United States Patent 11,931,406 (FLAVIVIRUS VACCINE) - sequence listing, part 54

SEQ ID NO: 19511 - RNA, 9879 nt, Artificial Sequence
  derived and/or modified CDS sequence (opt5) from DENV-1__EU863650__SS-prME
agcgugaccaugcugcucaugcugcuucccaccgugcugacguuccaccucaccacaagaggcggggagccucauaugaucguuuccaagcaggaacggggaaagucucugcuuuuuaagaccagcgccggcgugaauaugugcacacugauugcuauggaccucggggagcugugugaugacaccaugacauacaagugccccagaaucaccgaaacggagcccgaugacguggauuguuggugcaaugccaccgaaacaugggugaccuauggaacauguucccagaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaggaacaagacacaaauuucgucugccggcgcacguuuguggauagaggcuggggcaacggguguggacuguucggcaaagggagccuuauuaccugcgccaaguuuaagugcguuacaaaacuggagggaaagaucgugcaguacgaaaaucucaaauauucugucaucgugaccguucacacaggcgaccagcaucaaguggggaacgagaccacggaacacggaaccauugcgacaaucacaccccaggccccuacauccgagauucagcugaccgacuacggcgcucugacgcucgauuguagcccccggacaggccuggacuucaaugaaaugguccuucugaccaugaaggagaaaucuuggcucgugcauaagcagugguuucuggaucuuccucugcccuggacauccggggccagcaccucccaagagaccuggaaccgccaggaccuccuggucacauucaaaacggcucacgccaagaagcaggaagugguugugcugggaucucaagagggcgccaugcacaccgcucucacaggggcgaccgaaauccagacaagcggaaccacgacaauuuuugccggccaucugaaaugcagacuuaagauggauaaacugacccucaaggggaucuccuaugucauguguaccggccuguucaaacuggagaaggaaguggcugagacacagcacggaaccguucuugugcaggucaaguacgagggcacagacgccccgugcaaaaucccuuucagcucucaagaugaaaagggggccacgcagaauggacggcucgugaccgcuaaccccauugugacagacaaagagaagccuguuaauaucgaagccgagccgcccuuuggcgaguccuauauugucgugggggcgggagaaaaagcucugaagcugagcugguucaagaaaggcucuagcaucgggaagauguuugaggccaccgccagaggcgcucgccggauggccauucucggagauacagcuugggacuucggcuccaucgggggaguguuuaccucugucggcaaacuggugcaucagaucuucgggacggccuacggaguucuuuuuagcggcguguccuggaccaugaagauugggaucggcauucugcucacauggcugggacugaacagcagaucuaccucccuuagcaugacauguaucgcggucggcauggugacccucuaccuggggguuauggugcaggccgauucuggaugcgucauuaauuggaaaggccgcgaacugaaguguggguccggaaucuucgugacaaacgagguucacaccuggacggaacaauauaaguuucaggcugacagcccuaaacggcucuccgccgcuauuggcaaggccugggaggagggggugugcggcaucagaucugcgacacgccuggaaaacaucauguggaaacagauuagcaaugagcuuaaccauauccugcucgaaaaugacaugaaguucaccgucguggugggagaugucuccggcauucuggcccaggggaaaaagaccauccggccgcaacccauggagcacaaauacucuuggaaaagcuggggaaaggcuaagauuaucggcgccgacguucagaacacaaccuuuaucauugaugggccuaauacgcccgaauguccugacgaucagagagcuuggaacaucugggagguggaggacuauggauucggcauuuuuacaaccaauaucuggcugaaacuucgcgauuccuacacacaggugugcgaccaccggcucaugagcgccgccauuaaagauucuaaggcuguccaugcggacaugggcuauuggaucgaauccgagaaaaacgaaaccuggaagcuggccagagcuagcuucaucgaggugaagacauguguuuggcccaaaucucacacccuguggucccauggggugcucgaaagcgagaugauuaucccgaagauuuacggaggcccuaucucucaacacaauuaucgccccggguacuucacgcagaccgccggaccuuggcaccugggcaaacuugagcuggauuuugaccucugcgaagggacaaccgucgugguugaugagcauugcggaaaccggggccccagccugagaacaaccacggugacaggcaagauuauccacgaaugguguugccgguccuguacccugccuccccuucgcuucaaaggggaggacggaugcugguacggcauggagaucagaccggucaaggaaaaggaggaaaaucucgugaaaagcaugguuucugccggguccggagagguggacagcuuuucccugggccugcucuguauuucuaucaugauugaagaggucaugcggagcagauggucccgcaagaugcugaugacagggacccuugugguguuccugcuccugacccugggacagcuuacauggaacgaucugauccggcucugcauuauggucggcgcuaaugccucugacaacaugggcauggggacgaccuaucuggcgcucauggcuacauuuagaaugcgcccuauguucgccguuggacugcuuuuuagacggcugaccagccgcgaggugcuccugcugacagugggccuuucccuggucgccucuguggaacuccccaauagccuggaugagcucggggacggacuggcuaugggcaucaugauucuuaaacugcucaccgauuuccaaucccaucagcugugggccacgcugcuuagccugacauuuguuaagaccacccucucucugcacuacgcguggaaaacaauggcuaugauccucuccaucgugagccugcuuccccugugucugucuaccacaucccagaagacgaccuggcucccuguccugcuugggagccugggaugcaagccgcucacaauguuccugauuaccgaaaacaaaaucuggggcagaaagucuuggccccucaacgagggcauuauggccguggggaucguuuccauucugcuuagcucccugcugaaaaaugacgugccucucgccggaccccugaucgcuggcgggaugcuuaucgccuguuaugucauuagcggaucuagcgcugaucugucccucgaaaaggccgcgaaagugucuugggaggaggaagccgagcauagcggcgcuucccacaacauccuggucgaaauucaggacgaugggacaaugaagaucaaagacgaggaacgggaugacaccauuacgauccuccugaaggccacccuucuggcuaucucuggaguguacccuaugagcauucccgccacacuguuuguuuggcacuucuggcaaaagaaaaagcagcgcuccggcgugcucugggauaccccuucucccccggaggucgagaaagccgugcuggacgacggcaucuaucgcauucuucagcgggggcugcucggacgcagccagguuggcgugggggucuuucaagaaggaguguuccauacaauguggcacgugaccagaggcgcuguucugauguaccaggggaagcggcucgagccuuccugggcgagcgucaaaaaggaucugaucucuuauggaggcggcuggcgcuuccagggguccuggaauacaggagaagagguccaggugauugccgucgagcccggcaagaacccuaaaaaugugcaaacggcucccgggaccuuuaagacaagcgaaggagagguuggcgccaucgcccuugacuucaaaccggggaccucuggauccccuauugugaacagagaaggcaagaucgucggccuguacgggaauggagugguuaccacaagcggcacguacguguccgcuaucgcccaggcgaaggcuucucaggaggggccccugccugaaauugaggaugaggucuuucggaagagaaaccucaccaucauggaccugcaucccggaagcggcaagacacgccgguaucuucccgccauugugagagaagccaucaaacgcaagcugcggacccucguucuggcuccuacaagaguggucgccuccgagauggcggaagcucugaaagggaugccgauucgcuaccaaaccacggccgucaagagcgagcacacaggcaaagaaaucguggaucucaugugccaugccaccuucaccaugcggcuucugucucccgucagaguuccuaauuauaacaugaucauuauggacgaggcucacuuuacagaucccgccuccaucgcugcccgcggauacauuagcacccgggugggcaugggggaggcggccgcuaucuucaugacagccaccccucccggaucuguggaggcuuuuccucagagcaaugccgucauucaggacgaggaaaaggauaucccggagagauccuggaacucuggcuaugacuggaucacggauuuccccgggaagacagugugguuuguuccuagcauuaaauccggaaaugacaucgccaacugucugcggaagaauggcaaacgcgugauucagcucucuagaaagaccuucgacacagaauaccagaagaccaagaacaacgauugggacuaugucgugacgaccgauaucagcgagaugggggcuaauuuucgggcggaccgcguuauugaucccagacggugccugaagccugugauccuuaaagacggccccgagagagucauucuggccggaccgaugccugugacagucgcuuccgccgcccagcgccggggcagaaucgggcgcaaccagaauaaggaaggagaucaguacaucuacaugggccaaccccucaacaaugacgaggaucacgcucauuggaccgaagccaaaaugcugcuggacaacauuaauacacccgaggggaucauuccugcgcuguucgagcccgaacgggaaaagagcgcugccaucgauggagaauauagacuucgcggcgaggcccggaaaaccuucguggaacugaugagacgcggggaccugccuguuuggcucucuuacaagguggcuuccgagggcuuucaguauagcgauagacgguggugcuucgacggagagcgcaacaaucaggugcuggaagagaacauggacgucgaaauuuggacaaaagagggcgaaagaaagaaacuucggccgcgcuggcuggaugccagaaccuacuccgacccccucgcgcugcgggaguuuaaagaguucgccgcugggagacgcucuguuagcggagaucugauccucgaaaucggcaaacuuccucagcaccugacgcaacgggcccagaaagcucuggacaaucucgugaugcugcauaacuccgagcaagggggaaaggccuauagacacgcuauggaggaacuucccgauacaauugaaaccaucaugcugcucgcccugauugcggugcugaccggcggcgucacacucuuuuuccuuucugggcgcggacugggcaaaaccagcaucgggcugcucugugugacauccagcucugcccugcuuuggauggcuuccguugagccucacuggauugccgcuagcaucauccuggaguuuuuccucauggugcugcugauucccgaaccggaccggcagagaacgccucaagauaaucagcucgccuacgucgugaucggacuucuguuuaugauucugaccgucgccgcuacagagaugggccuccuggaaaccacaaagaaggaccuugggaucggacaugcggccgcugagaaccaccaucacgccgccaugcuggauguggaccuccaucccgcuucugccuggacccuguaugcgguugccacgaccauuaucacaccuaugaugcggcacaccauugagaauacaaccgcuaacaucucccugacggccaucgcuaaccaggccgcgauucucaugggccuugauaaaggcuggcccaucagcaagauggacauuggggugccucugcuggcccucggaugcuacucucaagucaauccccugacacuuaccgcugccgugcugaugcucguugcucacuacgccaucauuggcccggggcugcaggcuaaagccacacgcgaagcgcagaagagaaccgccgcuggaaucaugaaaaacccuaccguggauggcaucgucgccauugaccuggaccccgugguguaugaugcuaaguucgagaagcagcucgggcaaaucaugcuucugauucuguguacaagccagauccuccugaugcggacgaccugggcccuuugcgaauccauuacacuggccaccggaccccucacaacccugugggagggcucuccuggcaaauuuuggaauacgacaaucgcgguuagcauggcuaacaucuuccgcggguccuaccuggccggagcuggccucgccuuuagccuuaugaagucccucgggggaggcagacgggggaccggagcccagggcgaaacccugggcgagaaauggaagcgccagcucaaucaacugucuaaaagcgaguucaagacauauaagagauccgggauuaucgaagucgaccggucugaggcuaaagaaggacuuaagcgcggcgagaccacaaaacaugccgugagcagagggacggcgaagcugcggugguucguggaaagaaaccucgucaaaccggagggaaagguuauugaucugggcugugggcgcggaggcugguccuacuauugcgccggccugaaaaaggugaccgaggugaaggggucuacaaaaggaggccccgggcacgaggaaccuauccccauggcuaccuacggauggaaucucgucaaacuucauagcggcaaagacguguuuuucauuccucccgaaaagugugauacacugcugugcgacaucggggaguccagcccuaacccgaccauugaagagggacggacgcucagaguucugaaaaugguggagcccuggcuucgcggcaaucaguuuuguaucaagauccugaacccuuauaugcccucugucguggaaacccucgagcagaugcagcggaagcacggcgggaugcugguuagaaauccucugucccgcaacagcacacacgaaauguacugggugucuugcggaaccggcaauauugucuccgccgugaacaugacaagccggaugcuccugaauagauucaccauggcucaucgcaaacccacauacgagcgggauguggaccuuggggccggaaccagacacgucgcgguugagccggaaguggccaaccuggauaucauuggccaacgcaucgagaauauuaagaacgaacauaaaucuacguggcacuaugacgaggauaacccuuacaagacaugggcuuaucauggguccuacgaagugaaacccagcggauccgccagcucuauggucaauggcgugguucggcuccugaccaagcccugggacgugaucccuauggucacccagaucgcuaugacagacacgacccccuuuggccagcaaagaguguucaaggagaaaguugauacacgcaccccuaaggccaaaagagggacagcucagauuauggaggugaccgccaaguggcuuuggggauuucugagccggaacaaaaagccgcgcaucuguacaagagaagaguucacccggaaggucagauccaaugcggccauuggcgcuguguuuguugacgaaaaccaguggaacucucccaaagaggccguggaagaugagcgguucugggaccucguccaccgcgagagagaacugcacaagcaggggaaaugcgcuacgugcguguauaacaugaugggaaagcgggagaaaaagcugggcgaauuugggaaagccaagggcagccgcgccaucugguacauguggcucggagcgagauuccuggaguuugaagcucuuggcuucaugaaugaggaucauugguucucccgggagaacucucugagcggggucgaaggagagggccuccacaagcugggguauauucuucgcgacaucuccaaaaucccuggaggcaauauguacgccgaugacaccgccgggugggauacaagaauuaccgaagacgaucugcaaaacgaggcuaagaucacagacauuauggagcccgaacaugcccuccuggcuaccucuaucuuuaaacugacguaccagaauaaggugguucgggugcagcgcccugccaaaaacggcacagucauggaugugauuagcagacgggaccagcgcggauccggccaaguggggaccuauggacucaauacauucaccaacauggaggcgcagcugaucagacagauggaaagcgagggcaucuuucuucccucugaacuggagccgccuaaucucgccgggcggguucccgacuggcuggagaagcacggaacggaacgccuuagacggauggcuauuuccggcgaugacuguguggucaagccuaucgaugacagauucgccaccgcucugacagcccucaacgauauggggaaagugcgcaaggacauuccccagugggagccuagcaaaggcuggaacgauuggcaacagguucccuuuugcucucaccauuuccaccagcugaucaugaaggacggacgggaaauuguggucccguguagaaaucaggaugagcuggugggccgcgcgcgggucucccaaggggccggauggagccucagagaaaccgcuugccugggcaaauccuacgcccagauguggcagcuuauguauuuucaucgccgggaccugagacucgcugccaacgcuaucuguucugccgugccuguugauugggugcccacaagccgcaccacaugguccauucacgcgcaucaccaauggaugaccacggaggacaugcugagcgucuggaaucggguguggaucgaggaaaaccccuggauggaggacaagacacacguuucuuccugggaagaugugccuuaccuugggaagagagaggaccaguggugcggaagccugaucggccucaccgcccgcgcuaccugggccacaaauauucaggucgccaucaaccaggugcggagacugauugggaaugaaaacuaucuggauuacaugaccucuaugaaacgguucaagaaugagagcgacccggagggcgcucucugguga

SEQ ID NO: 19512 - RNA, 9879 nt, Artificial Sequence
  derived and/or modified CDS sequence (opt5) from DENV-1__KU365900__SS-prME
agcgugaccaugcugcucaugcugaugcccacagcccuugcuuuccaccugacgacccggggaggggaaccucauaugaucguguccaagcaggaacggggaaaaucucuccuguuuaagacaagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggagcacaaauacucuuggaaaagcuggggaaaggccaagauuaucggcgcugacgugcagaauaccaccuuuaucauugaugggccuaacacacccgaauguccugacgaucagagagcguggaauaucugggaggucgaggacuauggauucggcauuuuuaccacgaacaucuggcugaagcugcgcgauuccuacacacagguuugcgaccaccggcuuaugagcgccgcuauuaaagauucuaaggccgugcaugccgacaugggcuauuggaucgaauccgagaaaaaugaaaccuggaagcucgcuagagccagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgcgggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucagaggggaggacggaugcugguacggcauggagauucggccggugaaagaaaaggaggaaaaucuuguuaagagcauggugucugcugggccuggagaggucgacuccuuuagccucggccugcuguguaucuccauuaugaucgaagaggugaugagaucucgcuggagccggaaaaugcucaugacagggacccuggccguuuucuuucuucugauuaugggacagcucacauggaacgaucugaucagacugugcauuauggugggcgccaaugcuuccgaccgcaugggcauggggaccaccuaucuugcccugauggcgacauucaagaugagacccauguuugcugucggacuccugcuccggcgccugacgucuagagaggugcuucugcucaccaucggccugagccugguggccuccgucgaacuucccaacucucuggaggaacucggggauggacuggccaugggcaucaugauucucaaacugcuuacagacuuccaaagccaccagcugugggcuacccuccugucccugacauuuaucaagaccacguucagccuucauuacgccuggaaaacaauggcuaugguucugucuauugugucccucuuuccucugugucucagcaccaccucucagaagacaaccuggcugccggugcuucuggggucccugggaugcaagccccucacaauguuccugaucgccgagaauaaaauuuggggcagaaagagcuggccucuuaacgaaggcaucauggcggucgggaucgugucuauucugcucuccagccugcucaaaaacgauguuccccuggccggaccucuuaucgcuggcgggaugcugauugccuguuaugugaucuccggaagcucugcugaccugagccucgagaaggccgccgaggucuccugggaagaggaagcugagcacucuggcgcgagccauaauauucugguggaaguucaggaugacgggacgaugaaaaucaaggaugaggagcgcgacgauacccuuacaauccugcucaaagccacccugcucgcuguguccggagucuacccccugucuauuccugccacacuuuuugugugguauuucuggcaaaagaagaaacagagaagcggcguccugugggacacccccuccccgccugaaguggagcgggccguucuggaugacggcaucuaccgcauuaugcagagagggcuccugggacggucucaggugggcgucgggguguuccaagaaaacguuuuucacacgauguggcacgugacccgcggagcuguccuuauguaucagggcaagagacuggagcccagcugggccuccgugaaaaaggaccucaucagcuacgggggaggcuggcggcugcagggcucuuggaauacaggggaggaagugcagguuauugcggucgagccuggcaagaaucccaagaaugugcaaaccgcuccgggcacauucaagaccccugaaggggaggugggagccaucgcccucgauuuuaaacccggcacauccgggagcccuauugucaacagagaaggaaagaucgugggccuguacggcaaugggguugugacgaccucuggaacauaugucuccgcuaucgcccaggcgaaagcuagccaggagggcccccuucccgagauugaagacgagguguuccgcaagcggaaccugaccaucauggaucugcauccuggguccggaaaaaccagacgcuaccucccggccauuguucgggaagccaucaagagaaagcugcgcacacuuauucuggcucccacgcggguggucgccucugagauggcugaagcccucaaaggcaugccuaucagauaucaaaccacagcggucaagagcgagcacaccgggaaagagaucguugaccugaugugccaugccacauuuaccaugcgccugcucucccccgugcgggucccuaauuacaacaugauuaucauggaugaagcucacuucacggaccccagcucuauugccgcuagaggcuauaucuccacacgggugggaaugggcgaggccgccgcuauuuuuaugaccgcgaccccuccggggagcguggaagccuucccccagucuaaugcugucauccaggaugaggaacgcgacaucccugagagaagcuggaacuccggauacgaguggauuacagauuuucccggcaagaccguuugguucgugccuucuaucaaaagcgggaaugacauugccaacugucuucggaagaauggaaagcgcgugauccagcuguccagaaaaacauuugauaccgaauaucaaaagacgaaaaacaacgacugggacuacgucgugacaaccgauauuucugagaugggcgccaauuuccgggcugacagaguuaucgauccccgccggugccugaagccggugauucucaaagacgggccugaaagagucauccuggccggccccaugcccgugacaguugcgagcgcugcccagcgccggggaagaaucggccgcaaccauaauaaggagggggaucaguacauuuauaugggacagccucuuaacaaugacgaggaucacgcccacuggaccgaagcuaagaugcugcucgacaacaucaauacgcccgagggcauuaucccugcccuguucgaaccggagcgggaaaaauccgcggccauugauggggaguacagacugcgcggagaggcuagaaagaccuuuguggaacucaugcggcgcggcgaccuucccgucuggcugagcuauaaaguggccucugagggguuccaauacuccgauagaaaguggugcuuugacggcgaacggaacaaucagguccuggaggaaaacauggauguggagaucuggacaaaagagggagaacgcaagaaacucagaccucgguggcuggacgcuagaaccuauagcgacccccuugcccugcgcgaguucaaggaauuugcugccggccggagauccguuucuggggaucucauccuggagauuggaaagcugccucagcaucucacacagcgcgcgcaaaaugcccuugacaaccuggugaugcugcacaauagcgaacagggcgggcgggcuuacagacaugccauggaggagcuccccgauaccaucgaaacacugaugcuucuggcucucauugccgugcugaccggaggcgucacgcuguucuuucucuccggccgggggcuuggaaaaacaucuaucggccugcuguguguuauggccagcuccgugcuccuguggauggcuagcguggagccgcacuggauugcggccucuaucauccuugaguucuuucugaugguccuccugauuccugagcccgaccgccagagaaccccucaggauaaccaacuggcuuaugugguuaucgggcuccuuuucaugauucugaccguggccgccaaugagaugggacugcucgaaacaaccaagaaagaccugggcaucgggcacgucgcuguggagaaccaucaccaugccacaaugcuugaugucgaccugcaccccgcguccgccuggacgcucuacgcuguggccaccacaauuaucaccccuaugaugcggcauacaauugaaaacaccacggcuaauaucagccugaccgccaucgcgaaccaggccgcuauucugaugggacucgauaagggcuggcccaucucuaaaauggacauuggcguuccgcuucuggcccuggggugcuacucccaggugaauccucucacacugaccgcugccguccuuaugcugguggcucacuaugccaucauuggacccggccuccaagcgaaggccacacgcgaggcucagaagagaaccgccgcugggaucaugaaaaaccccacgguugauggaaucguggccauugaccuggauccugucguguacgacgccaaguuugaaaaacagcugggccagaucaugcuccuuauucuguguacaagccaaauccugcucaugcggaccacaugggcgcugugcgagucuauuacccuugcuaccgggccgcugacaacgcucugggagggaagccccggcaaguucuggaauaccacaaucgccguguccauggcuaacaucuuucgcggcucuuaucuggccggggccggacuggcuuucagccucaugaaaucccuuggcgggggaagacggggcaccggggcccagggagaaacacugggcgagaaguggaagcgccagcugaaucagcucagcaaauccgaguucaacaccuacaagagaucuggcauuauggagguugaccggagcgaagcgaaagaggggcugaagagaggagagacgacaaaacacgccgucucccgcggcaccgcuaaacuucggugguuuguggaaagaaaucuggugaagccugaggggaaagucaucgaucucggauguggccgcgggggauggucuuauuacugcgccggccugaagaaaguuaccgaagugaagggcuauacaaaagggggacccggccaugaggaaccuauucccauggcuaccuacggguggaaccuggugaagcucuacagcggaaaagacgucuucuuuaucccuccggagaagugugauacacuucugugcgacauuggcgaguccucucccaauccuacgaucgaagaggggcggacccugagagugcucaagaugguugaacccuggcugcgcggaaaccaauucuguauuaaaauccuuaauccuuauaugcccagcguggucgagacacuggagcagaugcagcggaagcacggcggcaugcucgugagaaacccgcugucccgcaauagcacccaugaaauguacuggguuucuugcgggacaggaaacaucguguccgccgucaauaugaccagccggaugcugcucaacagauuuacgauggcgcaccgcaaaccuaccuaugagaaggauguggaccugggcgccgggacacggcacguggcugucgaacccgagguugccaaccuugauauuaucggacagagaauugaaaauaucaaacaugagcacaagucuaccuggcauuacgacgaggauaaccccuauaagacaugggcuuaccacggcuccuaugaagugaaaccuagcgggucugccuccagcauggugaauggagucgugaagcugcucaccaaacccugggacguuauuccuauggugacacaaaucgcuaugaccgauacgacaccguucggccagcagcgcgucuuuaaggagaaaguggacaccagaacccccaaggccaagcggggcacagcgcaaaucauggaaguuacggcccgcuggcuguggggguuccuuuccagaaacaaaaagccucggauuuguaccagagaggaauuuacacggaaagugcgcagcaaugcugccaucggagcugucuucauugacgagaaccaguggaacucugccaaggaggccguggaagaugagagauuuugggaccugguucaucgggaacgcgagcuccacaaacagggcaagugcgcgaccugcguguacaacaugauggggaagagagagaaaaagcugggagaguucggcaaagcuaaggggagccgggccaucugguacauguggcugggcgcccgcuuucucgaguucgaagcucugggauucaugaaugaggaucacugguuuuccagagaaaacucucuuagcggcgucgagggggagggacugcauaaacucggcuauauucugcgggacaucuccaagaucucugggggaaauauguacgccgaugacacagcuggcugggauacccgcauuacagaagacgaucuucagaacgaggccaaaaucaccgacauuauggaacccgagcacgcgcugcucgccaaggcuaucuucaagcugacguaucaaaauaaaguggucagagugcagcggccugccaagaacgggaccguuauggaugugauuagccgcagagaccagcggggcuccggacaggucggcacauacgggcugaauaccuuuacaaacauggaagcucaacucauccgccagauggagucugagggaaucuucagccccuccgaacuggagaccccgaaccuugccgaaagagugcuggauuggcucggcaaauaugggguggagcggcugaagagaauggcgauuagcggagacgacuguguugugaaaccuaucgaugaccgcuuugccacggcucuuacagcccugaaugauaugggcaagguccggaaggacauuccccagugggaaccuucuaaaggguggaacgauuggcagcaagugcccuucugcucccaucacuuucaccagcucaucaugaaggacggcagagagauuguugugccuugucgcaaucaggaugagcuggucggacgggcuagagugagccagggcgccggguggucucugcgcgaaaccgcuugccucggaaaauccuacgcccaaauguggcagcugauguauuuccaucggagagaccuucgccuggcggccaacgcuaucuguagcgccguccccguggauuggguuccgacaucccggaccacguggucuauucacgcccaucaccaguggaugaccacagaggacaugcucagcguguggaauagagucuggaucgaagagaacccuuggauggaagauaagacccauaucuccagcugggaggacgugcccuaccugggcaaacgcgaggaccaauggugcgggucucuuauuggacugacagcucgggccaccugggcgacaaauauccagguugcuauuaaccaggugagacggcucaucggcaaugaaaacuaccuggauuauaugaccuccaugaagagauuuaagaaugagagcgaccccgaaggggcccugugguga

SEQ ID NO: 19513 - RNA, 9879 nt, Artificial Sequence
  derived and/or modified CDS sequence (opt5) from DENV-1__FJ176779__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuguggcgauggaccugggggagcucugugaagauacaaugaccuacaaaugcccgcgcauuacagaggcugaacccgacgauguggacuguuggugcaaugccaccgauacgugggucaccuauggaacauguucccaaaccggcgagcacagacgggacaagcgcucuguggcccuggcuccucauguugggcugggacucgagacaagaaccgaaacguggaugagcuccgagggcgccuggaaacagauccagcggguggaaacaugggcucugcgccaccccggcuucaccgucauugcccuuuuucuggcgcaugccaucgggacaucuauuacccagaagggaaucaucuucauucuccugaugcuugugaccccuagcauggcuaugagaugcguuggcaucgggucccgggauuuuguggagggacugagcggcgccacaugggucgacguggugcucgagcacgggucuugugucacgaccauggcuaaggauaaacccacacuggacauugaacugcucaagaccgagguuacaaacccugccgugcugcgcaaacuuugcaucgaagcgaagauuuccaauaccacgacagauagcagauguccgacccaaggagaggccacccugguggaagagcaggacgcuaacuucgucugccggcgcacauuuguggauagaggcuggggcaauggguguggacucuucggcaaagggucucugcuuaccugcgccaaguuuaagugcguuacaaaacuggagggaaagaucgugcaguacgaaaaccucaaauauuccgucauugugacgguucacaccggcgaccagcaucaaguggggaaugagagcacagaacacggaaccacagcuaccaucacgccccaggccccuaccacagagauccagcugaccgacuacggcgcccugacacucgauuguucuccccggaccggccuggacuucaacgaaaugguccuucugacgaugaaggagaaauccuggcucgugcauaagcagugguuucuggaucuuccucugcccuggacaagcggggcuuccaccucucaagagacauggaaucgccaggaccuccuggucaccuucaaaaccgcgcacgccaagaagcaggaagugguugugcugggaagccaagagggcgcuaugcacacagcccucacgggggccaccgaaauucagacauccggaaccacaaccaucuuugcuggccaucugaaaugcagacuuaagauggauaaacugacgcucaaggggaugagcuaugucauguguacaggcucuuucaaacuggagaaggaaguggccgagacccagcacggaaccguucuggugcagauuaaguacgagggcacagacgcgccgugcaaaaucccuuucuccacccaagaugaaaagggggucacacagaacggacggcuuauuacggcuaaucccaucgugaccgacaaagagaagccugugaacaucgaagccgagccccccuuuggcgagagcuauauuguuaucggggucggagaaaaagcccucaagcugucuugguucaagaaaggcagcuccauugggaagauguuugaggcuacagccagaggcgcucgccggauggccauccugggagauaccgcgugggacuucggcucuauugggggaguguuuacaagcgugggcaaacucguccaucagaucuucgggaccgccuacggagugcuguuuuccggcguuagcuggacgaugaagaucgggauuggcgugcuucugaccuggcucggacugaauucuagauccacaagccugucuaugaccuguaucgcugucggccuugugacacucuaccuggggguuauggugcaggccgauuccggaugcgucauuaacuggaaaggccgcgaacugaagugugggagcggaaucuucgugaccaaugagguucacacauggaccgaacaauauaaguuucaggcugacuccccuaaacggcucucugccgcgauuggcaaggccugggaggagggggugugcggcaucagaagcgcuacgcgccuggaaaacauuauguggaaacagaucuccaacgagcuuaaucauauccugcucgaaaacgacaugaaguucacagucguggugggagaugucgccggcauucuggcucaggggaaaaagaugauccggccgcaacccauggagcacaaauacucuuggaagaauuggggaaaggccaaaauuaucggcgccgacguucagaacagcaccuuuauuaucgaugggccuaauacccccgaauguuccgacgaucagagagcuuggaacaucugggagguggaggacuauggauucggcauuuuuacaaccaauaucuggcugaagcuucgcgauagcuacacgcaggugugcgaccaccggcucaugucugcggccauuaaagauuccaaggcuguccaugccgacaugggcuauuggaucgaaagcgagaaaaacgaaacauggaagcuggccagagcuucuuucauugaggugaagaccuguaucuggccuaaaucccacacacuguggagcaaugggguucucgaaucugagaugaucauucccaagaucuacggaggcccgauuagccaacauaacuaucgcccuggguacuucacccagacagccggacccuggcaccugggcaaacuugagcuggauuuugaccucugcgaagggaccacgguggucguggaugagcacugcggaaaucggggcccuucccugagaaccacaaccguuacaggcaagaucauucaugaaugguguugccggagcuguacccugcccccucuucgcuucagaggggaggacggaugcugguacggcauggagauccggcccgugaaagaaaaggaggaaaaccucgucaagucuaugguguccgcggggagcggagagguugacuccuuuucucugggccugcucuguaucagcauuaugaucgaagaggugaugagaucccgcuggucucggaaaaugcugaugacggggacacuugcugucuucuuucugcucauuaugggacagcugaccuggaaugaucugaucagacuuugcauuauggugggcgccaacgccagcgaccgcaugggcauggggacaaccuaucuggcucucauggccaccuucaagaugagaccgauguuugcggugggacugcucuuccggcgccugacauccagagagguccuucugcucacgaucggccugucucugguugcuagcguggaacuuccuaauucccuggaggaacucggggauggacuggccaugggcauuaugauccucaaacugcuuaccgacuuucaaagccaccagcugugggccacacuccugucuaugaccuucaucaagacaaccuuuucccugcauuacgcuuggaaaacgauggccauggugcuuagcauugucucucuguucccccucugucuguccacaaccagccagaagaccacauggcuccccgugcugcuugggucucugggaugcaagccucugaccauguuucucaucgcugagaacaaaauuuggggccggaaguccuggccgcugaacgaaggcaucauggccguugggauugugagcauccuucuguccagccuccugaaaaaugaugucccccucgcgggaccucugaucgccggcgggaugcuuauugcuuguuaugugaucucuggaagcuccgccgaccugucucuggagaaggcugccgagguuagcugggaagaggaagccgagcacuccggcgcuucucauaacauucucguggaaguccaggaugacgggacaaugaaaaucaaggaugaggagcgcgacgauacgcugaccauucuucugaaagcgacacuccuggccgugagcggagucuacccccucuccaucccugcuacccuguucgugugguauuucuggcaaaagaagaaacagagaucuggcguucuuugggacacacccagcccucccaagguggaacgggccguccuggaugacggcaucuaccgcauuaugcagagagggcugcucggacggucccaggugggcguugggguguuucaagagaaugucuuccacaccauguggcacgugacgcgcggagccgugcugauguaucagggcaaaagacuugaaccgagcugggcuucuguuaagaaagaccugaucuccuacgggggaggcuggcggcuccagggcagcuggaacaccggggaggagguccaggugauugccguggaaccuggaaagaaucccaagaacguccaaacagcgccuggcaccuuuaaaacacccgagggggaagugggagcuaucgcccuggauuucaagccgggcaccucuggguccccuauuguuaauagagagggaaaaaucgugggccucuacggcaacggggucgugacaacgagcggaaccuauguuuccgccauugcucaggccaaggcgucucaggaaggcccccugccugagaucgaggacgaaguguuucgcaaacggaaucuuacaaucauggaucugcaucccgggagcggaaagaccagacgcuaccugcccgcuauuguccgggaggccaucaagagaaaaaugcgcacccucauucuggccccuacacgggugguugcuuccgaaauggccgaggcucuuaagggcaugccgaucagauaucaaacgaccgccgugaaaagcgaacacacagggaaggagauugucgaccugaugugccaugcgaccuucacaaugcgccuccugucucccgugcgggugccuaacuacaauaugaucaucauggaugaggcccacuuuaccgaccccuccagcauugcugccagaggcuauaucucuacgcgggucggaaugggcgaagcugccgccauuuucaugacagcuaccccucccgggagcguugaggcguuuccucaguccaacgccgugauccaggaugaagagcgcgacauuccggaaagaucuuggaauagcggauacgaguggaucaccgaguuccccggcaaaacagugugguuugucccuuccaucaaggcugggaacgauauugccaauugucugcggaagaacggaaaacgcgugauccagcucucuagaaagaccuucgacacagaauaucaaaaaaccaagaacaaugauugggacuacguugugacgacagacauuagcgagaugggcgccaacuuccgggcugauagagucaucgacccccgccggugccuuaaaccugugauucugaaggaugggcccgaaagaguuauccuggccggcccgaugccugugaccgucgcguccgcugcccagcgccggggaagaauuggccgcaaucauaacaaggagggggaccaguacaucuauaugggacagccccucaauaacgaugaggaccacgcccacuggacagaagcuaaaaugcugcuugauaauaucaacacccccgagggcauuaucccugcccuguuugaacccgagcgggaaaagagcgcggccauugacggggaguacagacuccgcggagaggcuagaaaaacguucguggaacugaugcggcgcggcgaucugccugucuggcucucuuauaagguggccuccgagggguuucaauacagcgacagacgguggugcuucgauggcgaacgcaauaaccagguucuugaggaaaauauggacguggagaucuggaccaaagagggagaaagaaagaaacugcggccgagauggcuggaugcucgcacauauuccgacccccucgcccugcgggaguuuaaggaauucgcugccggcagacgcucugugagcggggaccuuauucuggagaucggaaagcucccucagcaucugacccagcgggcgcaaaacgcccuggauaaucucgucaugcuucacaacuccgaacagggcgggagagcuuaccggcaugccauggaggagcugcccgacacaaucgaaacccugaugcuccuggcucuuauugccguucugacaggaggcgugacccucuuuuuccugucuggcaaagggcugggaaagacgagcaucggccuccuuugugugauggccuccagcguccugcuguggauggcuucuguggagccucacuggauugcggccuccaucauucucgaauuuuuccugaugguucuucugauccccgagccggaucgccagagaacaccucaggacaaucaacucgcuuauguggucaucgggcugcuguuuaugauucucaccguggccgccaacgagaugggacuucuggaaaccacaaaaaaggaucugggcaucgggcacgucgcuguggagaaccaucaccaugccgcgaugcucgacguugaucugcaccccgccagcgcuuggacccuuuacgccguggcuacaacgauuaucaccccuaugaugcggcauacaauugaaaauaccacagccaacaucucucugaccgcgauugccaaucaggcugccauccucaugggacuggacaaaggcuggcccaucuccaagauggauauuggcgucccucugcucgcucuugggugcuacagccaggugaacccccugacgcugaccgccgcuguucucaugcugguggcccacuaugcgaucauuggaccgggccuucaagccaaggcuacacgcgaggcccagaaaagaaccgcugccgggaucaugaagaauccuacaauugacggaaucgucgccaucgaucuggaccccgugguguacgaugcgaaauucgaaaagcagcucggccagauuaugcugcugauccucuguaccucucaaauucuucugaugcggacgacaugggcucugugcgagagcaucacccucgccacagggccccugaccacccuuugggagggauccccuggcaaauuuuggaacacaacgauugcuguuucuauggccaauaucuuccgcggcagcuaucuggccggggcuggacucgccuucucccugaugaagagccugggcgggggaagacggggcaccggggcgcagggagaaacacucggcgagaaguggaaacgccagcuuaaccagcuguccaagucugaauuuaauaccuacaaaagaagcggcaucauggaggucgaccgguccgaagccaaggaggggcugaaaagaggagagacaaccaagcacgcugugucucgcggcacggccaagcuccggugguucguggaaagaaaccuggucaaaccggaggggaagguuauugaccuuggauguggccgcgggggauggagcuauuacugcgcuggccugaaaaaggugacagaagugaaaggcuauaccaaggggggacccggccaugaggaaccuauccccauggccaccuacggguggaaucucgucaaacugcacuccggaaaggauguguuuuucauuccucccgagaagugugacacacugcucugcgauaucggcgagucuagcccuaacccgaccauugaagaggggcggacacuuagaguucugaaaaugguggaacccuggcugcgcggaaaucaauuuuguaucaagauucucaacccuuacaugcccuccgucguggagacgcuggagcagaugcagcggaaacauggcggcaugcuuguuagaaauccucugagccgcaacucuacccacgaaauguauuggguguccugcgggacaggaaauaucgucagcgcggugaacaugaccucucggaugcuccugaacagauucacaauggcccaccgcaagcccaccuacgagcgggacguggaucugggcgcugggacgagacaugucgccguugaaccggaggugaccaaucucgacaucauuggacagcgcaucgaaaacauuaaauaugagcacaaguccacauggcauuacgaugaggacaauccuuauaagaccugggcuuaccacggcagcuaugaagugaaacccucuggguccgccagcuccauggucaacggagugguuaagcugcuuacaaaacccugggaugugaucccuauggucacccaaauugcuaugacagacaccacgcccuuuggccagcagagaguguucaaggagaaaguugauacacggaccccuaaggccaagcgcggcaccgcgcaaaucauggaagugacagccagauggcuguggagcuuucucucucggaauaaaaagccgagaaucuguacgcgggaggaauucacccgcaaagucagaagcaacgcugccauuggggcuguguuuguugacgagaaucaguggaacuccgccaaggaggccguggaagacgaucgguucugggaccugguccaucgcgagagagaacuucacaaacagggaaagugcgcgacaugcguguacaauaugaugggcaagcgggagaaaaagcugggggaauuuggaaaagcuaagggcucucgcgccaucugguacauguggcucggggccagauuccuggaguucgaggcucugggcuuuaugaacgaagaucacugguucagccgggagaauucccucucuggagucgaaggcgaggggcugcauaaacuuggauauauucugcgcgacaucagcaagauucccggcgggaacauguacgccgaugacaccgcuggaugggauacaagaaucaccgaggacgaucuccagaaugaagccaaaaucacagacauuauggagccugaacacgcgcugcuugccaaguccaucuuuaagcugaccuaucaaaacaaagugguucgggugcagcgccccgcuaagaauggcacggucauggaugugauuucuagacgggaccagcgcgggagcggccaggugggaaccuacggccucaacacauucaccaacauggaggcccaacugaucagacagauggaauccgaggggauuuuuagcccuaaugagcuggaaacacccaaccucgcugagcggguucuggauuggcuugaaaaauauggaguggagagacugaagcgcauggccaucucuggcgacgacugugucgugaaaccgaucgaugaccgguucgcgaccgcccucacggcucugaaugauauggggaagguuagaaaggacauuccucagugggaacccuccaaaggauggaacgauuggcagcaagugccuuuuugcagccaucacuuccaccagcuuaucaugaaggacggccgcgagauugucgugcccugucggaaucaggaugagcuggucgggagagcccgcgugucucagggcgcuggauggucccuccgggaaacagccugccugggcaaaagcuacgcucaaauguggcagcugauguauuuucauagacgcgaccuccggcuggccgcgaacgccaucuguuccgcuguuccuguggauuggguccccaccucuagaacaaccuggagcauucacgcccaucaccaguggaugacgaccgaggacaugcuuuccguguggaaucgcguuuggaucgaagagaacccguggauggaagauaagacacggauuagcucuugggaggacgugccuuaccuggggaaaagagaggaccaauggugcggaucccucaucggccugaccgcccgggcuacaugggccaccaauauccaggucgcgauuaaccaggugagacgccuuaucgggaaugaaaacuacagcgauuauaugacaucuaugaagcgguucaagaaugagagcgaacccgagggagcucugugguga

SEQ ID NO: 19514 - RNA, 9879 nt, Artificial Sequence
  derived and/or modified CDS sequence (opt5) from DENV-1__FJ176780__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaauaugugcacccuuauugcgauggaccugggggagcucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaaguucacaguuguggucggagauguggcuggcauucucgcccaggggaaaaagaugauccggccgcaacccauggaguacaaauauucuuggaaaagcuggggaaaggccaagauuaucggcgcugacgugcagaauaccaccuuuaucauugaugggccuaacacacccgaauguccugacgaucagagagcguggaauaucugggaggucgaggacuacggauucggcauuuuuaccacgaacaucuggcugaagcugcgcgauuccuauacacagguuugcgaccaccggcuuaugagcgccgcuauuaaagauucuaaggccgugcacgccgacaugggcuacuggaucgaauccgagaaaaaugaaaccuggaagcucgcuagagccagcuucaucgaggugaagacauguauuuggcccaaaucucauacccugugguccaacgggguccuggaaagcgagaugaucauuccgaagaucuauggaggcccuauuucucaacacaauuaccgccccggguacuucacacagaccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggaaaaugcucaugacagggacccuggccguuuucuuucuucugauuaugggacagcucacauggaacgaucugaucagacugugcauuauggugggcgccaaugcuucugaccgcaugggcauggggaccaccuaccuugcccugauggcgacauucaagaugagaccuauguuugcugucggacuccuguuccggcgccucacgagcagagaggugcugcuucugaccaucggccucucccugguggccucugucgaacugcccacaagccuugaggaacugggggauggacucgccaugggcaucaugauucugaaacuccugaccgacuuucaaucccaucagcuuugggcuacacugcucagccugaccuucguuaagacgacauuuucucugcacuaugccuggaaaaccauggcuauggugcuuuccaucgugagccuguucccccucugucugucuaccacaucccagaagaccacauggcucccuguccugcuugggagccugggaugcaagccgcugacgauguuucucauugccgagaacaaaaucuggggccggcgcucuuggccccugaaugaaggcauuauggcgguggggaucguuuccauccuucugagcucccuccugaagaacgaugugccucucgccggaccccugauugcuggcgggaugcuuaucgccuguuacgucauuagcggaucuagcgcugaccugucccuggagaaagccgccgaggugucuugggaagaggaagcugagcauagcggcgcgucccacaacauccucguugaagugcaggaugacgggaccaugaagauuaaagaugaggagagagacgauacacugaccauccuucugaaggccacacuccuggcugucucuggaguguauccucucagcauccccgccacccuguucgucugguacuucuggcagaagaagaagcagcgguccggcgugcuuugggacacgccuucucccccggaaguugagcgcgccgugcuggaugacggcauuuauagaaucaugcagcgggggcugcucggacgcagccaggucggcguggggguuuuucaagaaaauguguuccauaccauguggcacgucacaagaggagcugugcugauguaccagggcaaacggcuugagccuuccugggccagcgugaagaaagaccugauuucuuacgggggaggcuggagacuccagggcuccuggaacaccggggaggaaguucaggucaucgcgguggagcccggaaagaauccuaaaaacgugcaaacagcucccggcaccuuuaagacaccggaaggggaggucggagccauugcccuggauuucaagccuggcacgagcgggucucccaucgugaaucgcgaaggaaaaauuguuggccucuauggcaacgggguggucaccacauccggaaccuacgugagcgcuaucgcccaggcgaaggcuucccaggagggcccucugcccgagaucgaagacgagguuuuucggaaaagaaaucuuaccauuauggaucugcaccccgggucuggaaagacacgccgguaucugccugccaucgugagagaagccauuaaacgcaagcuccggacgcugauccuugcuccgaccagagucguggccagcgagauggcugaagcccugaagggcaugcccauucgcuaccaaacaaccgcgguuaaauccgagcauacagggaaggagaucguggaccucaugugccacgccaccuucacgaugcggcugcugagcccugucagagugcccaacuauaauaugaucauuauggaugaagcucauuuuacagacccuucuuccaucgccgcucggggcuacauuagcacccgcgugggaaugggcgaggccgccgcuaucuucaugaccgcgacacccccugggucugucgaagccuuuccgcagagcaacgcuguuauucaggaugaggaaagagacauccccgagcgguccuggaacucuggauaugaguggaucaccgauuucccuggcaaaacagugugguuugugcccagcauuaaguccgggaacgacaucgccaauugucuccgcaaaaacggaaagagagucauucagcuuucucggaagaccuucgauacggaauaccagaaaacaaagaauaacgacugggacuacgugguuaccacagauaucagcgagaugggcgccaacuucagagcugaccgcgugauugauccucggagaugccugaaacccgucauccugaaggacgggccggaacgcgugauucucgccggcccuaugcccguuaccguggcguccgcugcccagcggagaggacgcaucggccggaaucacaacaaagagggggaucaguauaucuacaugggacagccccugaauaacgacgaggaucaugcccacuggacggaagcuaagaugcuucuggacaauauuaacaccccugagggcaucauucccgcccucuuugaaccugagagagaaaagagcgcggccaucgauggggaguaucgccugagaggagaggcucggaaaacauucgucgaacugaugcgcagaggcgaccucccgguguggcuuucuuacaaggucgccuccgagggguaucaauacagcgaucggcgcuggugcuuugacggcgaaagaaauaaccaggugcuggaggaaaauauggauguugagauuuggaccaaagagggagaacggaagaaacugagaccccgcuggcucgacgcucggacauauuccgacccucuggcccuuagagaguucaaggaauuugcugccggccgccggucugugagcggggaucugauccucgagaucggaaaacugccccagcaccugacccagagagcgcaaaacgcccucgacaaucuugugaugcugcauaacuccgaacagggcgggcgggcuuaccgccacgccauggaggagcugccugauacaauugaaacccucaugcugcuugcucugaucgccguccucacgggaggcguuacacuguucuuucugucuggcagagggcucggaaagaccagcauuggccuucugugugugauggccuccagcgugcugcucuggauggcuucugucgagccccauuggaucgcggccuccauuauccuggaguucuuucuuauggugcugcucaucccggagccugaccggcagcgcacaccccaagauaaucaacuggcuuacguugugauugggcuccuguucaugauccuuaccgucgccgccaacgagaugggacugcuggaaaccacaaagaaagaccucggcauugggcacguggcugucgagaaucaccaucacgccgcgaugcuggauguggaccuucauccugccagcgcuuggacgcuguaugccguugcuaccacaaucauuacccccaugaugagacacacaaucgaaaacaccacggccaacauuucucucaccgcgaucgccaaucaggcugccauccugaugggacuggauaagggcuggccuauuuccaaaauggacaucggcgugccccuccuugcucuggggugcuacagccaggucaacccgcugacacucaccgccgcugugcugaugcuuguugcccauuaugcgauuaucggaccuggccugcaagccaaggcuacacgggaggcccagaaacgcaccgcugccgggauuaugaagaaucccacgguggauggaaucgucgccaucgaccucgaucccgugguguacgacgcgaaguuugaaaaacagcugggccagauuaugcugcucauccuuuguacaucucaaauucugcugaugagaaccacaugggcucucugcgagagcaucacccuggccaccgggccucuuacaacgcugugggagggauccccgggcaaguucuggaacaccacaauugcuguuucuauggccaauaucuuucggggcagcuaucucgccggggcuggacuggccuucucccugaugaaaagccucggcgggggacgcagaggcaccggggcgcagggagaaacacuuggcgagaaguggaaacggcagcugaaccagcuguccaagucugaguucaauaccuacaagagaagcggcaucauggaggucgaccgcuccgaagccaaagaggggcucaagcggggagagacgacaaaacacgcugugucuagaggcaccgccaagcugcgcugguuuguggaacggaaccuugucaaacccgaggggaagguuauugaucugggauguggcagagggggauggagcuauuacugcgcuggccucaagaaagugaccgaagugaagggcuacacaaaagggggaccuggccacgaggaacccaucccuauggccaccuauggguggaaucuggucaagcugcauuccggaaaagacguguucuuuauucccccugagaagugugauacacuccuuugcgacaucggcgagucuagcccgaaccccacgauugaagaggggcgcacccugcggguucugaaaaugguggaaccuuggcucagaggaaaucaauucuguaucaagauucugaaccccuacaugccuuccgucguggagacacuugagcagaugcagcgcaagcacggcggcaugcugguucggaauccccucagcagaaacucuacccaugaaauguauuggguguccugcgggacaggaaauaucgucagcgcggugaacaugaccucucgcaugcugcugaaucgguuuacgauggcccacagaaaaccgaccuacgagcgcgauguggaccucggcgcugggacaagacacgucgccguugaaccugaggugaccaaccuggauaucauuggacagcggaucgaaaacauuaagcaugagcacaaauccacauggcauuaugacgaggauaaucccuacaagaccugggcuuaucacggcagcuacgaagugaaacccucuggguccgccagcuccauggucaacggagugguuaaacuucugacaaagccuugggacgugauccccauggucacccaaauugcuaugacggauacaaccccuuucggccagcagcgcguguuuaaagagaagguugacaccagaacaccgaaagccaagcggggcacggcgcaaaucauggaagugaccgccaaauggcucuggggguuccugagcagaaauaagaagccccggaucuguacacgcgaggaauuuaccagaaaaguccggucuaacgcugccauuggagcuguguucguugacgagaaucaguggaacagcgccaaggaggccguggaagaugagcgcuuuugggaccuuguccauagagaacgggagcugcacaaacagggcaagugcgcgacaugcguguacaauaugauggggaaacgcgaaaagaagcucggagaguucggcaaagcuaagggguccagagccaucugguauauguggcugggcgcccgguuucuggaguucgaagcucucggauucaugaacgaggaucacugguuuucucgcgaaaauagccuguccggcgucgagggggagggacuucauaaacugggcuacauucucagagacaucucuaagauuccugggggaaacauguaugccgaugacaccgcuggcugggauacacggaucaccgaagacgaucugcagaaugaggcccgcaucacggacauuauggaacccgagcacgcgcuucuggccaaaagcaucuucaagcucaccuaccaaaacaaagugguuagagugcagcggccugcuaagaaugggacagucauggaugugauuucccgcagagaccagcggggcucuggacaggugggcaccuaugggcugaacacauuuaccaauauggaagcccaacugaucagacagauggagagcgagggaauuuucucccccagcgaacucgagacgccgaaccuggcugaacgcguucuugauuggcuggagaaguacggcguggaacggcucaaaagaauggccaucucuggggacgacugugucgugaagccuaucgaugaccgcuuugcgacagcccugaccgcucuuaacgauaugggaaaaguucggaaggacauuccccagugggagccuuccaaaggcuggaaugauuggcagcaagugcccuucugcagccaucacuuucaccagcugaucaugaaggacgggagagagauugucgugccuugucgcaaccaggaugaacucgucggccgggccagagugucucagggagcuggcuggucccugcgcgagacagccugccugggaaagagcuaugcucaaauguggcagcucauguacuuccaucggagagaccugcgccuugccgcgaaugccaucuguuccgcuguucccguggauuggauuccgaccucucggacgaccuggagcauccacgcccaucaccaguggaugacaaccgaagacaugcuguccgucuggaacagaguguggauugaggaaaauccuuggauggaggauaaaacacauaucagcucuuggggagacguucccuaccucggcaagcgggaggaccaauggugcgggucccugaucggacuuaccgccagagcuacaugggccaccaacauucagguggcgaucuaucagguccgccggcugauuggcaaugaaaacuaccucgauuauaugacgagcaugaaaagauuuaagaaugagucugaccccgaaggggcucugugguga

SEQ ID NO: 19515 - RNA, 9879 nt, Artificial Sequence
  derived and/or modified CDS sequence (opt5) from DENV-1__JN205310__SS-prME
agcgugaccguccuguucaugcugcugcccaccgcccuugcuuuucaccugacgacccucggcggggaaccucauaugaucguuuccaagcaggaaagaggaaagucucugcuuuucaagacaagcgccggcgugaauaugugcacccugauugcgauggaccucggggaacugugugaagauacaaugaccuacaagugcccgcggaucacagagaccgaacccgacgauguggacuguuggugcaaugcuacggagaccugggucacauauggaaccuguucccaaacaggcgagcaccgcagagauaagcggucuguggcccuggccccucauguugggcucggacuggaaacccgcacggagacauggaugagcuccgaaggcgcuuggaagcagauucagaagguggagaccugggcccuuagacaccccggcuuuacagucaucgcucuguuccucgcccaugcgauugggaccucuaucacccagaagggaaucauuuuuauccugcuuaugcuggugacaccuagcauggccaugcggugcguuggcauugggaaccgcgacuucguggagggacccuccggcgcuacgugggucgauguggugcucgaacacgggagcugugucaccacaauggccaaaaauaagccuacccuggacaucgagcugcucaaaacagaaguuaccaacccggcuauucugagaaaacuuugcaucgaggccaaaauuucuaauacgacaaccgauucccggugucccacccaaggagaagcgacacugguggaggagcaggacaccaacuuugugugccgcagaacauucgucgaucggggcuggggcaauggguguggacucuuuggcaaggggagccugaucacgugcgccaaguucaaaugcgugaccaaacuugaaggaaaaaucguucaguacgagaaccugaaguauucugugauugucacagugcacaccggcgaccagcaucaaguugggaaugaaacaaccgagcacggaacgaccgcuaucauuacaccucaggcccccaccuccgaaauccagcucacagauuacggcgcucugaccccugacuguagcccccgcacgggccuggacuuuaacgagauggugcuccugacaaugaaagagaagucuuggcuuguccauaaacagugguuccuggaucucccgcugccuuggaccuccggggccagcacaucccaagaaaccuggaauagacaggaccuucuggugaccuuuaagacagcccacgcuaagaaacaggaggucgugguucucggaucucaagaaggcgcgaugcacacggcccugaccggggcuacagagauucagaccagcggaacaaccacgaucuucgccggccaucugaagugccggcucaaaauggauaagcugacacuuaaagggguguccuaugucauguguaccggcagcuucaagcuggaaaaggagguggccgagacccagcacggaacaguucucgugcaggucaaauacgaaggcaccgacgcucccugcaagaucccuucuuccagccaagaugagaaaggggugauucagaacggacgccugaucacagccaaucccauugugacggacaaggaaaaacccguuaacaucgaggcggagccuccguuuggcgaaucuuauauugucgugggggcuggagagaaggcccugaaacuuagcugguucaaaaagggcuccucuaucgggaaaauguuugaagccaccgcuagaggcgcccggagaauggcuauccucggagauacagccugggacuucggcagcauugggggaguguuuaccuccgucggcaagcuggugcaucagaucuucgggacagcguacggaguucuguuuagcggcgugucuuggaccaugaaaauugggaucggcauucuccugacguggcuuggacucaauucccgcagcaccucucucuccaugacauguaucgccgucggcauggugacccuguaccuggggguuauggugcaggcugauagcggaugcgucauuaacuggaagggccgggagcuuaaguguggguccggaaucuucgugacaaacgaaguucacaccuggacagagcaauauaaauuucaggccgacucucccaagagacucagcgcugccaucggcaaagcgugggaggaaggggugugcggcauucgcuccgccacccggcuggagaauaucauguggaagcagauuucuaacgaacugaaucauauccuccuggagaacgauaugaaauucacggucguggugggagacgucagcggcauucuugcucaggggaagaaaaugaucagaccucaacccauggaacacaaguacuccuggaaaagcuggggaaaagccaagaucauuggcgcugacguucagaauacaaccuuuaucauugaugggccuaacacccccgaguguccggacaaucagcgcgccuggaacaucugggagguggaagauuauggauucggcauuuuuacaaccaauaucuggcugaaacuccgggacucuuucacgcaagugugcgaucacagacugauguccgccgcuaucaaggacagcaaagcgguccaugccgauaugggcuacuggauugagucugaaaagaaggagacauggaaacuggcucgcgccuccuucaucgaagugaagaccuguauuuggccuaaaagccacacacuuuggucuaacgggguucucgagagcgagaugaucauucccaagaucuauggaggcccugugucccaacauaauuaccggcccggguauuuuacccagacagccggaccuuggcaccugggcaaacuggaacucgacuucgaucugugcgaggggaccacggucgugguugacgaaaacugcggaaauagaggccccagccuucgcaccacaaccgugacaggcaagaccacgcacgagcgguguugcagaucuuguacacugccgccucuccgguuuaagcgcgaggaugggugcugguacggaauggaaaucagacccgucaaagagaaggaagagaaccuggugaaauccaugguuagcgcuggcuccggggaaguggacucuuucagccugggacuucucuguauuuccaucaugauugaggaggucaugcggucuagauggagccgcaagaugcugaugaccggcacacuggccguguuucuccugcuuaccauggggcaguccaccuggaaugaucugauccggcucugcacaauggugggagcgaacgcuucugacaugaugggcaugggcacgaccuaccuggcccugauggccacauucagaaugcgccccauguuugcugucgggcuucuguucagacggcucaccagccgcgaaauucugcuccugacaguuggacuuucccugguggccagcguggagcucccuaacucucuggaagaacugggcgacgggcuugcgaugggaaucaugaugcugaaacuccugaccgauuuucaaccgcaucagcucugggcuacgcugcuuucccugacauucgucaagaccacccucagccugcacuaugccuggaagacaauggccaugauucugucuaucgugucccuucugccccucugucugagcaccacaucucagaaaacgaccuggcucccuguucugcuuggcucccuggggugcaagccccugacaauguuucucaucaccgaaaauaaaauuuggggaagacggagcuggccucugaacgagggcaucauggcuauuggcaucguguccauucuucugagcucuccccucaagaaugacgucccucuggccgggccccucaucgcuggaggcaugcugaucgccuguuacgugauuagcggguccucugcggaucuuagccuggagaaagccgcugaaguuuccugggaggacgaagccgagcauucuggagcuagccacaacauccugguggaaguccaggaugacggcacaaugaagauuaaagaugaggagcgcgacgauacccucacgauccugcuuaaggccacccugcucgugauuuccggggucuauccgaugucuaucccugccacacuguucgugugguacuuuuggcaaaagaaaaagcagagaagcggaguucucugggacacccccuccccucccgaaguggagcgggcuguccuggauaauggcaucuaucgcauucuucagagaggccugcuggggcggagccaggugggaguuggcguguuccaagaaggggucuuccauacaauguggcacgugacccgcggagcggugcucauguaccagggcaaaagacuggagccgucuugggccuccguuaagaaagaccuuaucagcuaugggggaggcuggcgguuucagggcucuuggaacacaggggaggaaguccaggugauugcuguggagccuggaaagaaucccaagaacguccaaacgaccccuggcacauucaaaacccccgaaggggaggugggagccaucgcccuggauuuuaagcccggcaccuccgggagcacaauuguuaauagagaaggaaaaaucgugggccucuacggcaacggggucgugacgaccuccggaacauacguuucugcuauugcccaggcgaaggcuagccaggagggcccucugccggagaucgaagacgagguguuccgcaaacggaaucucaccaucauggaccugcaccccggguccggaaagacaagacgcuaucuuccugccauuguccgggaagccaucaagagaaaacugcgcacccuggugcucgcucccacgcggguuguggccagcgagauggcggaagcucugaagggcaugccuauuagauaccaaacaaccgccgucaaaucugagcauaccgggaaggagaucguggaucuuaugugccacgccacauuuaccaugcgccugcucucccccgugcgggucccuaacuauaauaugauuaucauggacgaagcucauuucacagauccggccagcaucgcugccagaggcuacauuucuacccggguuggaaugggcgaggcggccgcuaucuuuaugacggccacacccccugggagcguggaggcuuucccccaguccaacgccgugauucaggacgaagaacgcgauaucccugagagaucuuggaauagcggauaugaguggauuaccgacuuucccggcaaaacagucugguucgugccguccaucaagucugggaacgauaucgccaacugucugcggaagaauggaaaacgcguugugcagcugagcagaaagaccuuugacacggaauaccagaagaccaagaacaaugauugggacuaugucgugacaaccgauauuuccgagaugggcgcuaacuuccgggcggacagaguuaucgacccucgccggugccucaaacccgugauucuuaaggaugggcccgaaagagucauccuggccggcccuaugcccgugacagucgcuagcgccgcccagcgccggggaagaauuggccgcaauccuaacaaggagggggaccaguacguguacaugggacagccgcugaauaacgaugaggaccacgcucauuggaccgaagccaaaaugcuccuggauaauaucaacacacccgagggcauuaucccugcgcuuuucgaacccgagcgggaaaagucugcugccaucgacggggaguauagacugcgcggagaggccagaaaaaccuuuguugaacucaugcggcgcggcgaucugccuguguggcuguccuacaagguggcuagcgagggguuccaauauuccgacagacgguggugcuuugauggcgaacgcaauaaccagguccucgaggaaaauauggacguugagauuuggacgaaagagggagaaagaaagaaacuucggcccagauggcuggaugcccgcacauacucugacccgcuggcgcuccgggaguucaaggaauuugccgcuggcagacgcagcguguccggggaucugauccuugagauuggaaagcugccucagcaccucacccugaaagcccagaacgcucuggacaaucucgugaugcuucacaacucugaacaaggcgggaaggccuaucggcaugcuauggaggagcugcccgacaccaucgaaacacugaugcuccuggcccuuauugcgguccugaccggaggcgugacacucuucuuucugagcggcagagggcugggaaaaacguccaucggccuccuuuguguuauggccagcucugugcugcuguggauggcuuccgucgagccucacuggaucgccgcuagcauuauccucgaguucuuucugauggugcuucugauucccgagccugaucggcagcgcacaccgcaggacaaccagcucgccuacgucgugaucgggcugcuguucaugauucucacaguugccgcuaaugagaugggacuucuggaaaccacaaagaaagaucugggcaucgggcaugcggccgcugagaaccaccaccaugccgccaugcucgacguggaucugcacccggcuucugccuggacccuuuaugcggucgccacgaccaucauuacaccuaugaugagacauaccaucgaaaauacaaccgcuaacauuucccugacggccaucgcuaaucacgccgcgauucucaugggacuggacaagggcuggcccaucagcaagauggauauuggcgugccccugcucgcccuugggugcuacucucaaguuaacccucugacacugaccgcugccgugcucaugcuggucgcucauuacgccaucaucggaccgggccuucaggcuaaagccacacgggaggcgcagaagcgcaccgccgcugggauuaugaaaaaucccaccguggacggaaucguggccauugaucuggacccuguugucuaugaugcuaagaucgaaaaacaacucggccagauuaugcugcugauccucuguacaagccagauccuucugaugagaacgaccugggcccugugcgaguccauuacacucgccaccgggccccugacaacccuuugggagggaucuccuggcaaguuuuggaacacgacaaucgcggugagcauggcuaauauuuuccggggcuccuaccuggccggggcuggacucgccuuuagccugaugaagucccugggcgggggacgcagaggcaccggggcccagggagaaacccucggcgagaaauggaagcggcaacuuaaccagcugucuaaaagcgaguucaauaucuauaagcgcuccggcauuaucgagguggacagaucugaagcuaaagaggggcugaagcggggagagacaaccaagcacgccgucagcagaggcacagcgaaacuccgcugguucguugaacggaaccuggugaagcccgaggggaaagugaucgaucuuggauguggcagagggggaugguccuacuauugcgccggccugaagaaagucacggaagugaagggcuacaccaaagggggaccuggccacgaggaaccgauucccauggcuacauauggguggaaucucguuaagcugcauucuggaaaggacguguuuuucaccccucccgagaaaugugacacacugcucugcgauaucggcgagagcuccccuaaccccaccauugaagaggggcgcacgcuucggguccugaagaugguggaaccguggcugagaggaaaucaguuuuguaucaaaauucucaacccuuacaugcccagcguuguggagacccuggagcagaugcaacgcaagcacggcggcaugcuuguccggaauccccugucuagaaacuccacacaugaaauguacugggugagcugcgggaccggaaacaucgugucugccgucaauaugacaucccgcaugcuccugaaccgguucaccauggcucacagaaaaccuacauaugagcgcgacguugaucugggcgccgggacccggcacguggcgguggaacccgaggucgccaaucucgacauuaucggacagagaaucgaaaacauuaagaaugagcauaagagcacguggcacuacgaugaggacaacccuuauaaaacaugggcuuaccauggcucuuaugaagugaagccguccgggagcgccuccagcaugguuaauggagugguccgccugcuuaccaaacccugggaugugaucccuaugguuacccagauugcuaugacagacacgacccccuuuggccagcaaagaguguucaaggagaaagucgauacacggaccccuaaggccaagcgcggcacagcucagaucauggaagugaccgccagauggcuguggggguuucucucucggaacaaaaagcccagaauuuguacacgggaggaguucacccgcaaaguuagaagcaaugcggccaucggagcuguguuugucgacgagaaccaguggaacuccgccaaggaggcuguggaagaugagcgguucugggaccugguccaccgcgaaagagagcuucauaaacaaggcaagugcgccacgugcguguacaacaugauggggcggcgcgaaaagaaacugggagaguuuggcaaggccaaagggucuagagcgaucugguauauguggcucggcgcucgguuccuggaguuugaagcccugggauucaugaaugaggaccacugguucagccgcgaaaacucccucucuggcguugagggggagggacaccauaagcugggcuacauucuuagagauaucagcaaaauucccgggggaaauauguacgccgacgauaccgcuggcugggacacacggaucaccgaagaugaccugcagaacgaggccaagauuacagauaucauggaaccugagcacgcucuccuggccaccuccaucuuuaaacuuacguaucagaacaaggugguccgcgugcagagacccgcgaagaaugggacagugauggacguuauuucucggcgcgaucaaagaggcagcggacaggugggcaccuacgggcugaacacauucaccaauauggaagcccagcucauccggcagauggaguccgagggaauuuuuagcccuucugaacuggagacgcccaaccuggcugaaagagucuucgacuggcucgagaaacauggcaucgaacgccugaagcggauggccauuuccggggaugacugugugguuaaaccuaucgaugacagauuugcuaccgcccuuacagcgcugaaugacaugggaaaggugcgcaaagauaucccccaaugggagccgccuaagggcuggaacgacuggcagcagguccccuucugcagccaccacuuucaucagcucauuaugaaggaugggcgggagaucgugguccccuguagaaaucaagacgaacuggugggccgcgcccggguuucucagggagcuggcuggucccuuagagagaccgccugccuggggaaaagcuaugcucagauguggcagcucauguacuuccaccgccgggaucugagacuggccgcuaacgccauuuguuccgcggugccugucgacugggugccgacaucucgcaccacauggagcauccaugcccaccaucaauggaugaccacggaagauaugcucuccguuuggaaucggguguggauugaggaaaaccccuggauggaggacaagacacacgucagcucuugggaggaugugccuuaucugggaaaaagagaagaccaguggugcggcucccuuaucgggcugaccgcucgggccaccugggccacaaauauucagguggcuaucaaccaaguuagacgccucaucggaaaugagaacuaccuggauuauaugaccagcaugaagcgguuuaaaaaugaaucugaccccgagggcgcccuuugguga

SEQ ID NO: 19516 - RNA, 9879 nt, Artificial Sequence
  derived and/or modified CDS sequence (opt5) from DENV-1__HQ332182__SS-prME
agcgugaccaugcugcucaugcugcuucccacagcccuggcuuuccaccucacgaccagaggcggggaaccucauaugaucgucuccaagcaggaacggggaaaaucucugcuuuuuaagacaagcgccggcguuaauaugugcacccugauugcgauggaccucggggaacugugugaagauacaaugaccuacaaaugcccccgcaucacagaagcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagcggguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccagggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggacguccuaugugauguguacaggcagcuucaaacuggagaaggaagucgccgagacccagcacggaaccgugcuuguucaggugaaguacgagggcacagaugcgccgugcaaaauuccuuucucuacccaagacgaaaagggggucacacagaacggacggcucaucacggcuaaucccaucgugaccgauaaagagaagccugugaacauugaaacagagccgcccuuuggcgaguccuauaucguugucggggccggagaaaaagcccugaagcugagcugguucaagaaaggcucuagcauugggaagauguuugaggcuaccgccagaggcgcucgccggauggccauccucggagacacagcgugggauuucggcuccauugggggaguguuuaccucugugggcaaacugguccaucagguguucgggacggccuacggaguucuuuuuagcggcguguccuggaccaugaagaucgggaucggcauucugcucacauggcugggacugaauagcagaucuaccucccuuagcaugacauguaucgcugucggcauggugacccucuaccuggggguuauggugcaggccgacucuggaugcgucauuaacuggaaaggccgcgaacugaaguguggguccggaaucuucgugacaaacgagguucacaccuggacggaacaauauaaguuucaggcugauagcccuaaacggcucuccgccgcgauuggcaaggccugggaggagggggugugcggcaucagaucugcuacacgccuggaaaauauuauguggaaacagaucagcaacgagcuuaaucauauccugcucgaaaacgacaugaaguucaccgucguggugggagacgccaauggcauucuggcucaggggaaaaagaugauccggccgcaacccauggagcacaaauacuccuggaagucuuggggaaaggccaaaauuaucggcgccgauauucagaacaccacauuuaucaucgacgggccugauacccccgaauguccugacgaucagagagcuuggaauauuugggaggucgaggacuauggauucggcaucuuuacgacaaacauuuggcugaaacuucgcgauagcuacacccagaugugcgaccaccggcucauguccgcggccaucaaagauagcaaggcuguucaugccgacaugggcuauuggauugaaucugagaaaaaugaaacauggaagcuggccagagcuuccuucaucgaggugaagaccuguacauggcccaaaagccacacccuguggucuaacggggugcucgaauccgagaugaucauuccgaagaucuacggaggcccuauuagccaacauaauuaucgccccggguacuucacgcagaccgccggaccuuggcaccugggcaaacuugagcuggauuuugaccucugcgaagggacaaccgucgugguugaugagcacugcggaaaccggggccccucucugagaacaaccacggugacaggcaagaucauucaugaaugguguugccggagcuguacccugccuccccuucgcuucagaggggaggacggaugcugguacggcauggagauccggccggucaaagaaaaggaggaaaaucucgugagauccaugguuagcgcggggucuggagagguggacuccuuuagccugggcauccugugugucuccauuaugaucgaagaggugaugcgcucucgguggagcagaaagaugcucaugacagggacccuggcuguuuuccuucugcucauuaugggacagcugaccuggaacgaucugauccgccuuugcauuauggugggcgccaaugccuccgacagaaugggcauggggacaacguaucuggcucucauggccaccuuuaaaaugcggccuauguucgcggucggacugcucuuucgcagacugacaucucgggaggugcuucugcucaccaucggccugagccugguggcuuccgucgaacuucccaacucucuggaggaacucggggauggacuggccaugggcauuaugaugcucaagcugcuuacagaguuccaaccccaccagcuguggaccacgcuccugagccugacauuuaucaaaaccacccuuucccuggacuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaacaagaucuggggccgcaaauccuggccuauuaaugagggcaucauggcuauugggaucgugagcauccuucugucuucccuccugaagaacgaugucccccucgccggaccucugauugcgggcgggaugcuuaucgccuguuaugugauuagcggauccagcgcugaccugucucuggagaaagccgcugaaguuagcugggagcaggaagccgagcauuccggcaccucucacaauauccucguggaaguccaagaugacgggacgaugagaauuaaggaugaggagaaagacgauacccugacaauccuucugaaggccacccuccuggcugugagcggaguuuaccccauguccaucccugcgacacucuuugugugguauuucuggcagaaaaagaagcagcggucuggcguccugugggacacccccagcccgccugaaguggagcgcgccguccuugaugacggcauuuacagaauccugcagcgggggcugcucggacgcucccaagugggcguugggguguuccaggacggagucuuucauacaauguggcacgugacgagaggcgcuguucugauguaucaggggaaacggcuugaacccucuugggccagcgugaagaaagaucugauuuccuacggaggcggcuggagauuccaggggagcuggaacaccggagaggagguccaagugaucgccguggaaccuggcaagaaucccaaaaacguucagacaaccccggggaccuuuaagacaccugagggagaagucggcgcuauugcccucgacuucaagcccgggacgucuggauccccuaucgugaaucgcgagggcaaaauugugggccuguacgggaacggagucgugaccacaagcggcaccuauguuucugcgaucgcucaggccaaggccucccaagaagggccccuccccgagaucgaggaugaaguguuuaaaaagcggaaucugacaauuauggaccuucacccuggaagcggcaaaaccagacgcuaccugccggcuaucguccgggaggccauuaagagaaagcugcgcacgcucauccuggcgcccacacgggugguugcuuccgaaauggccgaggcccuuaaagggaugccuauuagauaucagaccaccgcugugaagucugaacauacaggccgcgagaucgucgaucugaugugccacgccaccuucacaaugcggcuccugagccccgugagaguuccuaacuacaauaugaucauuauggacgaggcucauuuuaccgaucccgccuccaucgcggcccggggauauauuagcacgcgcgugggcaugggggaagcugccgcuaucuucaugacagccaccccuccgggaucugucgaggccuuuccccaguccaacgcugugauucaggacgaagagagagauaucccugaacggagcuggaacucuggcuacgacuggaucacagauuuccccgggaaaaccgugugguuugucccuagcauuaaguccggaaacgacaucgcgaauugucugcgcaaaaacggcaagagaguuauucaacucucucggaagacguucgacaccgaguaucagaaaacaaagaacaaugauugggacuacguggugaccacagauaucagcgagaugggggccaacuucagagcugaccgcgucauugauccccggagaugccuuaaaccggugauccugaaggacggcccugaacgcguuauucuggccggacccaugcccgugaccgucgccuccgcugcccagcggagaggccgcaucgggcggaaucagaacaaagagggagaucaauacguguauaugggccagccucucaauaacgacgaagaucacgcgcauuggacagaggcuaagaugcugcuugacaauaucaacacccccgaggggauuaucccugcccuguuugaaccggagagagaaaagucugccgcuauugauggagaguaccgccucagaggcgaagcccggaaaacguucguugagcugaugcgcagaggggaccugcccguguggcucagcuauaaggucgcguccgagggcuuucaguacagcgaucggcgcuggugcuucgacggagaaagaaauaaccaggugcuugaggaaaauauggacgucgagaucuggacaaaagaaggcgagcggaagaaacugagaccucgcuggcuggaugcccggaccuauucugacccccucgcucugagagaguuuaaggaguucgccgcugggcgccgguccgugagcggagaucuuauucuggagaucggcaaacucccucaacaccugacccugagagcccagaacgcucucgacaaucuuguuaugcugcacaacuccgaacaagggggaaaggccuaccggcaugcgauggaggaacugcccgauacaaucgagacccucaugcugcuugcccugauugcugugcucacaggcggcgugacgcuguuuuuccugucugggaagggacucggcaaaaccagcaucgggcuucugugugucacagccuccucuguucugcucuggauggcuagcguggagccgcacuggauugccgccuccaucauucuggaauuuuuccuuauggugcugcucaucccugagcccgaccgccagagaaccccucaagauaaucagcuggcuuaugucgugaucggacugcucuuuaugauucuuacaguugcggccaacgaaaugggccugcuggagaccacgaagcgggaccucgggaucggacauguggcugccgagaaccaccagcacgccaccaugcuggaugucgaccuucgccccgcuagcgccuggacacuguacgcgguggccaccacagucauuaccccuaugaugagacauacgaucgaaaauacaaccgcuaacauuucucucacagccaucgcuaaucaagccgcgauucugaugggccuggauaaaggcuggcccaucuccaagauggacaucggggugccgcuccuugcccugggaugcuacagccagguuaacccucugacccucaccgcugccgugcugaugcuugucgcucacuaugccauuaucggccccgggcugcaggcuaaagccacacgggaggcgcagaagcgcacggccgcuggaauuaugaagaaucccaccguggauggcaucguugccauugaccucgacccuguggucuacgaugcuaaauucgaaaagcaacuggggcagaucaugcugcucauccuuugugccucucaggugcugcugaugagaacaaccugggcccucugcgaguccauuacacuggcgaccggaccgcuuacgacacugugggaaggcagccccggcaaauuuuggaacaccaccaucgcugugucuauggccaauauuuuccgggggagcuaucucgcuggagccggccuggccuucucccugaugaagucucucgggggaggccgcagagggacaggagcucagggcgagacccuuggcgagaaauggaagcggcaacugaaccagcugagcaaguccgaauuuaauacauacaaaagaagcgggaucauggagguugaccgcuccgaagccaaggagggacucaaacggggcgaaacgaccaagcaugcggucucuagagggacagccaaacugcgcugguucguggagcggaaccuugugaagccugagggaaaggucauugaucugggcugugggagaggaggcuggagcuauuacugcgcuggccucaaaaagguuaccgaagugaaaggguauacaaagggaggccccgggcacgaggaaccuauccccauggccaccuacggauggaaucuggugaaacugcauuccggcaaggacgucuuuuucaugccuccggagaaaugugauacgcuccuuugcgacaucggggaaucuagccccaacccuaccauugaggagggacgcacacugcgggugcugaagaugguugaacccuggcucagaggcaaucaguuuuguaucaagauucugaacccuuacaugcccuccguggucgagacccuugaacagaugcaacgcaaacacggcgggaugcuggugcggaauccgcucucuagaaacagcacacacgagauguauuggguuuccugcggaaccggcaauaucgugagcgcugucaacaugacaucucgcaugcugcugaaccgguucaccauggcccauagaaagccuacguacgagcgcgauguggaccucggggcgggaacaagacacguggccgucgaacccgagguugcuaaucuggauauuaucggccagcggauugaaaacaucaaaaaugagcauaaguccaccuggcacuaugacgaagauaaccccuacaaaaccugggccuaucacgggagcuacgaggugaagccuucuggauccgcuagcucuauggugaauggcgucgugcgccuucugacaaagcccugggacguuaucccuauggugacgcagauugccaugaccgacacaaccccguuuggccaacagagagucuucaaagagaagguggauacacggacccccagagcuaaacgggggacaacccagaucauggaaguuacggccaaguggcucuggggauuucugucccgcaacaaaaagccuagaauuuguacccgggaggaguucacacgcaaggugagaagcaaugcggccgucggcgcuguguuuguugacgagaaccaguggaacuccgccaaagaagcuguggaggaugagcgguucugggaccuuguccaucgcgaaagagagcugcacaagcaagggaaaugcgcuaccugcguguauaacaugaugggaaagcgggagaagaagcucggcgaguuugggaaggccaaaggcagccgcgcgaucugguacauguggcugggagcuagauuccuggaguucgaggcccucggcuuuaugaaugaggaucauugguucucucgggaaaacagccuguccggggucgagggagaaggccuucacaagcugggguacauucuccgcgacaucucuaaaauccccggaggcaauauguaugccgaugacacagcugggugggauaccagaauuacggaggacgaucugcagaacgaggccaagaucacagacauuauggaaccugagcaugcccuucuggccaccagcaucuuuaaacucacauaccagaauaaggugguucgggugcagcgccccgcgaaaaacggcaccgucauggaugugauuuccagacgggaccaaagaggaucuggccagguggggacguauggacugaacaccuucacaaauauggaaguucagcugauccgccagauggagagcgaaggcaucuuucucccguccgagcuggagaccccuaaccuugccgaacgggugcuggacuggcucgagaagcacggggcugaaagacugaagcgcauggccauuucuggagaugacugugucgugaaacccaucgaugaccgguucgcuacagcccuuaccgcgcugaaugauaugggcaagguuagaaaagacauuccucaaugggagcccagcaagggguggaacgauuggcaacaggugccuuuuugcucccaccauuuccaccagcucaucaugaaagacggccgcgaaauugucgugcccugucggaaucaagaugagcuggucggcagagcucgcgugagccagggagcuggguggucucugcgggagacagccugccucggaaaguccuacgcucagauguggcaacugauguauuuucauagacgcgaccuucggcuggccgcuaacgccaucuguagcgcgguuccgguggauugggucccuaccucuagaacgacaugguccauccacgcccaccaucaguggaugaccaccgaagacaugcucagcguguggaaucggguuuggauugaggaaaaccccuggauggaggacaagacacacguguccucuugggaagagguccccuaccugggcaaaagagaggaucaguggugcgggagccuuaucggacugaccgcucgcgccacaugggccacgaauauucagguggcuaucaaccaagugcggagacucauuggcaaugaaaacuaucuggacuacaugaccuccaugaagcgcuucaaaaaugagagcgauccugaaggggcccugugguga

SEQ ID NO: 19517 - RNA, 9879 nt, Artificial Sequence
  derived and/or modified CDS sequence (opt5) from DENV-1__HQ332181__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucguccaggggaagaaaaugaucagaccgcaacccauggaacacaaguacuccuggaaaucuuggggaaaggcuaagauuaucggcgccgacauucagaacaccaccuucaucaucgaugggccugacacacccgaguguccugauggacagcgcgccuggaauauuugggagguugaagacuauggcuuuggcguguucaccacgaacaucuggcugaaacugcgggauagcuacacacagaugugcgaccacagacuuauguccgcugcgauuaaggauagcaaagccgugcaugcugacaugggguauuggaucgagucugaaaagaaugagaccuggaaacucgcccgcgccuccuucauugaagucaagacauguaccuggcccaagagccacacacuguggucuaacggagugcuggaguccgagaugaucaucccgaaaauuuacggcgggccuaucagccaacauaauuaucggcccggauacuuuacccagacggcuggcccuuggcaccucgggaagcuggaacuugauuucgaccugugcgagggaaccacaguuguggucgaugaacacugcggcaacagaggccccucucuccggaccacaaccgugacggggaaaauuauccaugagugguguugccgcagcuguacacugccuccccugagauuucggggagaggacggcugcugguacgggauggaaauuagaccgguuaaggagaaagaagagaaucuugugcgcuccauggucagcgccggaaccggcgaaguggauucuuucucccucgggauccuguguguuagcaucaugauugaggaggugaugcgguccagauggucucgcaagaugcugaugacaggaacccucgcggucuuucugcuucugaucaugggccagcucaccuggaacgaccugauuagacugugcaucauggugggcgcuaaugccagcgaccggauggggaugggaacaacguaucuugcccugauggcuaccuucaagaugcgcccuauguuugccgugggccuccuguucagacggcucacaucccgcgaaguccugcuucugaccauugggcucucucugguugcgagcguggagcugcccaacucccuugaagagcugggagauggccucgcuauggggaucaugaugcugaaacuccugacagaauuucaaccccaccagcuuuggaccacgcugcucucucugacauucgugaagaccgcccugagccuugacuacgccuggaaaaccacagcuaugguccuguccauugugagccucuuuccucugugucucucuaccacaucccagaagacgaccuggcugccgguucuucugggaagcuucggcugcaaaccccugacaauguuucucaucaccgagaacaagaucuggggcagaaagucuuggccucugaaugaggggauuauggccaucggaauuguguccauccuucugagcucucuccugaaaaacgaugucccccucgcuggcccucugauugccgggggaaugcuuaucgcguguuaugugaucuccggcagcuccgccgaccugagccuggaaaaggcugccgagguuucuugggaacaggaggcugaacauagcggggccucccacaauauucucguggagguccaagaugacggaacaaugaaaaucaaggaugaggaacgggacgauacccugacgauucuucugaaagccacccuccuggcugugucuggcgucuaccccaugagcaucccugcgacacucuucgugugguauuucuggcagaagaaaaagcagcgcuccggcguucugugggacacccccucuccgccugagguggaaagagccguccuugauaacgggauuuaccggauccugcagcgcggacugcucggcagaagccaaguggggguuggaguguuucaggacggcgucuuccauacaauguggcacgugacccggggggcugugcugauguaucagggaaagagacuugagcccuccugggccucuguuaaaaaggaucugaucagcuacggcggcggguggcgcuuucagggauccuggaauacaggcgaggaaguccaagugauugccguggagccugggaaaaaccccaagaauguccagacgaccccgggaacauucaaaaccccugaaggcgaggugggggcuaucgcccucgacuuuaagcccggaaccagcggcucuccuauuguuaaccgggaaggcaagaucguggggcuguacggaaauggcgucgugacaacguccgggaccuauguuagcgcgauugcucaggccaaagccucucaagagggaccccuccccgagaucgaagacgagguguucaagaaaagaaaccugacaauuauggaucuucacccuggcuccgggaagacccgccgguaccugccggcuaucgucagagaagccaucaaacgcaagcugcggacacucauucuggcgcccaccagagugguugcuagcgagauggccgaagcccuuaagggcaugccuauccgcuaucagacgacagcugugaaauccgagcauaccggacgggagauugucgaccugaugugccacgccaccuuuacaaugagacuccugucucccgugcgggugccuaauuacaacaugaucauuauggaugaagcucauuucaccgaccccgccagcaucgcggcccgcggcuauaucuccacaagagucgggaugggagaggcugccgcuauuuuuaugaccgccacgccuccgggcagcguugaagccuucccccagucuaaugcugugauccaggaugaggaacgggacauuccugagcgcuccuggaacagcggguacgauuggaucacagacuuucccggaaagaccgugugguucgucccuucuauuaaaagcggcaaugauaucgcgaacugucugagaaagaacgggaaacgggugauccaacucuccagaaagacauucgacaccgaguaucagaagacgaaaaauaacgauugggacuacguugugaccacagacauuucugaaaugggcgccaauuuucgcgcugaucgggucaucgaccccagacgcugccuuaagccggugauucugaaagauggaccugagcggguuauccuggccggccccaugcccgugaccgucgccagcgcugcccagagacgcgggcggauuggaagaaaccagaauaaggaaggcgaccaauacguguauauggggcagccucucaacaaugaugaggaccacgcgcauuggacagaggcuaaaaugcugcuugauaacaucaauacccccgaaggaauuaucccugcccuguucgagccggaacgcgagaaguccgccgcuaucgacggcgaauacagacuccggggggaggcccgcaagacauuugucgagcugaugagacggggcgaucugcccguguggcucucuuauaaaguugcgagcgaaggauuccaguacuccgaccgcagauggugcuuugauggcgagcggaacaaucaggugcuugaagagaacauggacguggaaauuuggaccaaggagggggagagaaaaaagcugcgcccucgguggcuggaugccagaacguauagcgacccccucgcucugcgcgaauucaaagaguuugccgcuggacggagaucugucuccggcgaccuuauccuggaaauugggaagcucccucaacaccugacacugcgggcccagaaugcucucgauaaccuuguuaugcugcacaauagcgagcagggaggcaaagccuaccgccaugcgauggaagagcugcccgacaccaucgagacccucaugcugcuugcccugauugcugugcucacaggcggggugacccuguucuuucuguccggaaagggccucgggaagacaucuaucggacuucugugugucacggccagcuccgcucugcucuggauggccucuguggaaccgcacuggaucgccgcuagcauuauccuggaguucuuucuuaugguucugcucauuccugaacccgauagacagcggaccccucaagacaaccagcuggcguauguggucaucggccugcucuucaugauucuuacaguggccgcuaacgagauggggcugcuggagaccacaaaaaaggaucucggaaucggcuacgucgccgccgaaaaucaucagcacgcuaccaugcuggacguggaucuucaccccgccuccgcguggacgcuguacgccguugcuaccacagugaucaccccuaugaugcgccauacaauugagaacaccacggccaauaucagccucacagcuauugccaaccaagcggccauccugaugggccuggacaaaggguggcccauuucuaagauggauaucggagucccgcuccuugcucugggcugcuauucccaggugaauccucugacccucacagccgcuguucugaugcuuguggcccacuacgcuauuaucgggcccggacugcaggccaaagcgaccagagaagcccagaagcggaccgcugccggcaucaugaagaaccccacagucgacgggauuguggcuaucgaucucgacccugugguuuaugaugccaaauuugagaagcaacugggacagauuaugcugcucauccuuuguacgagccagauucugcugaugcgcaccacaugggcccucugcgaaucuaucacccuggcgacaggcccgcuuaccacgcugugggagggcucccccgggaaauucuggaauacaaccaucgcugucagcauggccaacauuuucagaggaucuuaccucgcuggcgccgggcuggccuuuagccugaugaagucccucggaggcgggcggcgcggaaccggcgcucagggcgagacacuuggggaaaaauggaagagacaacugaaucagcugucuaagagcgaguucaacaccuauaaacgguccggaaucauggaaguggacagaagcgaggccaaggaaggccucaaacgcggggagacaacgaagcaugcggugucccggggaaccgccaaacugagaugguuugucgagcgcaaucuuguuaagccugaaggcaaggugauugaccugggguguggacggggcggcuggucuuacuauugcgcugggcucaaaaaggugacagaggucaaaggauacaccaagggcgggcccggacacgaagagccuauccccauggccacauacggcuggaaccuggugaaacugcauagcgggaaggauguuuucuuuaugccuccggaaaaaugugacacccuccuuugcgauauuggagaguccucucccaauccuacgaucgaggaaggcagaacccugcgcgugcugaagauggucgagcccuggcuccggggcaaccaguucuguaucaagauucugaauccuuauaugcccagcgugguugaaacacuugagcagaugcaaagaaaacacgggggaaugcuggugcgcaacccgcucucccggaauucuacccacgagauguacugggucagcugcggcacagggaacaucguguccgcugugaacaugaccagcagaaugcugcugaaucgcuuuacaauggcccaucggaagccuaccuaugaaagagacgucgaucucggagcgggcacgcgccacguugccguggagcccgaaguggcuaaccuggacauuaucgggcagagaauugagaauaucaaaaacgaacauaagucuacauggcacuacgaugaggacaaucccuauaaaaccugggccuaccacggauccuaugaggucaagccuagcggcucugcuuccagcauggugaacggcguugugcggcuucugaccaagcccugggaugucauuccuauggugacacagaucgccaugacggacaccacaccguucgggcaacagcgcguuuuuaaagaaaagguggauaccagaacaccccgggcuaaaagaggaaccacacagaucauggaggucaccgccaaguggcucuggggcuuccugucucggaauaaaaagccucgcauuuguacgagagaagaguuuacccggaaggugcgcuccaacgcggccaucggggcuguuuucguggacgaaaaucaguggaacagcgccaaagaggcugucgaggacgaaagauuuugggaucuugugcaucgggagcgcgaacugcacaagcaaggaaaaugcgccacaugcgucuacaauaugaugggcaagagagagaaaaagcucggggaauucggcaaggccaaaggaucccgggcgauuugguacauguggcugggcgcucgcuuccuggaguuugaggcccucggguucaugaacgaagaccauugguuuagcagagagaauucucugagcggaguggaaggcgaggggcuucacaagcugggauauauccuccgggauauuuccaaaauccccggcgggaacauguacgccgacgauaccgcuggcugggacacacgcaucaccgaggaugaccugcagaaugaagccaagauuacggauaucauggagccugaacaugcucuucuggccacaucuauuuucaaacucaccuaucagaacaagguugugagaguccagcggcccgcgaaaaacggaacagugauggacgugaucagccgcagagaucaacggggcuccgggcagguuggaaccuacggccugaauacguuuaccaacauggaggugcagcugauuagacagauggaaucugaggggaucuuccucccgagcgagcuggaaacaccuaaucuugccgagcgcgcucuggacuggcucgaaaagcacggagccgagcggcugaagagaauggcuaucuccggcgaugacugugucgugaaacccauugacgaucgcuuugccaccgcgcuuacagcccugaacgacauggggaagguucggaaagauaucccucaaugggaacccucuaagggcuggaaugacuggcagcaggugccuuucugcagccaccauuuucaccagcucauuaugaaagauggaagagagaucgucgugcccugucgcaaccaagacgagcuggucggccgggcuagagugucccagggggccggauggagccugcgcgaaaccgcuugccucggcaagucuuaugcccagauguggcaacugauguacuuccaucggagagaucuucgccuggcugccaaugcgauuuguuccgccguuccgguggacugggucccuacaagccggaccacguggucuauccacgcucaccaucaguggaugacaaccgaggauaugcucuccguguggaacagaguuuggaucgaagagaaucccuggauggaagacaagacccacgugagcuccugggaggagguccccuaucuggggaaacgggaagaucaguggugcggaucucuuauuggccugacagccagagccaccugggcuacaaacauccagguggccauuaaucaagugcgccggcucaucgggaacgagaauuaccuggacuacaugacgagcaugaagagauuuaaaaacgaauccgacagcgagggcgcgcugugguga

SEQ ID NO: 19518 - RNA, 9879 nt, Artificial Sequence
  derived and/or modified CDS sequence (opt5) from DENV-1__HQ332180__SS-prME
agcgugaccaugcugcucaugcugcuucccacagcccuggcuuuccaccucacgaccagaggcggggagccucauaugaucauuuccaagcaggaacggggaaaaucucugcuuuuuaagacaagcgccggcgucaacaugugcacccugaucgcgauggaccucggggagcugugugaagauacaaugaccuacaaaugcccgcgcauuacagaggcugaacccgacgauguugacuguuggugcaaugccaccgauacgugggugaccuauggaacauguucccaaaccggcgagcacagacgggacaagcgcucuguggcccuggcuccucaugucgggcucggacuggagacaagaaccgaaacguggaugagcuccgagggcgccuggaaacagauccagcggguggaaacaugggcucuucgccaccccggcuucaccguuauugcccuguuucucgcgcaugccaucgggacaucuaucacccagaagggaauuaucuucauucugcuuaugcuggugaccccuagcauggcuaugagaugcgucggcaucgggaaccgggauuuuguggagggacucuccggcgccacauggguugacgugguccuggagcacgggagcugugugacgaccauggcuaagaauaaacccacacuggauauugaacuccugaagaccgaggugacaaacccugccguccuucgcaaacugugcaucgaagcgaagauuucuaauaccacgacagacuccagauguccgacccaaggagaggccacccucguugaagagcaggaugcuaacuucgugugccggcgcacauuuguggacagaggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucagcaucaaguggggaaugagacaaccgaacacggaacaauugcuaccaucacgccccaggccccuaccuccgagauucagcugacagacuacggcgcccucacccuggacuguagcccccggacaggccuugauuucaacgaaaugguucugcucaccaugaaggagaaaucuuggcuggugcauaagcagugguuucuugaccugccucuccccuggacguccggggcuagcacaucccaagagaccuggaaucgccaggaucugcuggucacauucaaaaccgcgcacgccaagaagcaggaaguggucgugcucggaucucaagagggcgcuaugcacaccgcccugacaggggccacggaaauccagaccagcggaacaaccacaauuuuugcuggccaucuuaaaugcagacugaagauggacaaacucacccugaaggggauguccuauguuauguguacgggcagcuucaaacuggagaaggaaguggccgagacacagcacggaaccguccuugugcagguuaaguacgagggcaccgaugcgccgugcaaaaucccuuucucuacacaagacgaaaagggggugacccagaacggacggcucaucacagcuaaucccauugucacggauaaagagaagccugugaacaucgaaaccgagccccccuuuggcgaguccuauauugugguuggggccggagaaaaagcccugaagcugagcugguucaagaaaggcucuagcaucgggaagauguuugaggcuacagccagaggcgcucgccggauggccauucucggagacaccgcgugggauuucggcuccaucgggggagucuuuacaucugugggcaaacuggugcaucaggucuucgggaccgccuacggagugcuuuuuagcggcguuuccuggacgaugaagaucgggauuggcauccugcucaccuggcugggacugaauagcagaucuacaucccuuagcaugaccuguauugcugugggcauggucacacucuaccugggggccauggugcaggcugacucuggaugcguuaucaacuggaaaggccgcgaacugaaguguggguccggaauuuucgugaccaacgagguccacacauggaccgaacaauauaaguuucaggccgauagcccuaaacggcucuccgcggccaucggcaaggcuugggaggagggggugugcggcauuagaucugccacgcgccuggaaaauaucauguggaaacagaucagcaacgagcuuaaucauauucugcucgaaaacgacaugaaguucacaguuguggucggagacgcuaauggcauccuggcccaggggaaaaagaugauucggccgcaacccauggagcacaaauacuccuggaagucuuggggaaaggccaaaaucauuggcgcugauauccagaacaccaccuuuaucauugacgggccugauacacccgaauguccugacggacagagagcguggaauaucugggagguggaggauuauggcuucggcauuuuuaccacgaacaucuggcugaagcuucgcgacagcuacacacagaugugcgaucaccggcucauguccgccgcuauuaaagacagcaaggccgugcaugccgauaugggguauuggaucgaaucugagaaaaaugaaaccuggaagcuggcuagagccuccuucaucgaggucaagacauguaccuggcccaaaagccacacacuguggucuaacggaguucucgaauccgagaugauuaucccgaagauuuacggcgggccuaucagccaacauaauuaucgccccggauacuucacccagacggcgggcccuuggcaccuggggaaacuugagcuggacuuugaucucugcgaaggaaccacagugguggucgacgagcacugcggcaaccggggccccucucugagaaccacaaccgugacggggaagauuauccaugaaugguguugccggagcuguacacugccuccccuucgcuucagaggagaggauggcugcugguacgggauggagauccggccgguuaaagaaaaggaggaaaaucucgugagauccauggucagcgcuggaucuggcgagguggacuccuuuagccuggggauucuguguguuuccaucaugauugaagaggugaugcgcucucgguggagcagaaagaugcucaugaccggaacacuggccgucuuccuucugcucaucaugggccagcugaccuggaacgaccugauucgccuuugcaucauggugggcgccaaugcuuccgauagaauggggaugggaaccacacaccuggcccucauggcgacguuuaaaaugcggccuauguucgcuguuggccugcucuuucgcagacugaccucucgggaggugcuucugcucacaauugggcugagccugauggccuccauggaacuucccaacucucuggaggaacucggagacggccuggccauggggaucaugaugcucaagcugcuuaccgaguuccaaccccaucagcuguggacaacccuccugagccugacguuugucaaaacaacccuuucccuggauuaugcuuggaagaccacagccaugauccucagcauugugucucuguucccucucugucuguccaccacaagccagaaaacgaccuggcuuccggugcugcugggaucuuuuggcugcaagccccucacaauguuccugaucaccgaaaacaagauuuggggccgcaaauccuggccucuuaaugaggggaucauggcuauuggaaucgucagcauccugcucucuucccugcucaagaacgacguuccccuggccggcccucuuauugcggggggaaugcugaucgccuguuacgugauuagcggcuccagcgcugaucugucucucgagaaagccgcugaagugagcugggagcaggaagccgagcacuccggggccucucauaauauccuggucgaagugcaagacgauggaacaaugaagauuaaagacgaggagagagaugacacccuuacgauccugcucaaggcuacccugcucgcgguuagcggcguguaucccauguccaucccugccacacuguuugucugguacuucuggcagaaaaagaagcagcggucuggcgugcuuugggauacccccagcccgccugaaguugagcgcgcugugcuggacgaugggauuuauagaauccugcagcggggacuccugggccgcucccaagucggggugggagucuuccaggacggcguguuucacacaauguggcacguuaccagaggggccgugcuuauguaccagggaaaacggcuggaacccucuugggccagcgucaagaaagaccucauuuccuauggcggcggguggagauuccagggaagcuggaacacaggcgaggaggugcaaguuaucgcuguggaaccugggaagaaucccaaaaacguccagacgaccccgggaacauuuaagaccccugagggcgaagugggggccauugcgcuggauuucaagcccggaaccucuggcuccccuaucgugaaucgcgagggcaaaauuguugggcucuacggaaacggcgucgugacaacgagcgggaccuacgugucugcuaucgcccaggccaaggcuucccaagaaggaccccugcccgagaucgaggacgaagucuuuaaaaagcggaaucuuacaauuauggaucugcauccuggcagcgggaaaaccagacgcuaucugccggccaucgugcgggaggcgauuaagagaaagcuccgcacacugauccuugcucccacccggguuguggccuccgaaauggccgaggcucugaaaggcaugccuauuagauaccagacgacagccgucaagucugaacacaccggacgcgagaucguggaccucaugugccaugcuaccuucacaaugcggcugcugagccccguuagagugccuaacuauaauaugaucauuauggaugaggcccacuuuaccgaccccgcguccaucgccgcucggggcuacauuagcacacgcgucgggaugggagaagccgcugccaucuucaugaccgccacgccuccgggcucuguggaggcuuuuccccaguccaacgcgguuauucaggaugaagagagagacaucccugaacggagcuggaauucuggguaugauuggaucacagacuuccccggaaaaaccgugugguuugucccuagcauuaaguccggcaacgauaucgccaauugucuccgcaaaaacgggaagagagugauucaacuuucucggaagacauucgacaccgaguaccagaaaacgaagaacaaugacugggauuauguggucaccacagacaucagcgagaugggcgcuaacuucagagccgaucgcguuauugacccccggagaugccugaaaccggugauccugaaggauggaccugaacgcgugauucucgccggccccaugcccgucaccguggcuuccgccgcgcagcggagagggcgcaucggacggaaucagaacaaagagggcgaccaauacguuuacauggggcagccucugaauaacgaugaagaccaugcucacuggacagaggccaagaugcuucuggauaauaucaacacccccgagggaauuaucccugcccucuuugaaccggagagagaaaagucugcugccauugacggcgaguaucgccugagaggggaagcgcggaaaacauucguggagcugaugcgcagaggcgaucuccccgucuggcuuagcuacaagguggccuccgagggauuucaguauagcgaccggcgcuggugcuucgauggcgaaagaaauaaccagguucuggaggaaaauauggacguggagaucuggaccaaagaaggggagcggaagaaacugagaccucgcuggcucgacgcucggacguacucugauccccuggcccuuagagaguuuaaggaauucgcugccggacgccgguccgucagcggcgaccugauucucgagaucgggaaacugccucaacaccugacacucagagcucagaacgcccuugauaaucuggugaugcugcauaacuccgaacagggaggcaaggcguaucggcacgccauggaggaacuccccgacaccaucgagacccugaugcuucuggcucucauugccguccugacaggcggggugacccuguuuuuccucucuggaaagggccuugggaaaacaagcaucggacugcuguguguuacggcuuccucugcccuccuguggauggccagcguggagccgcauuggauugcugcguccaucauucuugaauuuuuccugauggugcuccugaucccugagcccgaucgccagagaaccccucaagacaaucagcuggccuacgucguuaucggccuccuuuuuaugauucugacaguggcugccaacgaaauggggcugcucgagaccacaaagaaagaucugggaaucggcuauguggccgcugagaaccaccagcacgccaccaugcuugacgucgaucugcggcccgcgagcgccuggacgcucuacgcuguggccaccacaguuauuaccccuaugaugcgccauacaaucgaaaauaccacggcuaacauuucucugacagccaucgcgaaucaagccgcuauucugaugggccucgacaagggguggcccaucuccaaaauggauaucggagugccgcuucuggcccugggcugcuacagccaggucaacccucucacccugacagcugccgugcuuaugcuggucgcucacuaugccauuaucgggcccggacuccaggcgaaggccaccagagaggcucagaagcggaccgccgcuggcauuaugaaaaaucccacaguggacgggaucguugccauugaucuggacccuguggucuacgacgccaaguucgaaaaacaacugggacagaucaugcuccuuauccuguguacgucucagauucugcucaugcgcaccacaugggcgcugugcgaguccaucacccuugcuacaggcccgcugaccacgcucugggaaggcagccccgggaaguuuuggaacacaaccauugccgugucuauggcuaauaucuucagaggaagcuaucuggccggcgccgggcuggcuuucucccucaugaaaucucuuggaggcgggcggcgcggaaccggcgcccagggcgagacacugggggagaaguggaagagacaacugaaccagcucagcaaauccgaauuuaauaccuacaagcggagcggaauuauggagguugauagauccgaagcgaaagagggccugaagcgcggggaaacaacgaaacaugccgugucucggggaaccgcuaagcuuagaugguucgucgagcgcaaccuggugaagccugagggcaaagugaucgaccucggguguggacggggcggcuggagcuauuacugcgccgggcugaagaaaguuacagaagucaagggauauaccaaaggcgggcccggacacgaggaaccuauccccauggcuacauacggcuggaaucuggugaagcuccauuccgggaaagauguguuuuucaugccuccggagaagugugacacccuucugugcgauauuggagaaucuagccccaacccuacgaucgaggagggcagaacccugcgcguccucaagaugguugaacccuggcugaaaggcaaucaguuuuguauuaagauccuuaacccuuacaugcccuccgugguggagacacuggaacagaugcaacggaaacacgggggaaugcucgucagaaauccgcugucucgcaacagcacccacgagauguauuggguguccugcggcacagggaauauuguuagcgccgugaacaugaccucucggaugcugcucaacagauucacaauggcgcaucgcaagccuaccuacgagcgggacgucgaucugggagccggcacgagacacguggcuguugaacccgagguggccaaucuugacaucauugggcagcgcaucgaaaacaucaaaaaugagcauaaguccacauggcacuaugaugaagacaaccccuacaagaccugggcuuaucacggaagcuacgaggucaaaccuucuggcuccgccagcucuauggugaauggcguggucagacugcucaccaagcccugggauguuauuccuauggugacacagaucgcuaugacggacaccacaccguuugggcaacagcggguguucaaagagaaggucgacacccgcacacccagagccaaacggggaaccacacagauuauggaagugaccgcgaaguggcuguggggcuuucuuuccagaaacaagaaaccucggaucuguacgcgcgaggaauucaccagaaagguucggagcaaugccgcuauuggggccguguuugucgaugagaaccaguggaauuccgcuaaagaagccguggaggacgagcgcuucugggaucugguucauagagaacgggagcuccacaagcaaggaaaaugcgccacaugcguguauaacaugaugggcaagcgcgaaaagaaacugggggaguuuggcaaggcgaaaggaagcagagcuaucugguacauguggcugggcgcccgguuccucgaauucgaggcccugggguuuaugaaugaggaccauugguucucucgcgaaaacagccuuuccggagucgagggcgaagggcugcacaagcucggauacauccugagagauauuucuaaaauccccggcgggaauauguaugcugacgauaccgccggcugggacacacggauuaccgaggaugaccuucagaacgaggcuaagaucacggauauuauggaaccugagcaugcccugcucgcgacaagcaucuuuaaacugaccuaccagaauaaggugguucgcgugcagagacccgccaagaacggaacagucauggacgugaucucccggcgcgaucaaagaggcucugggcaggucggaaccuauggccugaacacguucaccaauauggaagugcagcucauucggcagauggagagcgaagggaucuuucugccguccgagcuugagacaccuaaccuggcugaaagaguucucgacuggcuggagaaacacggagccgaacgccuuaagcggauggcuauuucuggcgacgauuguguggucaaacccaucgacgauagauucgccaccgcgcugacagcccucaaugacauggggaaggugcgcaaagauauuccucaaugggagcccagcaagggcuggaacgacuggcagcaggugccuuuuugcucccaccauuuccaccagcugaucaugaaggauggacgggaaaucguugugcccuguagaaaucaagacgagcuggucggccgcgcucgggugagccagggggccggauggucucucagagagaccgcuugccugggcaaauccuacgcccagauguggcaacuuauguauuuucaucgccgggaucugagacucgcugccaacgcgauuuguagcgccguuccgguggacugggucccuacaucucgcaccacgugguccauccacgcucaccaucaguggaugacaaccgaagauaugcugagcguguggaaucgggucuggauugaggaaaaccccuggauggaggacaagacccacguguccucuugggaagagguucccuaccuugggaaaagagaggaccaguggugcggaagccugaucggccucacagcccgggccaccugggcuacaaauauucagguggccaucaaccaagucagacgccugauugggaaugaaaacuaucuggauuacaugacguccaugaagcgguucaaaaaugagagcgacccugaaggcgcgcucugguga

SEQ ID NO: 19519 - RNA, 9879 nt, Artificial Sequence
  derived and/or modified CDS sequence (opt5) from DENV-1__HQ332179__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugcuuccauuaugaucgaagaggucaugcgcucucgguggagcagaaagaugcucaugaccggaacacuggccguguuccuucugcucauuaugggccagcugaccuggaacgaccugauccgccuuugcauuaugguuggcgccaaugcuuccgauagaauggggaugggaaccacauaucuggcccucauggcgacguuuaaaaugcggccuauguucgcugugggccugcucuuucgcagacugaccucucgggagguccuucugcucacaaucgggcugagccugguggccuccguggaacuucccaacucucuggaggaacucggagacggccuggccauggggauuaugaugcucaagcugcuuaccgaguuccaaccccaccagcuguggacaacccuccugagccugacguuugucaaaacaacccuuucccuggauuacgcuuggaagaccacagccaugguucucagcaucgugucucuguucccucucugucuguccaccacaagccagaaaacgaccuggcuuccggugcugcugggaucuuuuggcugcaagccccucacaauguuccugaucaccgaaaacaagauuuggggccgcaaauccuggccucuuaaugaggggaucauggcuauuggaaucgucagcauucugcucucuucccugcucaagaacgacgugccccuggccggcccucuuaucgcggggggaaugcugaucgccuguuauguuauuagcggcuccagcgcugaucugcuccuggagaaagccgcugaagugucuugggagcaggaagccgagcauagcggggccucccacaauauccuugucgaagugcaagacgauggaacaaugaagauuaaagacgaggagagagaugacacccugacgauccuccugaaggcuacccuccuggcgguuucuggcguguaccccaugagcauuccugccacacuuuuugucugguauuucuggcagaaaaagaagcagcgguccggcgugcugugggauacccccucuccgccugaagucgagcgcgcugugcuggacgaugggaucuacagaauccuccagcggggacugcuuggccgcagccaaguuggggugggagucuuccaggacggcguguuucauacaauguggcacguuaccagaggggccgugcugauguaucagggaaaacggcucgaacccuccugggccucugucaagaaagaccugauuagcuacggcggcggguggagauuccagggauccuggaacacaggcgaggaggugcaagugaucgcuguugaaccugggaagaaucccaaaaacguccagacgaccccgggaacauuuaagaccccugagggcgaagugggggccauugcgcucgauuucaagcccggaaccagcggcucuccuaucgugaaucgcgagggcaaaauugucgggcuguacggaaacggcgugguuacaacguccgggaccuaugugagcgcuaucgcccaggccaaggcuucucaagaaggaccccuucccgagauugaggacgaagucuuuaaaaagcggaaucugacaaucauggaucugcacccuggcuccgggaaaaccagacgcuaccucccggccaucgugcgggaggcgauuaagagaaagcugcgcacacuuauccuggcucccacccggguuguggccagcgaaauggccgaggcucucaaaggcaugccuauuagauaucagacgacagccgucaaguccgaacauaccggacgcgagaucguggaccugaugugccacgcuaccuucacaaugcggcugcucucucccguuagagugccuaacuacaauaugauuaucauggaugaggcccauuuuaccgaccccgcgagcaucgccgcucggggcuauauuuccacacgcgucgggaugggagaagccgcugccaucuucaugaccgccacgccuccgggcagcguggaggcuuuuccccagucuaacgcggugauucaggaugaagagagagacaucccugaacgguccuggaauagcggguacgauuggauuacagacuuccccggaaaaaccgucugguuuguuccuucuaucaagagcggcaacgauaucgccaauugucuucgcaaaaacgggaagagagugauucaacugucccggaagacauucgacaccgaguaucagaaaacgaagaacaaugacugggauuacguggucaccacagacaucucugagaugggcgcuaacuucagagccgaucgcgugauugacccccggagaugccugaaaccgguuauccucaaggauggaccugaacgcgugauucuggccggccccaugcccgucaccguggcuagcgccgcgcagcggagagggcgcaucggacggaaucagaacaaagagggcgaccaauacguuuauauggggcagccucuuaauaacgaugaagaccacgcucauuggacagaggccaagaugcugcucgauaauauuaacacccccgagggaaucaucccugcccuguuugaaccggagagagaaaaguccgcugccauugacggcgaguaccgccugagaggggaagcgcggaaaacauucguggagcucaugcgcagaggcgaucuucccgucuggcugucuuauaagguggccagcgagggauuucaguacuccgaccggcgcuggugcuucgauggcgaaagaaauaaccagguccuggaggaaaauauggacguggagaucuggaccaaagaaggggagcggaagaaacucagaccucgcuggcuggacgcucggacguauagcgauccccuugcccugagagaguuuaaggaauucgcugccggacgccggucuguuuccggcgaccucauucuggagaucgggaaacugccucaacaccucacacuuagagcucagaacgcccuggauaaucuggugaugcuccacaacagcgaacagggaggcaaggcguaccggcaugccauggaggaacugcccgacaccauugagacccuuaugcugcucgcucugaucgccgugcugacaggcggggucacccucuuuuuccuuuccggaaagggccuggggaaaacaucuaucggacugcucuguguuacggcuagcuccgcccugcuuuggauggccugcguggagccgcacuggauugcugcgucuaucauucuggaauuuuuccucauggugcugcugaucccugagcccgaucgccagagaaccccucaagacaaucagcucgccuaugucgugauuggccuucuguuuaugauccugacaguugcugccaacgaaauggggcuccuggagaccacaaagaaagaucuuggaaucggcuacguggccgcugagaaccaucagcacgccaccaugcuggacgucgaucuccggcccgcgagcgccuggacgcuguacgcuguggccaccacagucauuaccccuaugaugcgccacacaaucgaaaauaccacggcuaacauuucccugacagccaucgcgaaucaagccgcuauucucaugggccuugacaagggguggcccaucagcaaaauggauauuggagugccgcugcuggcccucggcuguuauucucagguuaacccucugacccuuacagcugccgugcugaugcucgucgcucauuacgccaucaucgggcccggacugcaggcgaaggccaccagagaggcucagaagcggaccgccgcuggcauuaugaaaaaucccacaguggacgggaucguugccauugaucuggacccuguggucuaugacgccaaguucgaaaaacaacucggacagaucaugcuucugauucugugcacgucccagauccuccugaugcgcaccacaugggcgcuuugugagagcaucacccuggcuacaggcccgcucaccacgcugugggaaggcucucccgggaaguuuuggaacacaaccauugccguguccauggcuaauaucuucagaggaagcuaccuggccggcgccgggcucgcuuucucucuuaugaaaagccugggaggcgggcggcgcggaaccggcgcccagggcgagacacugggggagaaguggaagagacaacucaaccagcuguccaaaucugaauuuaauaccuauaagcggagcggaauuauggagguggauagauccgaagcgaaagagggccuuaagcgcggggaaacaacgaaacacgccguuagccggggaaccgcuaagcugagaugguucgucgagcgcaaccucgugaagccugagggcaaagugaucgaccuggggugcggacggggcggcugguccuacuauugugccgggcugaagaaagucacagaaguuaagggauacaccaaaggcgggcccggacaugaggaaccuauucccauggcuacauacggcuggaaucucgugaagcuucacucugggaaagauguguuuuucaugccuccggagaagugcgacacccugcugugugauaucggagaaagcucccccaacccuacgaucgaggagggcagaacccuccgcguccugaagaugguggaacccuggcuuaaaggcaaucaguuuugcauuaagauccugaacccuuauaugcccucuguuguggagacacucgaacagaugcaacggaaacaugggggaaugcuggucagaaauccgcugagccgcaacuccacccacgagauguacugggugucuuguggcacagggaauauuguuagcgccgugaacaugaccucccggaugcuccugaacagauucacaauggcgcaccgcaagccuaccuaugagcgggacgucgaucuuggagccggcacgagacauguggcuguggaacccgaggucgccaaucuggacaucauugggcagcgcaucgaaaacauuaaaaaugagcacaagagcacauggcauuacgaugaagacaaccccuauaagaccugggcuuaccacggaucuuaugagguuaaaccuuccggcagcgccucuuccauggugaauggcguggucagacuccugaccaagcccugggaugugaucccuaugguuacacagaucgcuaugacggacaccacaccguuugggcaacagcggguguucaaagagaaggucgacacccgcacacccagagccaaacggggaaccacacagauuauggaagugaccgcgaaguggcuuuggggcuuucugagcagaaacaagaaaccucggaucugcacgcgcgaggaauucaccagaaagguucggucuaaugccgcuauuggggccguguuugucgaugagaaccaguggaauuccgcuaaagaagccguggaggacgagcgcuucugggaucucguucacagagaacgggagcugcauaagcaaggaaaaugcgccacauguguguacaacaugaugggcaagcgcgaaaagaaacugggggaguuuggcaaggcgaaaggaagcagagcuaucugguacauguggcucggcgcccgguuccuggaauucgaggcccuuggguuuaugaaugaggaccacugguucucccgcgaaaacagccugucuggagucgagggcgaagggcuccauaagcugggauauauucuuagagauaucagcaaaauccccggcgggaauauguacgcugacgauaccgccggcugggacacacggauuaccgaggaugaccugcagaacgaggcuaagaucacggauauuauggaaccugagcacgcccuccuggcgacauccaucuuuaaacugaccuaucagaauaaggugguccgcgugcagagacccgccaagaacggaacaguuauggacgugauuucucggcgcgaucaaagaggcagcgggcaggucggaaccuacggccucaacacguucaccaauauggaagugcagcugauccggcagauggaguccgaagggaucuuucuuccgucugagcuggagacaccuaaccucgcugaaagagugcuggacuggcuugagaaacauggagccgaacgccugaagcggauggcuauuagcggcgacgauugcguugugaaacccaucgacgauagauucgccaccgcgcucacagcccugaaugacauggggaagguccgcaaagauauuccucaaugggagcccuccaagggcuggaacgacuggcagcaggugccuuuuuguucucaccacuuccaucagcugaucaugaaggauggacgggaaauuguugugcccugcagaaaucaagacgagcucgucggccgcgcucgggugagccagggggccggauggucccugagagagaccgcuugucuuggcaaaagcuaugcccagauguggcaacugauguacuuucaccgccgggaucucagacuggcugccaacgcgaucugcucugccgucccgguggacuggguuccuacaucccgcaccacguggagcauccaugcucaccaccaguggaugacaaccgaagauaugcuuucuguguggaaucgggucuggauugaggaaaaccccuggauggaggacaagacccauguguccagcugggaagagguucccuaucuggggaaaagagaggaccagugguguggaucccucaucggccugacagcccgggccaccugggcuacaaauauucagguggccaucaaccaagucagacgccugauugggaaugaaaacuaccucgauuacaugacgucuaugaagcgguucaaaaaugagagcgacccugaaggcgcgcugugguga

SEQ ID NO: 19520 - RNA, 9879 nt, Artificial Sequence
  derived and/or modified CDS sequence (opt5) from DENV-1__KR919820__SS-prME
accguggucgcccugcuuaugcugcuucccaugguuuucagcuuucaccugaccacgagaggcggggaaccucauaugaucgugaacaagcaggaacggggaaaaucccuccuguucaagaccucuggcgggauuaauaugugcacccuuaucgcuauggaccugggagaucucugugaggacaccaugacauacaaaugcccgagaauuaccgaagccgagcccgaugacguggauuguuggugcaacgccacagacaccugggucacguauggcaucuguagcccuaccggggaacacagacgggagaagcgcuccguggcucuggcgccccauguuggacugggccucgagacaagagccgaaaccuggaugucuagcgagggcgcuuggaaacaaauucagcggguggaaacaugggcccugcgccacccuggguuuaccgucaucgcucuuuuccuggcccauaucauuggaacguccaucacacagaagggcgugauuuuuauccuccugaugcuuguuacccccucuauggcgaugagaugcgugggggucggaaaucgggauuucguggagggccugagcggggccacauggguggacgucguucucgagcacggauccugugugaccaccauggcuaagaacaaaccuacacuggauauugaacugcucaagacggaggugagcaauccggccguccugcgcaaacuuugcaucgaagcuagaauuucuaacaccacaaccgacucccggugucccacacagggcgaggccagccugucugaagaacaggauaccaauuuugugugccgcagaacgcucguugaccggggcugggggaacggauguggccuguucgggaagggaucccuuaucacaugcgcgaaauuugagugccugaccaagauggaaggcaagaucgugcaguacgagaaucucaaauauagcgucauugugaccguucacacaggggaucagcaucaggugggaaacgaaaccacaggccacggcacgaccgccacaaucaccccucaagcucccacaucugagauucagcugaccgacuacggggcccugacgcucgacuguuccccucgcaccggacuggauuucaaugaaaugguccuucugacaaugaaggagaaaagcuggcucgugcauaagcagugguuucuggaccuuccccugccgugggcuuccggcgccucuagcccucaggagaccuggaacagacaagaucuccuggucacauucaaaaccgcccacgcuaagaaacaggaagugguugugcuggggucccaggagggagcgaugcacacggcccucacaggcgcuaccgaaauccaaacaagcgggaccaccacaauuuuugccggccaucugaagugccggcuuaagauggacaaacugacgcucaagggaaugucuuaugucauguguaccggcuccuucaaacugaagaaagagguggccgaaacacagcacgggaccguucuggugcaggucgaguacgagggaacagaugcucccugcaagaucccuuucaccacgcaggacgaaaagggcgugauccaaaaugggagacuuauuacagccaaccccaucgugaccgauaaagagaagcccguuaauauugaagcggagccuccguuuggagagagcuauauggucaucggcgugggggacaaagcucucaagcugucuugguucaaaaagggcagcucccugggaaagauguuugaagccaccgcccgcggcgcucggagaauggccauucucggggauacagcuugggacuucggaucugugggcggggucuuuaccagcaugggaaaacuggugcaucagaucuucggcacagccuacgggguucucuuuuccggcgugagcuggacgaugaagaucggaauuggccugcuccugaccuggcuggggcuuaacucucgcuccacaagccucucuaugaccuguaucgcggucggaauuaucacacuguaccugggcgugaugguucaggccgauaccgggugcguggucaacuggaaaggacgggagcucaaguguggcuccgggauuuucgugacgaaugaaguucacaccuggacagagcaguauaaauuucaagcugacagccccaagagacuguccgccgcuaucggcaaggccugggaagacggagugugcggcauucgcucugcgacccggcuugagaacaucauguggaaacagaucgccaaugagcugaacuacauucuccuggaaaaugauaugaaguucacagucguggugggggacgucaaaggaauccugacccagggcaagaaagggauuagaccucagcccauggagcauaaguauagcuggaaauccuggggaaaggcuaagaucauuggcgccgauguucaaaacacaaccuuuaucaucgacggcccugauacgcccgaauguccggacucucagcgcgcuuggaauauuugggagguggaagauuacggguucggaaucuuuacaaccaacauuuggcuuaaacuccgggacagcuauacccaggugugcgaucacagacugauguccgccgccaucaaggacagccgcgcuguccacgcggauaugggcuacuggauugagucugagaaaaaugaaacauggaagcugucccgggccagcuucaucgaggugaaaaccuguacguggccuaagucucauacacucugguccaacgggguucuggaaagcgagaugaucauucccaagaucuauggaggcccuauuucucagcacaauuacagacccggguacuucacccaaacagcuggaccuuggcaucuuggcaaacuggaacucgacuuugaucugugcgagggcaccacaguggucguggacgagcagugcgggaaccggggacccagccugcgcaccacgaccguuacaggcaagaucauucacgaaugguguugcagauccuguacccuuccgccucuccgguucaaaggggaggacggaugcugguauggcauggaaaucagacccgugaaggagaaagaggaaaaucuggucaagagcauggugucugccggguccggaaagguugauaacuuuagccugggccuccuguguaucuccauuaugguggaggaagucaugcgcucucgguggagcggcaaaaugcuuaugacagggaccauggccguguuccugcuccuggugaugggacagcugacguggaaugaccuuaucagagucugcauuaugguuggcgcucacgcccuggauuccauggggaugggaacaaccuaccucgcgcugauggcuacauuuaagauccgccccaugcucgccgugggccugcuuuucagaaaacugaccucucgggagauucuccugcugaccaucgggcuuagccugauuacaccuguggaacucccgaacuccaucgaggagcugggagacggccucgccaugggcaucaugaugcugaaacuucugacggauuuucaacccuaucagcucugggcuacccugcugucucuuacauucgucaaaaccacacugagccuccauuacgccuggaagaccgcggcuauggugcuguccauuguuagccuccugccucuuugucugucuacgacaucccagaagaccaccuggcugcccauccuccuggggagccuuggaugcaaaccucugacaauguuucucauuucugaaaacaagaucuggggccgcagauccuggcccauuaaugaggggaucauggccgugggaaucgucagcauucugaugucuucccuccugaaaaacgacgugccucuugccggcccccugaucgcugggggaaugcugguugccuguuaugugauuagcggcuccagcgcugaucucacccuggaaaagacagccgaggucucuugggaagaggaggcggaacacagcggcacggcccauaauauccuuguggagguccaggacgaugggaccaugaaaauuaaggacgaagaacgggaagauacacugaccauccuccugaaagcugcccuccuggcucuuuccggaguguacccgaugucuaucccugccacacuguucguuugguauuuuuggcaaaagaagaaacagcgcagcggcgugcugugggacauucccuccccucccgaggucgagaaggccgugcucgaugacgggaucuaccggauucugcagcggggaguuuucggccgcucucaggugggggucggaguguuucaagaaggcguguuccacaccauguggcauguuacgagaggcgcuguccuuaccuaccaggggaaacggcuggagccgagcugggcguccgugaagaaagaccucaucucuuauggaggcggguggcgccugcagggaagcuggaacgugggcgaagagguccaggugauugccguugagccugggaagaaucccaagaacgugcaaacagucccuggaaccuucaaaacacacgaaggcgaggugggcgcuaucgcccucgauuuuaagcccgggaccuccggaagccccauuguuaauagagacggcaaaguggucgggcuguacggaaacggcgugguuacaacgucugggaccuauguguccgccaucgcucagagcaaggucucucaggaaggcccucuuccggagaucgaagaugagguguucaaaaagaagaaucugacaauuauggaccugcaccccggauccggcaaaacccggagauaccucccugccaucgugcgcgagagcauuaagcggagacugcgcacccuuauccuggcgcccacacgggucguugcuuccgaaauggccgaggcccucaaagggcugccuauuagauaucaaacgaccgcugugcgcaacgaacauacaggacgggagaucguggaucugaugugccacgccaccuuuacaaugagacuccuuucucccguccgcgugccuaauuacaacaugaucauuauggacgaagcgcauuucaccgauccggcuagcaucgccgcccggggcuauauuuccacgagaguugggaugggagaggcugccgcuaucuuuaugacagccacacccccuggcagcgcggaggccuucccccagucuaauuccgugauuuacgacgaagagaaggauaucccugaacggagcuggaacucuggguacgacuggaucaccgauuuucagggcaaaacagucugguucgugcccagcauuaagaccggaaaugacaucgcuaacugucugcgcaagaacggcaaaagaguuauucagcugucccggaagacauuugacaccgaguaucagaagacgaaaaauucugauugggacuucguggucacaaccgauaucagcgaaaugggggccaacuuucgcgcugacagagugauugauccgcggagaugccucaaaccugucauccugcgcgacggacccgagcgggugauucuugccggccccaugccuguuacaguggccuccgcugcgcagagacgcgggcggaucggaagaaaucagucuaaggagggcgaucaguacaucuauauggggcaaccccugaacaaugacgaagaucacgcccauuggaccgaggcuaagaugcuccuggacaacauuaauacgccugaaggcaucauuccggcccuguucgagcccgagcgcgaaaagagcgccgcuaucgauggagaguaccggcucagaggcgaggcccgcaagaccuucguggagcuuaugagaagaggggaccugccugucuggcuguccuauaaaguugcgagcgaaggcauucaauacgcugaucgcaaguggugcuuugacggagagagaaacaaucagauccucgaggaaaacauggacguggagaucuggacaaaagaaggggagcggaagaaacugcgccccagauggcuugaugcccggaccuauucugacccucuggcccucagagaguucaaggaguuugcugccggacgccgguccgugagcggcgaucugauucuggagaucggcaagcucccccaccaccuuacacagagagcgcaaaaugcccuggacaaccuggucaugcuccauaauuccgaacaagggggacgcgcuuaccggcacgccauggaggaacugccggauaccauugagacacuuaugcugcucgcuaugaucgccacccugacgggcgggguggcucuguucuuucucucuggaaaaggccuugggaagacaagcauuggacugcuguguguuauggccuccucuacccuccuguggauggcgagcguggaaccucauuggaucgccgcuuccaucguccuugaguucuuucugauggugcuccugauucccgagccugacagacagcggacaccccaggauaaccaacuggccuacgucgugaucggccuccuuguucugauucugacaguggcugccaaugaaaugggccuccuggagaccaccaagaaggaccuugggaucggaagcgccgcugcggaaauucagcaccacacgaccauccuggaugucgaccuccauccugccucugcuuggacacuguaugccguggccaccacaguuauuacccccaugcugcgccacacgaucgagaacaccacagcuaacaugucccucaccgccaucgcgaaucaggccgcuauucuuaugggccuggauaaaggguggccgaucagcaagauggacauuggagugccucugcucgcccugggcugcuacucucaagucaaccccaugacacuuaccgcugccgugcugaugcucguggcgcauuaugccaucauugggcccggacugcaggcuaaggccacgagagaugcucagaaacggacagccgcuggcaucaugaagaauccuaccguugacggcaucgucgccauugaccuggauccggugguguacgacacaaaauucgagaagcagcucgggcaaaucaugcuucugauucuguguaccucccagauccuccugaugcgcaccacaugggcguuuugcgaaagcauuacgcuugccaccggaccccugacaacccucugggagggcucuccugggaaauucuggaacacaaccaucgcugucagcauggccaauaucuuuagaggauccuaucuggcuggcgccgggcuggccuucucucucaugaaaagccuuggaggcaaccggcgcggcacgggggcgcagggagaaacacugggcgagaaguggaaaagacagcugaaucaacucuccaagcuggaauuuaacaccuacaaacggagcgggauuauggagguugaucgcaccgaggcuaaggaaggacuuaaaagaggcgagacaacccggcacgccguguccagagggacagcuaagcugcgcugguucguggaacggaaucucgucaagcccgagggaaaagugaucgaccugggcuguggcagagggggauggucuuauuacugcgccggccugaagaaaguuacggaagugaagggguacaccaaaggaggcccugggcaugaggagcccauuccuauggccacauauggauggaaccucgucaaacuucacagcggcaaagauguguucuuuaucccgcccgaaaagugugacacccugcugugcgauauuggcgaguccucuccuaaucccacaaucgaagaggggcgcacccuccggguucugaagaugguggaaccuuggcuuagaggaaaccaguucuguauuaaaguccugaaucccuacaugccgagcgugguggagacgcucgagcgcaugcagcggaagcacggcgggaugcuggucagaaacccucugucccgcaauucuacccaugaaauguauuggguuagcugcggaacaggcaacaucguguccgcugugaauaugaccagccggaugcuccugaacagauuuacaaugacccaccgcaaacccacauacgagaaggacgucgaucuuggggccggaacccggcauguggcgguugaacccgagguggccaaccuggacaucauuggccagagaaucgagaauauuaaaaacgaacacaagucuacguggcacuaugaugaggacaauccuuacaagacaugggcuuaucauggcuccuacgaagucaaacccagcgggucugccuccagcauggugaacggaguugugcgccuccugaccaagccuugggacgucaucccgauggugacccaaauugcuaugacagauacgacccccuucggccagcagagaguuuuuaaagagaagguggacacacggaccccuaaagccaagcgcgggacagcgcaagucauggaaaucaccgccggauggcuuuggaaguuccugucucgcaagaagaaaccccggaucuguacaagagaggaguuuacccggaaggugcgcuccaaugcugccauuggcgcugucuucguggaugaaaaccaguggaauagcgccaaagaggcuguugacgaugaaagauuuugggaccucgugaaccgggagcgcgaacugcacaagcaggggaagugcgccacgugcgucuacaauaugaugggcaaaagagagaagaaacugggagaguucggcaaggcgaaagggucccgggccaucugguauauguggcucggagcucgcuuucuggaguucgaggcccuuggcuuuaugaacgaagaucauugguucagcagagacaauucucugagcgggguggagggagaaggccuccacaagcugggguacauucuucgggauaucgcucgcauuccuggcggaaacauguaugccgacgauaccgccggcugggacacaagaaucaccgaggaggaucugcagaaugaagcgcgggugacagagcucauggaacccgaccaugcucaacuggccaccuccaucuuccgccugacguaccagaacaaaguugugagaguccagcggccggggaagaauggaacagugauggacguuauuucucgcagagaucagcggggcagcgggcaagugggaaccuauggccucaacacauuuaccaacauggaggcccagcugaucagacagauggaguccgaaggggucuucucuccuagcgagcuugaaacgcccaaucuggcuaaccgcgugcucgacuggcuggagaaguacggcgucgaacggcuuaaaagaauggccauuuccggagaugacugugugguuaagccuaucgaugaccgcuuugcuaccgcccugacagcgcucaaugauaugggcaaagugcggaaggacauuccccagugggagccuucuagaggguggaacgauuggcaacagguccccuucugcagccaccacuuucaucagcugaucaugaaagacggacgcgagaucgugguuccgugucggaaucaggaugaacuggugggcagagcccgcgucucccaaggggcuggauggagccuccgggagaccgccugccugggcaagucuuaugcucagauguggcagcuuauguacuuccacagacgcgaccugcggcucgccgcgaacgccauuuguuccgcugugccuguggacuggguucccacaagcagaaccacauggucuauccaugcccaccaccaauggaugaccacggaagauaugcuguccgucuggaaucggguguggauugaggaaaaccccuggauggaggacaagacacaugugaccagcugggaggaugucccuuaccuugggaaaagagaagaccaguggugcggcucccugaucggacucucugcucgcgccaccugggcuauuaauauccagguggccauuaaccagguucggaagcugaucggcaaugagcacuaucaagauuacaugacaagcaugagacgcuuuaaaaacgaauccgagccggaaggggcgcugugguga

SEQ ID NO: 19521 - RNA, 9879 nt, Artificial Sequence
  derived and/or modified CDS sequence (opt5) from DENV-1__DQ285561__SS-prME
agcgugaccaugcugcucaugcugcuucccaccgcucugacguuccaccucaccacacggggaggggagccucauaugauugucggaaagcaggaacggggcaaaucccugcuuuuuaagaccucugcugggguuaauaugugcacacugauugccauggaccucggagagcugugugaugacaccaugacauacaaaugcccgcgcaucaccgaaacggagcccgaugacguggauuguuggugcaaugcgaccgaaacaugggugaccuauggcacauguagccaaaccggggagcacagacgggacaagcgcuccgucgcucuggccccucaugugggacucggccuggagacgagaacagaaaccuggaugucuagcgagggcgccuggcggcagauucagaaaguugaaacaugggcccuucgccaccccggguucaccgugaucgcccuguuucucgcucaugccauuggaaccuccaucacacagaagggcaucauuuucauccugcuuaugcuggucacgccuucuauggcgaugagaugcguggggauuggaaaccgggauuuuguugagggccucagcggggccaccuggguggacgucgugcuggagcacggauccugugugacaaccauggcuaaggauaaacccacacuggacaucgaacuccugaagaccgaggucacgaauccugccguucuucgcaaacugugcauugaagcuaagaucagcaacacaaccaccgauucuagauguccgacacaaggcgaggccacccucguggaggaacaggacacaaauuucgugugccggcgcacguuugucgauagaggcugggggaacggauguggccuguucgggaaaggaucccuuauuaccugcgcgaaguuuaagugcgugacaaaacuggagggcaagaucguucaguacgaaaaucucaaauauagcgugaucgucaccgugcacacaggggaccagcaucaaguuggaaacgagaccacggaacacggcaccauugccacaaucacaccccaggcuccuacaucugagauucagcugaccgacuacggcgcccugacgcucgauuguagcccccggacagggcuggacuucaaugaaauggugcuucugaccaugaaggagaaaagcuggcucguccauaagcagugguuucuggaucuuccucugcccuggacaucuggagcuuccaccagccaagagaucuggaaccgccaggaccuccuggugaccuucaaaacagcccacgccaagaagcaggaagucgugguucugggcucccaagagggggcuaugcacacggcgcucaccggagccacagaaauucagaccucuggcacaaccacgaucuuugcugggcaucugaaaugcagacuuaagauggauaaacugacacucaagggcaucagcuaugugauguguaccggauccuucaaacuggagaaggaagucgccgagacccagcacggcacagugcugguucaggugaaguacgaggggaccgacgccccgugcaaaauuccuuucagcucucaagaugaaaagggagucacacagaauggccggcuugugacggcuaaccccaucgugaccgacaaagagaagccuguuaauauugaagccgagccgcccuuuggggaguccuauaucgucgugggagcgggcgaaaaagcucucaagcugagcugguucaagaaagggucuagcauuggcaagauguuugaggccacagccagaggagcucgccggauggccauccugggcgauaccgcuugggacuucggguccaucggaggcguguuuacaucugucgggaaacucgugcaucagauuuucggaaccgccuacggcguucuguuuagcgggguguccuggacgaugaagaucggcauuggaauccuucugaccuggcucggccugaacagcagaucuacaucccugagcaugaccuguauugcggucgggaugaucacacuuuaccucggagugaugguucaggccgauucuggcugcgugauuaauuggaaagggcgcgaacugaaguguggauccggcaucuucgucaccaacgaggugcacacauggaccgaacaauauaaguuucaggcugacagcccuaaacggcuguccgccgcuaucgggaaggccugggaggagggcguuugcggaauuagaucugcgacgcgccucgaaaacaucauguggaaacagauuagcaaugagcugaaccauauccuucuggaaaaugacaugaaguucacaguggucgugggcgauguguccgggauucucgcccagggcaagaagucuauccggccgcaacccauggagcacaaauacagcuggaaguccuggggcaaggcuaaaaucauuggggccgacguccagaacaccaccuuuaucauugauggaccuaauacacccgaauguccugacgaucagagagcuuggaacaucugggagguugaggacuauggcuucggcauuuuuaccacgaauaucuggcugaagcugcgcgauagcuacacacaggugugcgaccaccggcuuaugucugccgccaucaaagauuccaaggcugugcaugcggacaugggguauuggauugaaagcgagaaaaacgaaaccuggaagcucgccagagcuucuuucaucgaggucaagacauguauuuggcccaaaucccacacccuguggagcaauggagugcuggaaucugagaugaucauuccgaagaucuacggcgggccuaucagccaacauaacuaucgccccggauacuucacacagaccgccggcccuuggcaccucgggaaacuggagcuugauuuugaccugugcgaaggaacgaccguuguggucgaugagcacugcggcaaucggggccccucccucagaacaaccacagugaccgggaagauuauccaugaaugguguugccggagcuguacgcugccuccccugcgcuucaaaggagaggacggcugcugguacgggauggagauuagaccgguuaaggaaaaggaggaaaaccuugugaaaucuauggucuccgccggaagcggcgagguggacuccuuuucucucgggcugcuguguaucagcauuaugaucgaagagguuaugcgguccagauggucucgcaagaugcucaugacaggaacccuggcuguguuccuucugcucacaaugggccagcugaccuggaaugaucugauucggcuuugcaucauggucggcgccaacgcgagcgacaauauggggaugggaaccacauaucuggcucucauggccacguuuagaaugcgcccuauguucgccgugggccugcucuuuagacggcugaccucccgcgaggugcuucugcucacagucgggcugucucugguugcuagcguggaacuucccaacucccuggaggaacucggagauggccuggccauggggaucaugauucucaaacugcuuaccgacuuccaaagccaccagcugugggcgacacuccugucucugaccuuugugaagacgacauucucccuucauuacgcuuggaaaaccauggccaugauccugagcauugucucucucuuuccccugugucucuccaccacaagccagaagaccacauggcugccugugcuucugggaucucugggcugcaagccgcucacgauguuccugaucaccgagaacaaaauuuggggcagaaaguccuggccccuuaaugaagggaucauggccguuggaaucgugagcauucugcucuccagccugcucaaaaacgaugucccucuggcuggcccccuuaucgccgggggaaugcugauugcuuguuaugugaucucuggcagcuccgccgaccugucucucgagaaggcggccgagguuagcugggaagaggaagcugagcacuccggggccucucauaauauucugguggaaauccaggaugacggaacaaugaaaaucaaggaugaggagcgggacgauaccauuacaauccuucugaaagcuacccuccuggccauuagcggcgucuacccuauguccauccccgccacgcucuuugugugguauuucuggcaaaagaagaaacagcgcucuggcguccugugggacaccccuuccccucccgaaguggagagagcuguucuugaugacgggauuuaccggauccugcagcgcggacugcucggcagaucccaggugggggucggaguguuccaagaaggcguuuuucacacaauguggcacgugaccagaggggcgguccugauguaucagggaaagcgccuugagcccagcugggccucugugaaaaaggaccugauuuccuacggcggcggguggagauuccagggaagcuggaacacaggcgaggaagugcagguuaucgcugucgagcccgggaaaaauccuaagaacgugcaaaccgcccccggaacauuuaagacgucugaaggcgaggugggggccaucgcucucgauuucaaaccgggaaccuccggcagcccuauugucaaucgggaaggcaagaucguggggcuguacggaaacggcguugugacaaccuccgggaccuaugucucugccauugcgcaggcuaaagccagccaggagggaccccucccugagaucgaagacgagguguuuagaaagcgcaaucugacaauuauggaucuucaucccggcuccgggaaaacgcggagauaccugcccgccaucguucgcgaagcuaucaagcggaagcugagaacccucgugcuggccccuacacgcgucguggcgagcgagauggcugaagcccuuaaaggcaugccgauucgguaucaaaccacagccguuaagucugagcacaccggaagagagaucguggaccugaugugccaugcuacguucacaaugcgccuccugucccccguccgggugccuaacuacaauaugauuaucauggaugaagcccacuuuaccgaccccgcuagcauugccgcgagaggcuauaucucuacccggguggggaugggagaggccgcugccaucuucaugacagcuaccccucccggcagcgucgaagccuuuccucaguccaacgccguuauucaggaugaggaaaaagacaucccggagcgcucuuggaauagcggguacgauuggauuacaggauuccccggcaagaccgugugguuugugccuuccaucaaaucugggaacgacauugcuaauugucugagaaagaacggcaagcgggucauccagcucagccgcaaaacguucgauacagaguaucaaaagaccaaaaacaaugacugggacuacgugguuacaaccgauauuuccgaaaugggagcgaacuucagagccgaccgggugaucgaucccagacgcugccuuaagccugucauccugaaagacggccccgagcgggugauucuggcugggccgaugccuguuacgguggccagcgccgcucagagacgcggacggaucggcagaaaucagaacaaggaaggggaucaguacauuuauaugggacaaccccucaauaacgacgaggaucaugcccacuggaccgaggcgaagaugcugcuugacaauaucaacacacccgaaggcauuaucccugcucuguuugagcccgaacgcgagaaaucugccgccaucgauggggaauaccggcucagaggcgaggcucgcaagaccuucgucgagcugaugagacggggagaccugccuguguggcucuccuauaaagucgccagcgaaggcuuucaguacuccgaucgcagauggugcuucgacggggagcggaauaaccaggugcuugaagagaauauggauguugaaauuuggacaaaggagggagagcgcaaaaagcugagaccgcgguggcuggacgcgagaaccuauucugacccccucgcccugcgcgaauuuaaagaguucgcugccggccggagaagcguguccggggaucuuauccuggaaauuggaaagcucccucagcaccugacacaacgcgcucagaacgcccuggacaaucucgugaugcuucauaacucugagcagggcggcaaggcuuaccggcacgccauggaggaacugcccgauaccaucgagacgcugaugcuccuggcgcuuauugccguccugacagggggaguuacccucuuuuuccugagcggcagagggcugggaaaaaccuccaucggccuccuuugugugauguccucuagcgcucugcuguggauggccagcguggaaccucauuggaucgcugccucuauuauccucgaguuuuuccugaugguccuucugauucccgaaccggaccggcagcgcacaccucaagauaaucagcucgccuaugugguuaucgggcugcuguuuaugauucucaccguggcugcgaacgagaugggacuucuggagacaacgaagaaagaccugggcaucggccacgccgcugccgaaaaccaccaucacgccgcuaugcucgaugucgaccugcaucccgccuccgcguggacccuuuacgccguggcuacaaccauuaucacaccuaugaugagacacaccaucgagaauacgaccgccaacauuagccugacagcuaucgccaaucaggcggccauucucauggggcuggauaagggauggcccaucucuaaaauggacauuggcgucccucugcucgcucuugggugcuacagccaagugaacccccugacccugacagccgcuguucucaugcugguggcccauuaugcuaucaucggaccgggccuucaggccaaggcgacccgggaagcccagaagcgcacggcugccgggauuaugaaaaauccuacagucgauggaaucguggcuauugaccuggaucccguuguguacgacgccaaguucgagaaacagcucggccaaaucaugcugcugauucucuguaccucccagauccuucugaugagaacaaccugggcccugugcgaaucuaucacccucgcgacaggcccccugacgacccuuugggaggggagcccuggaaaguuuuggaacacaaccauugcugucuccauggccaauaucuuccggggcagcuaucuggcuggggccggacucgccuucucccugaugaaaucucugggcgggggacgcagaggcacaggcgcucagggggagacccucggagaaaaguggaagcggcagcuuaaccaacugagcaaauccgaguuuaauauuuacaagcgcucuggcaucguggaaguggacagaagcgaggccaaagaagggcugaagcggggagagacgauuaaacacgcgguuuccagaggcacagccaagcuccgcugguucgucgagcggaaccuggugaagccggaagggaaagugaucgaucuuggauguggcagaggcggguggucuuauuacugcgcuggacugaagaaagucaccgagguuaagggcuauaccaaagggggacccggccacgaggaaccuauucccauggccacauacggguggaaucucgugaagcuguacagcggaaaagacguguuuuucaucccucccgaaaagugugauacccugcucugcgacaucggcgaguccagcccuaacccgacaauugaggaaggccgcacgcuucggguccugaagaugguggagcccuggcugagagggaaucaguuuuguaucaaaauucucaacccuuauaugcccucuguuguggaaacccuggagcagaugcagcgcaagcauggaggcaugcuuguccggaauccucuguccagaaacagcacacacgagauguacugggugucuugcgggaccggaaauaucguuuccgcugugaacaugacaagccgcaugcuccugaaccgguucaccauggcccauagaaaacccacguaugaacgcgaugucgaccugggcgcggggacccggcacguggccguggagccggaagucgcuaaucucgauauuaucggacaaagaaucgagaacauuaagaaugaacacaaaucuacauggcauuacgacgaggauaacccuuauaagaccugggccuaccacggcuccuaugagguuaagcccagcggcuccgcuagcucuauggugaauggggugguccgccugcuuacaaaacccugggacgugaucccuaugguuacccagauugccaugacagauaccacgcccuuuggacagcaaagaguguucaaggaaaaagucgacacacggaccccuaaggcuaaacgcggcaccgcccagaucauggaggugacagcgaaguggcuguggggguuucucagcagaaacaagaaaccgcggauuuguacgagagaagaguucacccggaagguucgcuccaaugccgcuaucggagccguguuugucgacgaaaaccaguggaacucugcuaaagaggccguggaggaugaaagauucugggaccugguucggcgcgagagagaacuucauaagcagggcaaaugcgccacaugcguguacaacaugauggggaagcgggagaagaaacugggcgaauuuggaaaggcgaaaggcagccgcgcuaucugguacauguggcucggggccagauuccuggaguucgaggcccugggauuuaugaaugaagaucacugguucucccgggagaacucucucagcggcgucgaaggggagggacugcauaaacuuggcuauauucugcgcgacaucuccaaaauucccgggggcaauauguacgcugaugacaccgccggaugggauacaagaaucaccgaggacgaucuccaaaacgaagcuaagauuacagacaucauggagccugaacacgcccugcuugcgaccucuaucuuuaaacugacguaucagaauaaggugguccgggugcagcgccccgccaagaacggcaccguuauggaugugauuagcagacgggaccagcgcggguccggacaagucggcacauacgggcucaacaccuucacaaauaugggagcucagcugaucagacagauggagagcgaaggcaucuuuucuccuuccgagcuggagacccccaaccucgccgggcgggugcuggauuggcuugaaaaacacggcaucgagagacugcgccggauggcuauuagcggagacgacugugugguuaagccgaucgaugacagauucgccacggcgcucacagcccugaaugauaugggcaaagugcgcaaggacauuccucagugggaacccucuaaaggguggaacgauuggcaacaggucccuuuuugcucccaucacuuccaucagcuuaucaugaaggacggacgggagaucgugguucccuguagaaaucaggaugaacuggugggccgcgcucgggucagccaaggggccggauggucccucagagagaccgcuugccugggcaagucuuaugcccagauguggcagcugauguacuuucaccgccgggaccucagacuggcugccaacgcgauuuguagcgccgugccugucgauugggugcccacaucccgcaccacguggagcauccacgcucaucaccaauggaugaccacagaggacaugcuuucuguuuggaaucggguguggauugaagagaacccguggauggaagauaaaacccaugucuccagcugggaggacgugccuuaucuggggaagagagaagaccaguggugcggcucucucaucggacugacagcccgggccaccugggcuacaaauauucagguugccaucaaccaggugagacgccuuaucggcaaugagaacuaccuggauuacaugaccagcaugaaacgguucaagaaugaguccgaccccgaaggggcgcucugguga

SEQ ID NO: 19522 - RNA, 9879 nt, Artificial Sequence
  derived and/or modified CDS sequence (opt5) from DENV-1__DQ285562__SS-prME
uccgugaccaugcugcucaugcugcuucccaccgcccuggcuuuccaccucacgaccagaggcggggaaccucauaugaucguguccaagcaggaacggggaaagucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggcggcagauucagaaaguugaaacaugggcucuuagacaccccggcuucaccgugaucgcccuguuucucgcgcauacaauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccaaggagaggcgacacucguggaagaacaagaugccaacuucgugugccggcgcaccuuugucgacagaggcuggggcaauggguguggacuguucggcaaagggagccuucugacaugcgcuaaguuuaagugcgugacgaaacucgagggaaagauuguucaguacgaaaaccugaaauauucugugaucgucaccgugcacacaggcgaucagcaucaaguugggaaugagaccacagaacacggaaccaucgccacgauuacaccccaagcuccuaccuccgagauccagcugaccgacuacggcgcccucacacuggacuguagcccccggaccggccuugauuucaacgaaauggugcugcucacgaugaaggagaaaucuuggcugguccauaagcagugguuucuugaccugccucuccccuggacauccggggccagcaccucccaagagacauggaaucgccaggaucugcuggugaccuucaaaaccgcucacgcgaagaagcaggaagucgugguucucggaucucaagagggcgccaugcacacagcucugacgggggccaccgaaauucagacaagcggaaccacaaccaucuuugccggccaucuuaaaugcagacugaagauggacaaacucacgcugaaggggguguccuaugucauguguacaggcagcuucaaacuggagaaggaaguggcugagacccagcacggaaccguucuugugcaggucaaguacgagggcacagaugccccgugcaaaauuccuuucucuacccaagacgaaaagggggugacacagaacggacggcucaucacggcgaaucccaucgugaccgauaaagagaagccuguuaacauugaaacagagccgcccuuuggcgaguccuauaucgucauuggggcuggagaaaaagcccugaagcugagcugguucaagaaaggcucuagcaucgggaagauguuugaggccaccgcuagaggcgcccgccggauggcuauucucggagacacagccugggauuucggcuccaucgggggaguguuuaccucugugggcaaacugguccaucagguguucgggacggcguacggaguucuuuuuagcggcguguccuggaccaugaagaucgggauuggcauccugcucacauggcugggacugaauagcagaucuaccucccuuagcaugacauguauugucgugggcaugguuacccucuaccugggggugaugguccaggccgacucuggaugcgugaucaacuggaaaggccgcgaacugaaguguggguccggaauuuucguuacaaacgaggugcacaccuggacggaacaauauaaguuucaggcugauagcccuaaacggcucuccgccgcuaucggcaaggccugggaggagggggucugcggcauuagaucugcgacacgccuggaaaauaucauguggaaacagaucagcaacgagcuuaaucauauucugcucgaaaacgacaugaaguucaccgugguggucggagacgccaauggcauccugacccaggggaaaaagaugauucggccgcaacccauggagcacaaauacuccuggaagucuuggggaaaggcuaaaaucauuggcgccgauauccagaacacaaccuuuaucauugacgggccugauacgcccgaauguccugacgaucagagagcuuggaauaucugggagguugaggacuauggauucggcauuuuuacaaccaacaucuggcugaaacuucgcgauagcuacacacagaugugcgaccaccggcucauguccgccgccauuaaagauagcaaggcugugcaugcggacaugggcuauuggaucgaaucugagaaaaaugaaaccuggaagcuggccagagcuuccuucaucgaggugaagacauguauuuggccccgcagccacacccuguggucuaacgggguccucgaauccgagaugaucauuccgaaaaucuacggaggcccuauuagccaacauaauuaucggcccggguacuucacgcagaccgccggaccuuggcaccugggcaaacuugagcuggauuuugaccucugcgaagggacaaccgugguuguggaugagcacugcggaaacagaggccccucucugcggacaaccacggucacaggcaaaaucauccaugaaugguguugccgcagcuguacccugccuccccuuagauucaagggggaggacggaugcugguacggcauggagauucggccggugaaagaaaaggaggaaaaucucguuagauccauggugagcgccgggucuggagaggucgacuccuuuagccugggccugcucuguguguccaucaugguugaagaggugaugcgcucucgguggagcagaaagaugcugaugacagggacccuugcugucuucuuucugcucauuaugggacagcugaccuggaacgaucugauccgccuuugcauuauggugggcgccaauguguccgacagaaugggcauggggacaacguaucuggcgcucauggcuaccuucaaaaugcggccuauguuugccgucggacuccuguuccgcagacugacaucucgggagguucuucugcucaccaucggccugagccugguggccuccguggaacuucccaacucucuggaggaacucggggauggacuggcuaugggcauuaugaugcucaagcugcuuacagacuuucaaagccaccagcuguggaccacgcuccugucccugacauucaucaaaaccacccuuagccuggauuacgccuggaagacaaucgcgaugguccucucuauugugucccuguuuccccucugucugagcaccacaucucagaaaacgaccuggcuuccuguucugcugggguccuucggaugcaagccgcucacaauguuucugaucaccgagaacaagauuuggggccgcaaaagcuggccccuuaaugaaggcaucauggcuguggggauugucucuauccugcucuccagccugcucaagaacgacgugccucuggccggaccccuuaucgccggcgggaugcugauuacauguuauguuaucuccggaagcucugcugaucugagccucgagaaagccgcugagguguccugggaagaggaagccgagcauucuggcgcgagccacaauauucuggucgaagugcaggacgaugggaccaugaagaucaaagacgaggagagagaugacacgcuuaccauucugcucaaggccacacugcucgcugucuccggaguguacccuaugucuauccccgccacccuguucguuugguauuucuggcagaagaagaagcagcggagcggcgugcuuugggauacaccuagcccucccgaagucgagcgcgcugugcuggacgacggcaucuaccgcauucugcagcgggggcuccugggacgcucucagguuggcgugggggucuuucaagauggaguguuccauaccauguggcacgugacaagaggcgccguucuuauguaucaggggaaacggcuggaacccagcugggccuccgucaagaaagaccucaucagcuacggaggcggcuggagauuucaggggucuuggaacacgggagaggagguccaggugauugcugucgaacccggcaagaauccuaaaaacgugcaaaccacacccgggaccuucaagaccccggagggagaaguuggcgcgaucgcccuggauuuuaagccugggacauccggaagccccauugugaaucgcgagggcaaaaucgucggccucuacgggaacggagugguuacgaccucuggcacauauguguccgcuauugcccaggccaaggcuagccaggaagggccucugcccgagaucgaggacgaagucuucaaaaagcggaaucuuaccaucauggaucugcaccccggauccggcaaaacaagacgcuaccugccugccauugugcgggaggcgaucaagagaaagcuccgcacccugauucuugcuccgacgcggguuguggccucugaaauggccgaggcucugaaagggaugcccaucagauaucaaacaaccgccgucaagagcgaacauaccggccgcgagauuguggaccucaugugccacgcgacauuuaccaugcggcugcuguccccugugagaguccccaacuacaauaugaucaucauggaugaggcucauuucacagacccugccagcauugccgcucggggauauaucucuacccgcguuggcaugggggaagccgcugccauuuuuaugacggcgacacccccuggauccguggaggccuucccgcagagcaacgcugugauccaggaugaagagagagacauucccgaacggucuuggaauagcggcuacgauuggaucaccgacuuuccugggaaaacagucugguucgugcccuccaucaagucuggaaacgacauugccaauugucuccgcaaaaacggcaagagaguuauccagcuuagccggaagaccuucgauacggaguaucagaagaccaagaacaaugacugggauuacguggucacaaccgacauuuccgagaugggggcuaacuuuagagccgaucgcgugaucgacccucggagaugccugaaacccguuauucugaaggauggcccggaacgcgugauccucgccggaccuaugcccgucacaguggcuucugcggcccagcggagaggccgcauugggcggaaucagaacaaagagggagaccaguacaucuauaugggccaaccccugaauaacgaugaagaccacgcucauuggaccgaggccaagaugcuucuggauaauaucaacacaccugaggggauuauccccgcccucuucgaaccugagagagaaaagagcgcugccauugacggagaguaccgccugagaggcgaagcgcggaaaaccuuugucgagcugaugcgcagaggggaucucccgguguggcuuuccuauaagguugcuagcgagggcuuccaguacucugaccggcgcuggugcuuugacggagaaagaaauaaccaggugcuggaggaaaauauggauguggagaucuggacgaaagaaggcgagcggaagaaacugagaccccgcuggcucgacgcccggacauauuccgauccucuggcccuuagagaguucaaggaauuugcugccgggcgccggagcgucuccggagaccugauucucgagaucggcaaacugccccagcaccugacccucagagcgcaaaacgcccuugauaaucugguuaugcugcacaacucugaacaagggggaaaggcuuaccggcaugccauggaggaacucccugacaccaucgagacacugaugcuucuggcucucauugccgugcugaccggcggcgugacacuguucuuucucagcgggaagggacuuggcaaaacguccaucgggcugcugugugucauggcuucuagcgugcuccuguggauggccuccguugagccccacuggauugcggccagcaucauucuugaguucuuucugauggugcuccugaucccggagccugaucgccagagaacaccccaggacaaucaacuggcuuaugucgugaucggacuccuuuucaugauucugacagucgccgcuaacgaaaugggccugcucgagaccacaaagaaagaucuggggaucggacaugccguggccgagaaccaccaccaugcuaccaugcuugacauugaucugcacccugcgucugccuggacgcucuacgcuguugccaccacaaucauuacccccaugaugcggcauacaaucgaaaauaccacggccaacauuucccugacagcuaucgccaaucaggcggccauccugaugggccucgacaagggcuggccuauuagcaaaauggauaucggggugccccuucuggcucugggaugcuacucucaggucaacccgcucacccugacagccgcugugcuuaugcugguugcccacuaugcgauuaucggcccugggcuccaagccaaggcuacccgcgaggcccagaagagaaccgcugccggaauuaugaaaaaucccacaguggacggcaucgucgcuaucgaccuggaucccgugguguacgacgccaaguuugaaaaacagcuggggcagauuaugcuccuuauccuguguacgucccaaauucugcucaugcggaccacaugggcgcugugcgagagcaucacccuugccacaggaccucugaccacgcucugggaaggcucuccgggcaaguucuggaacacaaccauugcuguuagcauggccaauaucuuccgcggguccuaucuggcuggagccggccuggccuuuucucucaugaaaagccuugggggaggcagacgggggaccggagcgcagggcgagacacugggcgagaaguggaagcgccagcugaaccagcucuccaaaagcgaguucaauaccuacaagagauccgggaucauggaggucgaucggucugaagcuaaagagggacugaagagaggcgaaacaacgaaacaugccgugagccgcgggaccgcuaaacuucggugguuuguggagagaaaccuggucaagcccgagggaaaaguuauugaccucggcugugggcgcggaggcugguccuauuacugcgccggccugaagaaagugacagaagugaagggguauaccaaaggaggcccugggcacgaggaacccaucccuauggccacauacggauggaaucuggucaagcuccacucuggcaaagauguguucuuuacgcccccugagaagugugacacccuucugugcgauauuggggaaagcuccccgaaccccaccaucgaggagggacggacacugagaguucucaagaugguggaaccuuggcugcgcggcaaucaauucuguauuaaaauccuuaaccccuacaugccuucugucguggagacccuggaacagaugcagcggaagcauggcgggaugcucguuagaaauccccugagccgcaacuccacacacgagauguauugggugagcugcggaaccggcaauauugucucugcugugaacaugacaucccggaugcugcucaacagauuuaccauggcccaucgcaaaccgacguacgagcgggacguggaucugggggcgggaacaagacacgucgccguugaaccugagaucgcuaaucuugacaucauuggccagcgcaucgaaaacauuaagaaugagcacaaaagcaccuggcauuaugaugaagacaaccccuacaagaccugggccuaucacgggucuuacgaggugaagcccuccggaagcgcuucuuccauggugaauggcgucgugagacugcucacaaaaccuugggacguuauccccauggugacgcaaauugccaugaccgauacaaccccuuucggccagcagcgggucuuuaaggagaaaguggacacacgcaccccgagacccaagcgggggacagcgcaaaucauggaaguuaccgccaaauggcuguggggauuccuuagcagaaacaagaagccucggaucuguacgcgcgaggaauuuaccagaaaagugcgguccaaugcugccauuggcgcugucuucguggaugagaaccaguggaauagcgccaaggaagcuguugaggacgagcgcuuuugggaucuggugcauagagaacgggagcuccacaaacaggggaagugcgccacaugcgucuauaacaugaugggaaaacgcgaaaagaagcugggcgaguucgggaaagcgaagggcucuagagccaucugguacauguggcugggagcucgguuccucgaauuugaggcccugggcuucaugaaugaggaccauugguuuagccgcgaaaacucccuuucugggguggagggagaaggccugcacaaacucggguacauucugagagauaucagcaagauucccggaggcaaugucuaugcugacgauaccgccgggugggacacacggaucaccgaggaugaccuucagaacgaggccaaaaucacggauauuauggaaccugagcacgcgcugcucgcuacauccaucuucaagcugaccuaccaaaauaaagugguucgcgugcagagacccgccaagucuggcacagucauggacauuaucagccggcgcgaccagagaggauccggccagguggggaccuauggacugaacacguuuaccaacauggaagugcaacucauucggcagauggagucugaaggcaucuucagcccguccgagcuggagaauagcaaccuugccgaaagaguucuggauuggcucgagaagcaugggguggaacgccugaaacggauggcuaucucuggagacgauugugucgugaagccuacagacgauagauuugccaccgcucuuacagcccugaaugacaugggcaaaguucgcaaggauauuccccagugggagccuuccaaaggguggaacgacuggcagcaagugcccuucugcagccaccauuuucaccagcucaucaugaaggauggccgggaaauugucgugccuuguagaaaucaggacgagcuggucggacgcgcgcgggugucucagggcgccggguggucccugagagagaccgcuugccucggaaagagcuacgcccaaauguggcagcugauguauuuccaccgccgggaucuuagacuggcugccaacgcgaucuguuccgccguucccguggacugggucccgacaucucgcaccacguggagcauucaugcucaccaucaguggaugacaaccgaagacaugcucuccguguggaaucggguuuggaucgaggaaaacccuuggauggaggauaaaacccacgugagcucuugggaagacguccccuaccugggcaagagagaggaucaauggugcgggucccuuauuggacugacagcccgggcuaccugggccacaaauauccagguggcuaucaaacaggugagacgccucauuggcaacgagaauuaucuggacuacaugacgagcaugaagcgguuuaaaaacgaaucugaucccgagggggcccugugguga

SEQ ID NO: 19523 - RNA, 9879 nt, Artificial Sequence
  derived and/or modified CDS sequence (opt5) from DENV-1__DQ285558__SS-prME
agcgugaccaugcugcucaugcugcuucccacagcccugacguuccaccucaccacacggggaggggagccucauaugaucgucggaaagcaggaacggggaaaaucccugcuuuuuaagaccucugcugggguuaacaugugcacacugauugccauggaccucggagagcugugugaugacaccaugacauacaaaugcccgcgcaucaccgaaacggagcccgaugacguggauuguuggugcaaugcgaccgaaacaugggugaccuauggcacauguagccaaaccggggagcaccggcgggacaagcgcuccgucgcucuggccccucaugugggacucggccuggagacgagaacagaaaccuggaugucuagcgagggcgccuggcggcagauucagaaaguugaaacaugggcccuucgccaccccggguucaccgugaucgcccuguuucucgcucaugccauuggaaccuccaucacacagaagggcaucauuuucauccugcuuaugcuggucacgccuucuauggcgaugagaugcguggggauuggaaaccgggauuuuguugagggccucagcggggccaccuggguggacgucgugcuggagcacggauccugugugacaaccauggcuaaggauaaacccacacuggacaucgaacuccugaagaccgaggucacgaauccugccguucuucgcaaacugugcauugaagcuaagaucagcaacacaaccaccgauucuagauguccgacacaaggcgaggccacccucguggaggaacaggacacaaauuucgugugccggcgcacguuugucgauagaggcugggggaacggauguggccuguucgggaaaggaucccuuauuaccugcgcgaaguuuaagugcgugacaaaacuggagggcaagaucguucaguacgaaaaucucaaauauagcgugaucgucaccgugcacacaggggaccagcaucaaguuggaaacgagaccacggaacacggcaccauugccacaaucacaccccaggcuccuacaucugagauucagcugaccgacuacggcgcccugacgcucgauuguagcccccggacagggcuggacuucaaugaaauggugcuucugaccaugaaggagaaaagcuggcucguccauaagcagugguuucuggaucuuccucugcccuggacaucuggagcuuccaccagccaagagaccuggaaccgccaggaccuccuggugacauucaaaacggcccacgccaagaagcaggaagucgugguucugggcucccaagagggggcuaugcacaccgcgcucacaggagccaccgaaauccagacaucuggcaccacgacaauuuuugcugggcaucugaaaugcagacuuaagauggauaaacugacccucaagggcaucagcuaugugauguguaccggauccuucaaacuggagaaggaagucgccgagacacagcacggcaccgugcugguucaggugaaguacgaggggacagacgccccgugcaaaaucccuuucagcucucaagaugaaaagggagucacgcagaauggccggcuugugaccgcuaaccccauugugacagacaaagagaagccuguuaauaucgaagccgagccgcccuuuggggaguccuauauugucgugggagcgggcgaaaaagcucucaagcugagcugguucaagaaagggucuagcaucggcaagauguuugaggccaccgccagaggagcucgccggauggccauucugggcgauacagcuugggacuucggguccaucggaggcguguuuaccucugucgggaaacucgugcaucagaucuucggaacggccuacggcguucuguuuagcgggguguccuggaccaugaagauuggcaucggcauucuucugacauggcucggccugaacagcagaucuaccucccugagcaugacauguaucgcggucgggcuuauuacccucuaccugggagugaugguucaggccgauucuggcugcgugaucaauuggaaagggcgcgaacugaaguguggauccggcauuuucgucacaaacgaggugcacaccuggacggaacaauauaaguuucaggcugacagcccuaaacggcucuccgccgcuaucgggaaggccugggaggagggcguuugcggaaucagaucugcgacacgccuggaaaacauuauguggaaacagaucagcaaugagcuuaaccauauucugcucgaaaaugacaugaaguucaccguggucgugggcgauguguccgggauccuggcccagggcaagaagucuauucggccgcaacccauggagcacaaauacagcuggaaguccuggggcaaggcuaaaaucaucggggccgacguccagaacaccacauuuauuaucgauggaccuaauacccccgaauguccugacgaucagagagcuuggaacauuugggagguugaggacuauggcuucggcaucuuuacgacaaauauuuggcugaaacuucgcgauagcuacacccaggugugcgaccaccggcucaugucugccgccaucaaagauuccaaggcugugcaugcggacaugggguauuggaucgaaagcgagaaaaacgaaacauggaagcuggccagagcuucuuucauugaggucaagaccuguaucuggcccaaaucccacacacuguggagcaauggagugcucgaaucugagaugauuaucccgaagauuuacggcgggccuaucagccaacauaacuaucgccccggauacuucacccagacggccggcccuuggcaccuggggaaacuugagcuggauuuugaccucugcgaaggaaccacaguuguggucgaugagcacugcggcaaucggggccccucccugagaaccacaaccgugacggggaagaucauucaugaaugguguugccggagcuguacacugccuccccuucgcuucaaaggagaggacggcugcugguacgggauggagaucagaccgguuaaggaaaaggaggaaaaccucgugaaaucuauggucuccgccggaagcggcgagguggacuccuuuucucuggggcugcucuguauuagcaucaugauugaagagguuaugcgguccagauggucucgcaagaugcugaugaccggaacacuugcuguguuccugcuccugaccaugggccagcugaccuggaaugaucuuauccggcugugcauuauggucggcgccaacgcgagcgacaauauggggaugggaacaacguaucucgcucugauggccaccuuuagaaugcgcccuauguucgccgugggccuccuguuuagacggcuuacaucccgcgaggugcugcuccugaccgucgggcugucucuuguugcuagcguggaacugcccaacucccucgaggaacugggagauggccucgccauggggaucaugauccugaaacuucugacagacuuccaaagccaccagcucugggcgacccugcugucucuuacguuugugaagacaaccuucucccugcauuacgcuuggaaaaccauggccaugauucucagcaucgucucucuguuuccccucugucuguccacaaccagccagaagacaacguggcuuccugugcugcugggaucucucggcugcaagccgcugaccauguuccuuauuacagagaacaaaaucuggggcagaaaguccuggccccugaaugaagggauuauggccguuggaaucgugagcauccuccuguccagccuccugaaaaacgaugucccucuugcuggcccccugauugccgggggaaugcugaucgcuuguuaugugauuucuggcagcuccgccgaccucucucuggagaaggcggccgagguuagcugggaagaggaagcugagcacuccggggccucucauaauauccuuguggaaauucaggaugacggaaccaugaaaaucaaggaugaggagcgggacgauacaaucaccauucugcucaaagcuacgcugcucgccaucagcggcgucuacccuauguccauucccgccacccuguuugugugguauuucuggcaaaagaagaaacagcgcucuggcguccuuugggacacaccuuccccucccgaaguggagagagcuguucuggaugacgggaucuaccggauucugcagcgcggacuccugggcagaucccaggugggggucggaguguuccaagaaggcguuuuucacaccauguggcacgugacaagaggggcgguccuuauguaucagggaaagcgccuggagcccagcugggccucugugaaaaaggaccucaucuccuacggcggcggguggagauuccagggaagcuggaacaccggcgaggaagugcagguuauugcugucgagcccgggaaaaauccuaagaacgugcaaacagcccccggaacguuuaagaccucugaaggcgaggugggggccaucgcucuggauuucaaaccgggaacauccggcagcccuaucgucaaucgggaaggcaagauuguggggcucuacggaaacggcguugugaccaccuccgggacauaugucucugccaucgcgcaggcuaaagccagccaggagggaccccugccugagauugaagacgagguguuuagaaagcgcaaucuuacgaucauggaucugcaucccggcuccgggaaaacccggagauaccugcccgccauuguucgcgaagcuaucaagcggaagcucagaacacuggugcuugccccuacccgcgucguggcgagcgagauggcugaagcccugaaaggcaugccgauccgguaucaaacaaccgccguuaagucugagcacacgggaagagagauuguggaccucaugugccaugcuacauucaccaugcgccugcugucccccguccgggugccuaacuacaauaugaucauuauggaugaagcccacuuuaccgaccccgcuagcaucgccgcgagaggcuauauuucuacacggguggggaugggagaggccgcugccaucuucaugaccgcuacaccucccggcagcgucgaagccuuuccucaguccaacgccguuauccaggaugaggaaaaagacauuccggagcgcucuuggaauagcggguacgauuggaucaccgacuuccccggaaagacggugugguuugugccuuccauuaaaucuggcaacgauaucgcuaauugucucagaaagaacgggaagcgggucauucagcuuagccgcaaaacauucgacaccgaguaucaaaagaccaaaaauaaugacugggauuacgugguuaccacggacaucuccgaaaugggcgcgaacuucagagccgaucgggugauugaccccagacgcugccugaagccugucauccugaaagauggacccgagcgggugauccucgcuggcccgaugccuguuaccguggccagcgccgcucagagacgcgggcggauuggaagaaaucagaacaaggaaggcgaccaguacaucuauauggggcaaccccugaauaacgaugaggaccaugcccacuggacagaggcgaagaugcuucuggauaauauuaacacccccgaaggaaucauuccugcucucuuugagcccgaacgcgagaaaucugccgccaucgacggcgaauaccggcugagaggggaggcucgcaagacauucgucgagcugaugagacggggcgaucucccuguguggcuuuccuauaaagucgccagcgaaggauuucaguacuccgaccgcagauggugcuucgauggcgagcggaauaaccaggugcuggaagagaauauggacguugaaaucuggaccaaggagggggagcgcaaaaagcugagaccgcgguggcucgacgcgagaacauauucugauccccuggcccuucgcgaauuuaaagaguucgcugccggacggagaagcguguccggcgaccugauucucgaaaucgggaagcugccucagcaccugacccaacgcgcucagaacgcccucgauaaucuugugaugcugcauaacucugagcagggaggcaaggcuuaccggcacgccauggaggaacugcccgacacgauugagacacucaugcugcuugcgcugaucgccguccucaccggcgggguuacccuguuuuuccugagcggaagaggccucgggaaaacauccauuggacuucugugugugauguccucuagcgcucugcucuggauggccagcguggaaccucauuggaucgcugccucuaucauucuggaguuuuuccuuaugguccugcucauccccgaaccggaucggcagcgcaccccucaagacaaucagcuggccuaugugguuauuggccugcucuuuaugauccuuacaguggcugcgaacgagauggggcugcuggagacgaccaagaaagaucucggaauuggccacgccgcugccgaaaaccaccaucacgccgcuaugcuggacgucgaucuucaucccgccuccgcguggacacuguacgccguggcuaccacaaucauuaccccuaugaugagacacacgaucgagaauaccacagccaacaucagccucaccgcuauugccaaucaggcggccauccugaugggccuggacaagggguggcccauuucuaaaauggauaucggagucccucuccuugcucugggcugcuacagccaagugaacccccugacacucaccgccgcuguucugaugcuuguggcccauuaugcuauuaucgggccgggacugcaggccaaggcgacgcgggaagcccagaagcgcacagcugccggcaucaugaaaaauccuaccgucgacgggauuguggcuaucgaucucgaccccguuguguacgacgccaaguucgagaaacagcugggacaaauuaugcugcucauccuuuguacaucccagauucugcugaugagaaccaccugggcccucugcgaaucuaucacacuggcgacgggcccccuuaccacacugugggagggcagcccugggaaguuuuggaacaccacaaucgcugucuccauggccaauauuuuccggggaagcuaucucgcuggcgccgggcuggccuucucccugaugaaaucucucggaggcgggcgcagaggaaccggcgcucagggcgagacgcuuggggaaaaguggaagcggcagcugaaccaacugagcaaauccgaguuuaauaucuacaagcgcucuggaauuguggaaguggauagaagcgaggccaaagaaggccucaagagaggggaaacaaucaaacacgcgguuuccagaggaaccgccaagcugcgcugguucgucgagcggaaccuugugaagccggaaggcaaagugauugaccugggguguggaagaggcggcuggucuuauuacugcgcugggcucaagaaagucaccgagguuaagggauauacaaaaggcgggcccggacacgaggagccuauccccauggccaccuacggcuggaaucuggugaagcuguacagcgggaaagauguguuuuucauuccucccgaaaagugugacacacuccuuugcgauaucggagaguccagcccuaacccgacgaucgaggaaggccgcacccugcggguccugaagaugguggagcccuggcucagaggcaaucaguuuuguauuaaaauccugaacccuuauaugcccucuguuguggaaacacuugagcagaugcagcgcaagcaugggggaaugcugguccggaauccucucuccagaaacagcacccacgagauguacugggugucuugcggcacagggaauauuguuuccgcugugaacaugaccagccgcaugcugcugaaccgguucacgauggcccauagaaaacccaccuaugaacgcgacgucgaucucggagcgggcacacggcacguggccguggagccggaagucgcuaaucuggacaucauugggcaaagaaucgagaacaucaagaaugaacacaaaucuaccuggcauuacgaugaggacaacccuuauaagacaugggccuaccacggauccuaugagguuaagcccagcggcuccgcuagcucuauggugaauggcgugguccgccuucugaccaaacccugggaugugauuccuaugguuacacagaucgccaugaccgacacgacacccuuugggcagcaaagaguguucaaggaaaaagucgacacccggaccccuaaggcuaaacgcggaacagcccagauuauggaggugacggcgaaguggcucuggggcuuucugagcagaaacaagaaaccgcggaucuguaccagagaagaguucacacggaagguucgcuccaaugccgcuauuggggccguguuugucgaugaaaaccaguggaacucugcuaaagaggccguggaggacgaaagauucugggaucuuguucggcgcgagagagaacugcauaagcagggaaaaugcgcuaccugcguguacaacaugaugggcaagcgggagaagaaacucggggaauuuggcaaggcgaaaggaagccgcgcuaucugguacauguggcugggcgccagauuccuggaguucgaggcccucggguuuaugaaugaagaccacugguucucccgggagaacucucugagcggagucgaaggcgaggggcuucauaagcugggauauauccuccgcgauauuuccaaaauccccggcgggaauauguacgcugacgauacagccggcugggacaccagaauuacagaggaugaccugcaaaacgaagcuaagaucaccgauauuauggagccugaacacgcccuucuggcgacgucuaucuuuaaacucaccuaucagaauaaggugguccgggugcagcgccccgccaagaacggaacaguuauggacgugaucagcagacgggaucagcgcggcuccgggcaagucggaaccuacggccugaacacauucaccaauaugggggcucagcugauuagacagauggagagcgaaggaaucuuuucuccuuccgagcucgagacgcccaaccuggccggccgggugcuugacuggcuggaaaaacacgggauugagagacuccgccggauggcuaucagcggcgacgauugugugguuaagccgauugacgauagauucgccacagcgcugaccgcccuuaaugacaugggaaaagugcgcaaggauaucccucagugggaacccucuaaaggcuggaacgacuggcaacaggucccuuuuugcucccaucacuuccaucagcugauuaugaaggaugggcgggagaucgugguucccuguagaaaucaggacgaacucgugggacgcgcucgggucagccaaggcgccggguggucccugagagagacagcuugccugggaaagucuuaugcccagauguggcagcucauguacuuucaccgccgggaucugagacuugcugccaacgcgaucuguagcgccgugccugucgacugggugcccaccucccgcacgaccuggagcauucacgcucaucaccaauggaugacaaccgaggauaugcugucuguuuggaaucggguguggaucgaagagaacccguggauggaagacaaaacacaugucuccagcugggaggacgugccuuaucucggcaagagagaagaucaguggugcgggucucugauuggccuuaccgcccgggccacaugggcuaccaauauccagguugccauuaaccaggugagacgccugaucggaaaugagaacuaccucgacuacaugacgagcaugaaacgguucaagaaugaguccgaucccgaaggcgcgcugugguga

SEQ ID NO: 19524 - RNA, 9879 nt, Artificial Sequence
  derived and/or modified CDS sequence (opt5) from DENV-1__DQ285559__SS-prME
agcgugaccaugcugcucaugcugcuucccacagcucugacguuccaccucaccacaagaggaggggagccucauaugaucguguccaagcaggaacggggaaaaucucugcuuuuuaagaccagcguuggagugaauaugugcacacugauugcuauggaccucggggagcugugugaagauaccaugacauacaaaugcccccgcaucaccgaggccgaacccgacgauguggacuguuggugcaaugcgacggauaccugggucacauauggaaccuguucccaaacaggagagcacagacgggacaagcgcucuguggcucuggccccucauguugggcucggacuggagaccagaacggaaacauggaugagcuccgagggcgccuggaaacagauucagaagguggaaaccugggcccuucggcaccccggcuucacagucaucgcccuguuucucgcucaugccauugggaccucuaucacccagaagggaaucauuuucauccugcuuaugcuggugacaccuagcauggcgaugcgcugcguuggcauugggaauagagauuuuguggagggacucuccggcgccacgugggucgacguggugcuggagcacgggagcugugucaccacaauggcuaaaaauaagcccacccuggauaucgaacuccugaaaacagagguuaccaacccugccgugcuucggaagcugugcauugaagcuaaaaucucuaauacgacaaccgacucccgcuguccgacccaaggagaggccacacucguggaagaacaagaugcgaacuucgucugcagacggaccuuuguggaccgcggcuggggcaauggguguggacuguucggcaaggggagccuucugacaugcgccaaguuuaaaugcguuacgaagcucgagggaaaaauugugcaguacgaaaaccugaaguauucugucaucgugaccguucacacaggcgaucagcaucaaguggggaaugagaccacagaacacggaaccaucgcuacgauuacaccccaagccccuaccuccgagauccagcugauugacuacggcgcucucacccuggacuguagccccagaacaggccuugauuucaacgaaaugguccugcucaccaugaaagggaagucuuggcuggugcauaaacagugguuucuugaccugccucuccccuggacguccggagccagcacaucccaagagaccuggaaucggcaggaucugcuggucacauucaagaccgcccacgcuaagaaacaggaggugguugugcucggcucucaagaaggggcgaugcacaccgcccugacaggagcuacggagauccagaccagcggcacaaccacaauuuuugccgggcaucuuaagugccgccugaaaauggacaagcucacccugaaaggcauguccuaugucauguguacgggcagcuucaagcuggaaaaggagguggccgaaacacagcacggcaccguucuugugcaggucaaauacgaggggaccgaugcuccgugcaagaucccuuucucuacacaagacgagaaaggagugacccagaacggcagacucaucacagccaaucccauugugacggauaaggaaaaaccuguuaacaucgagaccgaaccgcccuuuggggaguccuauauugucgugggagcgggcgagaaggcucugaagcugagcugguucaaaaaggggucuagcaucggcaaaauguuugaagccacagcccggggagcuagacgcauggccauucucggcgacaccgcuugggauuucggguccaucggaggcguguuuacaucugucgggaagcugacccaucagguguucggaacggccuacggcguucuuuuuagcgggguguccuggaccaugaaaaucggcauuggaauccugcucacauggcugggccugaauagccggucuaccucccuuagcaugacauguauugcggucgggauggugacccucuaccugggaguuauggugcaggccgacucuggcugcgucaucaacuggaaggggagagagcugaaguguggauccggcauuuucgugacaaacgaaguucacaccuggacggagcaauauaaauuucaggcugauagcccuaagaaacucuccgccgcuaucgggaaggccugggaagagggcgugugcggcauuagaucugcgacacggcuggagaauaucauguggaaacagaucagcaacgaacuuaauuacauucugcucgagaacgacaugaaguucaccgucguggugggcgacgccaaugggauccuggcucagggcaagaaaaugauuagaccgcaacccauggaacauaaguauuccuggaaaucuuggggcaaggccaaaaucauuggggcugauauccagaacaccacauuuaucauugacggaccugauacccccgaguguccugacgaucagcgcgccuggaauaucugggaagucgaggacuacggcuucggcauuuuuacgacaaacaucuggcugaaacuucgggauagcuauacccagaugugcgaccacagacucauguccgccgcuauuaaagauagcaaggcgguucacgccgacaugggguacuggaucgagucugaaaagaaugagacauggaaacuggcucgcgccuccuucaucgaagugaagaccuguauuuggcccaaaagccauacacuguggucuaacggagugcucgaguccgaaaugaucauuccgaagaucuauggcgggccuauuagccaacacaauuaccggcccggauacuucacccagacggccggcccuuggcaucuggggaaacuugagcuggauuuugaccucugcgagggaaccacagucgugguugaugaacacugcggcaacagaggccccucucugcgcaccacaaccgugacggggaagaucauccacgagugguguugccggagcuguacacugccuccccuuagauuccggggagaagacggcugcugguaugggauggagauucgcccggucaaggagaaagaagagaaucucgugagauccaugguuagcgcuggaucuggcgaaguggacuccuuuagccuggggauccugugugucuccauucucaucgaggaagugaugcggucuaaguggagcagaaaaaugcugaugaccggaacacuugccguuuuccugcuccugauuaugggccagcugaccuggaacgaucuuacccgccugugcaucauggugggcgcgaaugcuuccgaccggauggggaugggaacaacguaccucgcccugauggccaccuuuaagaugagaccuauguucgcugucggccuccuguuucgcagacuuacaucucgggaggugcugcuccugaccauugggcugagccuuguggccuccgucgagcugcccaacucucucgaggaacugggagauggccucgcgauggggaucaugauccugaaacuucugacagacuuccaaccccaucagcucuggaccacgcugcugagccuuacauuuauuaagaccacccugucccucgauuaugcuuggaagacaauggccaugacccugagcaucguuucucucuucccucugugucuuuccacaacgagccagaaaaccacauggcugccggugcugcucggaucuuuuggcugcaagccccugaccauguuccuuauuacagaaaacaaaaucuggggccgcaaguccuggccuauuaaugaggggaucauggccgugggaaucgucagcauucugcucucuucccugcucaaaaacgacgugccccuggcuggcccucuuaucgccgggggaaugcugauugcuuguuacguuaucagcggcuccagcgccgaucugucucucgaaaaggcggccgaggugagcugggaggaagaggcugaacacuccgggaccucucauaauauucuggucgaggugcaggacgauggaacgaugaaaaucaaggacgaagagagagaugacacccuuacaauccugcucaaggccacccugcucgcuguuagcggcguguaucccauguccauuccugccacacuguuugucugguacuucuggcagaaaaagaaacagcggucuggcgugcuuugggauacccccagcccgccugaggucgaacgcgccgugcuggacgacgggaucuaucgcauucugcagcggggacuccugggccgcucccagguuggggugggagucuuccaagauggcguguuucacacaauguggcauguuacgagaggggcugugcuuauguaccagggaaagcggcuggagcccucuugggcgagcgucaaaaaggaccucaucuccuacggcggcggguggcgcuuccagggaagcuggaacaccggcgaagagguccaggugauugccguugagccugggaagaaucccaaaaacguccaaacaaccccgggaaccuuuaagacaccugaaggcgaggugggggcuaucgcccuggauuucaaacccggaacgucuggcuccccuauugugaauagagaaggcaagaucgucgggcucuauggaaacggcgugguuaccacaagcgggaccuacgugucugccaucgcucaggccaaagcgucccaggagggaccccugcccgaaauugaggacgaggucuuuaagaagcggaaucuuacaaucauggaucugcacccuggcagcgggaaaaccagacgcuaucugccggcuauugugcgggaagccaucaagagaaaacuccgcacgcugauucuugcccccacacggguuguggcuuccgagauggccgaagcgcugaagggcaugccuaucagauaccaaaccaccgcugucaaaucugagcacacaggacgcgaaaucguggaccucaugugccaugccaccuucacaaugcggcugcugagccccguuagagugccuaacuauaauaugauuaucauggaugaggcccacuuuaccgaccccgcuuccauugccgcucgcggcuacaucagcacgcgggucgggaugggagaggccgcggccauuuucaugacagcuaccccuccgggcucuguggaagccuuuccccaguccaacgcugugauccaggaugaggaaaaggacaucccugagagaagcuggaacucuggguaugauuggauuacagacuuccccggaaagaccgucugguuuguuccuagcaucaaauccggcaacgacauugccaauugucuccggaagaacgggaaacgcgugauccagcuuucuagaaagacguucgauaccgaauaccagaaaaccaagaacaaugacugggauuacguggucaccacagacauuagcgagaugggcgccaacuuccgggcugaucgcgugaucgaccccagacggugccugaagccgguuauucugaaagauggaccugagagagugauccucgcgggccccaugcccgucaccguggccuccgcugcccagcgccgggggagaaucggacgcaaucagaacaaggaaggcgaccaguauguuuacauggggcaaccucugaauaacgaugaggaccaugcccacuggacagaagcuaaaaugcuucuggauaauauuaacacccccgagggaaucauuccugcccucuuugagccggaacgggagaagucugcggcuaucgacggcgaauauagacugcgcggggaggcccggaaaacguucguggaacugaugagacgcggcgaucuccccgucuggcuuagcuacaagguggccuccgagggauuucaguauagcgacagacgguggugcuucgacggcgagcgcaauaaccagguccuggaagagaauauggauguggaaauuuggacaaaagagggggaaagaaagaagcugcggccucgcuggcucgacgcuagaaccuacucugauccccuggcccuucgggaguuuaaagaguucgcggccggaagacgcuccguuagcggcgaccugauccucgaaaucgggaagcugccucagcaucugacccuccgggcucaaaacgcccuugauaaucuggugaugcugcacaacuccgagcagggaggcaaggcuuauagacacgccauggaggaacuccccgacacaauugaaacccugaugcuucuggcucucaucgccgugcugacaggcggggucacgcuguuuuuccucucuggaaagggccuugggaaaaccagcauuggacugcuguguguuauggcguccucugcccuccuguggauggcuagcguggagccgcauuggaucgccgcuuccauuauccuugaguuuuuccugauggugcuccugaucccugaacccgaucgccagcggacaccucaggacaaucaacuggccuacgucgugauuggccuccuuuuuaugauccugaccguugccgcuaacgagauggggcugcucgaaacaaccaagaaggaucugggaauuggccacguggcggccgagaaccaucaccacgcuacgaugcuugacgucgaucugagacccgccagcgccuggacccucuacgcuguggccacaaccgucaucacaccuaugaugcggcauaccauugagaauacgacagcgaacaucucucugaccgccauugcuaaucaggccgcuauccugaugggccucgacaaaggguggcccaucuccaagauggauauuggagugccgcuucuggcccugggcugcuauagccagguuaacccucucacacugaccgcggccgugcuuaugcuggucgcucacuacgccaucauugggcccggacuccaagcuaaagccacccgcgaagcucagaagagaacagccgcgggcaucaugaaaaaucccacgguggacgggauuguugccaucgaccuggauccuguggucuaugacgcuaaguucgagaagcagcugggacagaucaugcuccuuauucuguguaccucucaaauccugcucaugcggacaaccugggcccugugcgaauccauuacacuugcuaccggcccgcugacgacacucugggagggcagccccgggaaauuuuggaacaccaccaucgccgugucuauggccaauauuuuccgcggaagcuaccuggcgggcgcugggcuggccuucucccucaugaagucucuuggaggcgggagacggggaacaggcgcucagggcgaaacccugggggagaaauggaagcgccagcugaaccagcucagcaaauccgaguuuaauacauauaagagaagcggaaucauggaaguggaucgguccgaggccaaggaaggccugaaacgcggggagacgaccaagcaugccguuucuagaggaacagcuaaacuucggugguucgucgaaagaaaccuggugaagccugagggcaaagugaucgaccucggguguggacgcggcggcuggagcuacuauugcgccgggcugaagaaagucaccgagguuaagggauacacaaagggcgggcccggacacgaggagccuauucccauggcgaccuacggcuggaaucuggugaaacuccauuccgggaaggauguguuuuucaucccuccggaaaaaugugacacgcuucugugcgauauuggagagucuagccccaacccuaccaucgaagagggccggacacugagaguccucaagaugguggagcccuggcugaaaggcaaucaauuuuguauuaagauccuuaacccuuauaugcccuccguuguggaaacccuggagcagaugcagcgcaagcacgggggaaugcucguccggaauccgcugucuagaaacagcacacacgaaauguacuggguguccugcggcaccgggaauauuguuagcgccgugaacaugacaucucgcaugcugcucaaccgguucaccauggcucauagaaaaccuacguaugagcgcgacgucgaucugggagccggcacacggcacguggcuguggagcccgaagucgccaaucuugacaucaucgggcagagaauugagaacaucaagaaugaacauaaauccaccuggcacuacgaugaggacaaccccuauaagaccugggcguaccacggaagcuaugaaguuaaaccuucuggcuccgccagcucuauggugaauggcgugguccgccugcucacaaagcccugggacgugauuccuaugguuacgcaaaucgcuaugaccgauacaaccccguuugggcagcagcggguguucaaggagaaagucgacacaagaacaccccgcgccaagagaggaacagcucaaauuauggaggugaccgccaaauggcuguggggcuuucuuucccggaacaagaaaccucgcaucuguacgagagaagaguucacccggaagguuagaagcaaugcugccaucggggcgguguuugucgaugaaaaccaguggaacuccgccaaggaggcuguggaagacgagcgguucugggaucugguucaucgcgagagagaacuccacaaacagggaaagugcgccacaugcguguacaacaugaugggcaaacgggagaagaaacugggggaauuuggcaaggcuaaaggaagccgcgccauuugguacauguggcugggcgccagauuccucgaguucgaagcgcugggguuuaugaaugaggaccauugguucucucgggagaacagccuuuccggagucgaaggcgaggggcugcacaagcucggauauauccugcgcgauauuucuaagauccccggcgggaauauguacgcugacgauaccgccggcugggacacaagaauuaccgaagaugaccuucagaacgaggccaaaaucacggauaucauggagccugaacaugcucugcucgccacagcuauuuuuaagcugaccuaucaaaauaaagugguccgggugcagcgccccgccaagagcggaacaguuauggacgugaucuccagacgggaccagcgcggcucugggcaggucggaaccuacggccugaacacguucaccaacauggaggcgcaacucauuagacagauggaaagcgaggggaucuuucugccguccgaacuugagacaccuaaucuggccaaacgggugcucgauuggcuggagaaguauggagcugaacgccuuaagagaauggccauuucuggcgacgauugugugguuaaacccaucgacgaucgguucgcuaaggcccugaccgcgcucaacgacauggggaaagugagaaaggauaucccucagugggagcccagcaaaggcuggaaugacuggcagcaagucccuuuuugcucccaccacuuccaucagcugauuaugaaggauggacgcgaaaucgugguucccugucggaaccaggacgagcuggugggcagagcccgcgucagccagggggcuggauggucucuccgggaaacagccugccugggcaaguccuacgcucaaauguggcagcuuauguauuuucacagacgcgaucugcggcucgccgcuaaugccauuuguagcgcggugccggucgacugggugccuaccucuagaacaaccugguccauccaugcccaccaccaguggaugacgacagaggacaugcugagcguuuggaaccgcguguggauugaggaaaaucccuggauggaggauaaaacccaugucuccucuugggaagaggugcccuaccuugggaagcgggaagaccaauggugcggaagccugaucggccucaccgcuagagccacaugggccaccaacauucagguugcuaucaaucaggugcgccggcugaucgggaacgagaauuaccuggauuauauggccuccaugaaaagauucaagaacgagagcgacccugaaggcgcgcucugguga

SEQ ID NO: 19525 - RNA, 9879 nt, Artificial Sequence
  derived and/or modified CDS sequence (opt5) from DENV-1__AF311956__SS-prME
agcgugaccaugcugcucaugcugcuucccaccgcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccgcccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggccgggccugggaggagggggugugcggcaucagaucugcuacacgccuggaaaauauuauguggaaacagaucagcaacgagcuuaaucauauccugcucgaaaacgacauuaaguucaccgucguggugggaaaugccaacggcauccuggcucaggggaaaaagaugauucggccgcaacccauggagcacaaauacuccuggaagucuuggggaaaggccaaaaucauuggcgccgacauccagaauaccacauuuaucauugaugggccugacacccccgaauguccugaugagcagagagcuuggaacaucugggaggucgaagacuauggauucggcauuuuuacgacaaauaucuggcugaaacuucgcgauagcuacacccagaugugcgaccaccggcucauguccgcggccauuaaagauagcaaggcuguucaugccgacaugggcuauuggaucgagucugagaagaacgagacauggaagcuggccagagcuuccuucaucgaagugaagaccuguauuuggcccaaaagccacacacuguggucuaauggggugcucgaguccgagaugaucauuccgaagauguacggaggcccuaucagccaacauaacuaucgccccggguacuucacccagacggccggaccuuggcaccugggcaaacuugaacuggauuuugaccucugcgaggggaccacagucgugguugaugaacacugcggaucucggggccccagccugagaaccacaaccgugacgggcaagauuauccaugagugguguugccgguccuguacacugccuccccuucgcuucagaggggaggacggaugcugguacggcauggaaauccggccggucaaagagaaggaagagaaucucgugagaagcaugguuucugcgggguccggagaaguggauagcuuuucccugggcauucugugugucucuaucaugauugaggaggugaugcgcagccggugguccagaaagaugcucaugaccgggacacuggcuguuuuccuucugcucaucaugggacagcugaccuggaacgaccugauucgccuuugcaucauggugggcgccaaugccucugacaaaaugggcauggggaccacauaucuggcucucauggccacguuuaagaugagaccuauguucgcggucggacugcucuuucggcgccugaccagcagagaagugcuucugcucacaauuggccugucccugguggcuucugucgagcuucccaacagccuggaagaacugggggauggacuggccaugggcaucaugaugcucaaacugcuuaccgaguuccaaccccaccagcuguggacaacccuccugucccugacguuuaucaagacaacccuuagccuggacuacgccuggaaaaccacagcuaugguucucucuauugugucccuguucccucucugucugagcaccacaucucagaagacgaccuggcuuccggugcugcugggguccuuuggaugcaagccccucacaauguuccugaucaccgagaacgagauuuggggccggaaaagcuggccucuuaaugaaggcaucauggccauugggaucgucucuauccugcucuccagccugcucaagaacgaugugccccuggcuggaccucuuauugccggcgggaugcugaucgcguguuauguuauuuccggaagcucugccgaccugagccucgagaaagcugccgaaguguccugggaggaagaggcugagcauucuggcacaagccacaauauccuggucgaagugcaggaugacgggaccaugaagauuaaagaugaggaacgcgacgauacgcuuaccauccugcucaaggccacacugcucgccguuuccggaguguaccccaugucuaucccugcuacccuguuugucugguauuucuggcagaagaagaagcagagaagcggcgugcuuugggacacacccuccccgccugaggucgagcgggcggugcuggaugacggcauuuaccgcauccugcagagagggcuccugggacggucucagguuggcgugggggucuuccaagauggaguguuucauaccauguggcacguuacacgcggcgccgugcuuauguaucaggggaaaagacuggaacccagcugggcuuccgucaagaaagaccucauuagcuacggaggcggcuggcgguuccaggggucuuggaacacgggagaggaagugcaagugaucgccguugagccuggcaagaaucccaaaaacguccaaaccacaccggggaccuuuaagaccccugaaggagaggugggcgccauugcucuggacuucaagcccgggacauccggaagcccuaucgugaauagagagggcaaaauugucggccucuacgggaacggagugguuacgaccucuggcacauauguguccgccaucgcgcaggcuaaggccagccaggaagggccccugcccgagaucgaagaugaggucuuuaaaaagcgcaaucuuaccauuauggaccugcacccuggauccggcaaaacacggagauaccugccggccaucgugcgcgaagcuauuaagcggaagcucagaacccugauccuugcccccacgcgcguuguggcgucugagauggcugaggcccugaaagggaugccuauucgguaucaaacaaccgccgucaagagcgaacauaccggcagagagaucguggaucucaugugccacgcuacauucaccaugcgccugcugucccccguucgggugccuaacuacaauaugaucauuauggacgaagcccauuuuacagaucccgcuagcaucgccgcgagaggauauauuucuacccgggucggcaugggggaggccgcugccaucuucaugacggcuacaccuccgggauccguggaagccuuuccccagagcaacgccgugauucaggacgaggagcgcgauaucccugaaagaucuuggaauagcggcuacgacuggaucaccgauuuccccgggaaaacagucugguuuguuccuuccauuaagucuggaaacgacaucgcuaauugucuccggaaaaacggcaagcgcgugauucagcuuagcagaaagaccuucgauacggaguaucagaaaaccaagaacaaugacugggacuacguggucacaaccgauaucuccgaaaugggggcgaacuuccgggccgacagagugauugauccccgccggugccugaaaccgguuauccugaaggacggcccugagagagugauucucgcuggacccaugcccgucacaguggccucugccgcucagcgccggggcagaaucgggcgcaaucagaacaaagagggagaucaguacguuuauaugggccaaccucugaauaacgacgaagaucacgcccauuggaccgaggcgaagaugcuucuggacaauaucaacacacccgaagggauuaucccugcucucuuugagccggaacgggaaaagagcgccgccauugauggagaguacagacugcgcggcgaagcuagaaaaaccuucguggagcugaugcggcgcggggaccuccccgucuggcuuuccuauaagguggccagcgaaggcuuucaguacucugauagacgguggugcuucgacggagagcgcaauaaccagguccuggaagagaauauggauguggagaucuggacgaaagaaggcgagagaaagaaacugcggccuagauggcucgacgcgcgcacauauuccgacccccuggcccuucgggaauuuaaggaguucgcugccgggagacgcagcguuuccggagaucugauucucgaaaucggcaaacugccucagcaccugacccuccgggcucaaaacgcccuugacaaucuggugaugcugcacaacucugagcaagggggaaaggcuuacagacaugccauggaggaacuccccgauaccaucgagacacugaugcuucuggcgcucauugccgugcugaccggcggcgucacacuguuuuuccucagcgggaagggacuuggcaaaacguccaucgggcugcuguguguuaccgcuucuagcgcccuccuguggauggcuuccguggaaccgcacuggauugccgccagcaucauucuugaguuuuuccugauggugcuccugaucccugagcccgaccggcagcgcacaccucaggauaaucaacuggcuuaugucgugaucggacuccuuuuuaugauucugaccguugcggccaacgaaaugggccugcucgagacaaccaagaaagaccuggggaucggacauguggcugccgaaaaccaccagcacgccacgauucuugaugucgaccugcaucccgcuucugccuggacccucuacgcgguggccacaaccgucaucacaccuaugaugagacacaccauugagaauacgacagcuaacaucucccugaccgccauugcuaaucaggccgcgauccugaugggccucgauaagggcuggcccaucagcaaaauggaccuuggggugccgcugcuggcccucggaugcuacucucaaguuaacccucugacacuuaccgcugccgugcugaugcucgucgcucauuaugccauuaucggccccgggcugcaggcuaaggccacccgggaagcgcagaagcgcacagccgcuggaauuaugaaaaaucccacgguggauggcaucguugccauugaccuggauccuguggucuacgacgcuaaguucgagaaacagcucgggcaaaucaugcuucugauccuguguaccucccagauucuccugaugagaacaaccugggcccuuugcgagagcaucacacuggccaccggaccgcucacgacacugugggaaggcucucccggcaaguuuuggaacaccaccauugcggugagcauggcuaauaucuuccggggguccuaucuggccggagcuggccucgccuucucucuuaugaaaagccucgggggaggccgcagagggacaggagcccagggcgagacccugggcgaaaaguggaagcggcagcucaaccaacuguccaaaagcgaguuuaauacauacaagcgcuccgggauuauggaaguggacagaucugaggcuaaagagggacuuaagcggggcgaaacgaccaaacacgccguuagcagagggacagcgaagcugcgcugguucgucgagcggaaccucgugaagccugaaggaaaagugaucgaucugggcugugggagaggaggcugguccuauuacugcgccggccugaagaaagucaccgagguuaagggguauacaaaaggaggccccgggcaugaggaaccuauccccauggcuaccuacggauggaaucucgugaaacuucacucuggcaaagacguguuuuucaugccuccggagaagugugauacgcugcugugcgacauuggggaaagcucccccaacccuaccaucgaggaaggacgcacacuccggguccugaagaugguggagcccuggcuuagaggcaaucaguuuuguauuaaaauccugaacccuuacaugcccucuguuguggagacccucgaacagaugcagcgcaagcacggcgggaugcugguccggaauccgcugagcagaaacuccacacaugagauguauugggugagcugcggaaccggcaauauuguuucugccgugaacaugacaucccgcaugcuccugaaccgguucaccauggcucacagaaaaccuacguacgaacgcgaugucgaccuuggggccggaacacggcauguggcgguggagcccgaagucgccaaucuggauaucauuggccaaagaaucgagaacaucaagaaugagcacaaaagcaccuggcacuaugacgaagauaaccccuacaagaccugggcuuaucaugggucuuacgagguuaagccuuccggaagcgccucuuccauggugaauggcgugguccgccuccugacaaaacccugggacgugauuccuaugguuacgcagaucgcuaugaccgauacaaccccguuuggccagcaaagaguguucaaggaaaaagucgacacacggacaccccgcgccaagagagggacagcucagauuauggaggugaccgccaaauggcuuuggggauuucugagccggaacaagaagccuagaaucuguacgcgggaagaguucacccgcaaaguuagauccaaugcggccauuggcgcuguguuugucgacgagaaccaguggaauagcgccaaggaagcuguggaggaugaacgguucugggaccucguucaccgcgagagagaacugcauaaacaggggaagugcgccacaugcguguauaacaugaugggaaaacgggagaagaagcugggcgaguuugggaaagccaagggcucucgcgcgaucugguacauguggcucggagcuagauuccuggaguucgaggcccuuggcuuuaugaaugaagaucacugguucagccgggagaacucccugucuggggucgagggagaaggccuccauaaacugggguacauccuucgcgacauuagcaagauccccggaggcaauauguaugccgaugacaccgcugggugggauacaagaauuaccgaggacgaucugcaaaacgaagccaaaaucacggacauuauggagccugaacacgcucuccuggccacauccaucuuuaagcugaccuaccagaauaaagugguccgggugcagcgccccgcgaagaacggcacaguuauggaugugaucucuagacgggaccagcgcggaagcggccaagucgggaccuauggacucaacacguucaccaauauggaggugcagcugauuagacagauggaguccgaaggcaucuuuuucccgucugagcuugaaagcccuaaccuggccgagcgggugcucgauuggcuggaaaagcacggggcugagagacuuaaacgcauggccauuuccggagacgacuguguugugaagcccaucgaugaccgguuugcuacagcccugauugcgcucaaugauaugggcaaagucagaaaggacaucccucagugggagcccagcaaaggguggaacgauuggcaacaggugccuuucugcucucaucacuuucaucagcugaucaugaaggacggccgcgaaauuguugugcccugucggaaucaggaugagcuggucggcagagcucgcgugucccaaggagcuggguggagccuccgggaaaccgccugccugggaaagucuuacgcucagauguggcagcuuauguauuuccacagacgcgaccugcggcucgccgcuaacgccaucuguuccgcggucccgguggauuggguuccuacaagcagaaccacaugguccauucacgcccaucaccaauggaugaccacggaggacaugcugucuguguggaaucgcgucuggaucgaagagaaccccuggauggaggauaaaacacaugugagcuccugggaagagguucccuaccuuggcaagcgggaagaccaguggugcgggagccugauuggacucaccgcuagagccaccugggccacaaauauccagguggcuauuaaccagguccggagacugaucggcaaugagaacuaucuggacuacaugaccucuaugaaacgcuuuaagaaugaguccgauccugaaggggcccucugguga

SEQ ID NO: 19526 - RNA, 9879 nt, Artificial Sequence
  derived and/or modified CDS sequence (opt5) from DENV-1__AF311958__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcacccucacacuggacuguagccccagaaccggccuugauuucaacgaaauggugcugcucacgaugaaagagaagucuuggcugguccauaaacagugguuucuugaccugccucuccccuggacauccggggccagcaccucccaagagacauggaaucggcaggaucugcuggugaccuucaagaccgcucacgcgaagaaacaggaagucgugguucucggaucucaagagggcgccaugcacacagcucugacgggggccaccgaaauucagacaagcggaaccacaaccaucuuugccggccaucuuaagugccgccugaaaauggacaagcucacgcugaaagggacauccuaugugauguguaccggcagcuucaagcuggagaaggaagucgcugagacccagcacggaacagugcuuguucaggugaaauacgagggcaccgaugccccgugcaagauuccuuucucuacacaagacgaaaaaggggucacgcagaacggaagacucaucaccgcgaaucccaucgugacagauaaggagaaaccugugaacauugaaaccgagccccccuuuggcgaguccuauaucguugucggggcuggagaaaaggcccugaagcugagcugguucaaaaagggcucuagcauugggaaaauguuugaggccacagcucggggcgccagacgcauggcuauccucggagacaccgccugggauuucggcuccauugggggaguguuuacgucugugggcaagcugguccaucagguguucgggaccgcguacggaguucuuuuuagcggcguguccuggacaaugaaaaucgggaucggcauucugcucaccuggcugggacugaauagccggucuacaucccuuagcaugaccuguaucgccgucggcauggugacacucuaccuggggguuauggugcaggcugacucuggaugcgucauuaacuggaagggcagagaacugaaguguggguccggaaucuucgugaccaacgagguucacacguggacagaacaauauaaauuucaggccgauagcccuaagcgccucuccgcugccauuggccgggcgugggaggagggggugugcggcaucagaucugccacccgccuggaaaauauuauguggaaacagaucagcaacgagcuuaaucauauccugcucgaaaacgacauuaaguucaccgucguggugggaaaugcuaacggcauccuggcccaggggaaaaagaugauucggccgcaacccauggagcacaaauacuccuggaagucuuggggaaaggcuaaaaucauuggcgccgacauccagaauacaaccuuuaucauugaugggccugacacgcccgaauguccugaugagcagagagccuggaacaucugggaggucgaagacuauggauucggcauuuuuacaaccaauaucuggcugaagcuucgcgauagcuacacacagaugugcgaccaccggcucauguccgcugcgauuaaagauagcaaggccguucaugcugacaugggcuauuggaucgagucugaaaaaaacgagaccuggaagcuggccagagccuccuucaucgaagugaagacauguauuuggcccaaaagccacacccuguggucuaauggggugcucgaguccgagaugaucauuccgaagauguacggaggcccuaucagccaacauaacuaucgccccggguacuucacgcagaccgcuggaccuuggcaccugggcaaacuugaacuggauuuugaccucugcgaggggacaaccgucgugguugaugaacacugcggaucucggggccccagccugagaacaaccacggugacaggcaagauuauccaugagugguguugccgguccuguacccugccuccccuucgcuucagaggggaggacggaugcugguacggcauggaaauccggccggucaaagagaaggaagagaaucucgugagaagcaugguuucugccggguccggagaaguggauagcuuuucccugggcauucugugugucucuaucaugauugaggaggugaugcgcagccggugguccagaaagaugcucaugacagggacccuggcgguuuuccuucugcucaucaugggacagcugaccuggaacgaccugauucgccuuugcaucauggugggcgcuaaugccucugacaaaaugggcauggggacaacguaucuggcccucauggcuaccuuuaagaugagaccuauguucgccgucggacugcucuuucggcgccugacaagcagagaagugcuucugcucaccauuggccugucccugguggcgucugucgagcuucccaacagccuggaagagcucggggauggacuggcuaugggcaucaugaugcucaaacugcuuacagaauuccaaccccaccagcuguggaccacgcuccugucccugacauuuaucaagaccacccuuagccuggacuacgccuggaaaacaaccgccaugguucucucuauugugucccuguucccucucugucugagcacaacgucucagaagaccacauggcuuccggugcugcugggguccuuuggaugcaagccccucaccauguuccugaucacagaguaugagauuuggggccggaaaagcuggccucuuaacgaaggcaucauggcuauugggaucgucucuauccugcucuccagccugcucaagaaugaugugccccuggccggaccucuuauugcuggcgggaugcugaucgccuguuacguuauuuccggaagcucugcggaccugagccucgagaaagccgcugaaguguccugggaggaagaggccgagcauucuggcaccagccacaacauccuggucgaagugcaggaugacgggacgaugaagauuaaagaugaggaacgcgacgauacccuuacaauccugcucaaggcuacccugcucgccguuuccggaguguaucccaugucuaucccugccacacuguuugucugguacuucuggcaaaaaaagaagcagagaagcggcgugcuuugggacacccccuccccgccugaggucgagcgggcugugcuggaugacggcauuuaucgcauccugcagagagggcuccugggacggucucagguuggcgugggggucuuccaagauggaguguuucauacaauguggcacguuacgcgcggcgcggugcuuauguaccaggggaaaagacuggaacccagcugggccuccgucaagaaagaccucauuagcuacggaggcggcuggcgguuccaggggucuuggaauaccggagaggaagugcaggugaucgcuguugagccuggcaagaaccccaaaaauguccaaacaaccccggggaccuuuaagacaccugaaggagaggugggcgccauugcccuggacuucaagcccgggacguccggaagcccuaucgugaacagagagggcaaaauugucggccucuaugggaauggagugguuaccacaucuggcaccuacguguccgcuaucgcccaggcgaaggcuagccaggaagagccccugcccgaaaucgaggaugaagucuuuaaaaagcgcaaccuuacaauuauggaccugcacccuggguccggaaaaacccggagauaucugccggccaucgugcgcgaggccauuaagcggaagcucagaacgcugauccuugcucccacacgcguuguggccucugagauggcggaagcucugaaaggcaugccuauucgguaccaaaccaccgccgucaagagcgagcauacagggagagaaaucguggaucucaugugccacgccaccuucacaaugcgccugcugucccccguucgggugccuaauuauaacaugaucauuauggacgaggcucauuuuaccgaucccgccagcaucgcugccagaggcuacauuucuacgcgggucggaaugggcgaagcggccgcuaucuucaugacagccaccccuccgggguccguggaggcuuuuccccagagcaaugccgugauucaggacgaggaacgcgauaucccugagagaucuuggaacagcggauaugacuggaucacagauuuccccggcaaaaccgucugguuuguuccuuccauuaagucugggaaugacaucgccaacugucuccggaaaaauggaaagcgcgugauucagcuuagcagaaagacguucgauaccgaauaccaaaaaacaaagaacaacgacugggacuacguggucaccacagauaucuccgagaugggcgcuaauuuccgggcggacagagugauugauccccgccggugccugaaaccgguuauccugaaggacgggccugagagagugauucucgccggccccaugcccgucaccguggcuucugccgcccagcgccggggaagaaucggccgcaaccagaauaaagaaggggaucaguauguuuacaugggacaaccucugaacaaugacgaggaucacgcucauuggacagaagccaagaugcuucuggacaacaucaauacccccgagggcauuaucccugcgcucuuugaaccggagcgggagaagagcgcugccauugauggggaauauagacugcgcggagaggccagaaaaacguucguggaacugaugcggcgcggcgaccuccccgucuggcuuuccuacaagguggcuagcgagggguuucaguauucugauagacgguggugcuucgacggcgaacgcaacaaucagguccuggaggagaacauggauguggaaaucuggacaaaagagggagaaagaaagaaacugcggccuagauggcucgacgcccgcaccuacuccgacccccuggcgcuucgggaguuuaaggaauucgccgcuggcagacgcagcguuuccggggaucugauucucgagaucggaaaacugccucagcaccugacccuccgggcccaaaaugcucuugacaaccuggugaugcugcacaauucugagcagggcgggaaggccuauagacaugcuauggaagagcuccccgauacaaucgaaacccugaugcuucuggcccucauugcggugcugacaggaggcgucacgcuguuuuuccucagcggcaaggggcuuggaaaaaccuccaucggccugcuguguguuacagccucuagcgcucuccuguggauggccuccguggagccgcacuggauugcugccagcaucauucuugaguuuuuccugauggugcuccugaucccugaacccgaccggcagcgcaccccucaggauaaccaacuggccuacgucgugaucgggcuccuuuuuaugauucugacaguugcugcgaaugagaugggacugcucgaaaccacgaagaaagaccugggcaucgggcauguggccgcugagaaccaccagcacgccaccaugcuugaugucgaccugcaucccgccucugcuuggacacucuacgccguggcgaccacagucauuaccccuaugaugagacacacgaucgaaaacacaaccgccaauauuucccugacagcuaucgccaaccaggcugccauucugaugggacucgauaagggcuggcccaucagcaaaauggaccuuggcgugccgcugcuggcgcucgggugcuauucucaaguuaauccucugacccuuaccgccgcugugcugaugcucgucgcccauuacgcuaucauuggacccggccugcaggccaaggcuacacgggaggcccagaagcgcacggcggccgggaucaugaaaaaccccaccguggauggaauuguugcuaucgaccuggauccuguggucuaugacgccaaguucgagaaacagcucggccaaauuaugcuucugauccuguguacaucccagauccuccugaugagaaccacaugggcucuuugcgaaagcauuacccuggccacggggccgcucacaacccugugggagggaucucccggcaaguuuuggaauaccacaaucgccgugagcauggcgaacauuuuccggggcuccuaccuggcuggggccggacucgcuuucucucuuaugaaaagccugggcgggggacgcagaggcaccggggcccagggagaaacacugggcgagaaguggaagcggcagcucaaucaacuguccaaaagcgaauuuaacacguauaagcgcuccggcaucauggagguggacagaucugaggccaaagaagggcuuaagcggggagagaccacaaaacacgcuguuagcagaggcgccgcgaagcugcgcugguucgucgaacggaaucucgugaagccugaggggaaagugauugaucugggauguggcagagggggaugguccuacuauugcgccggccugaagaaagucaccgaaguuaagggcuacacaaaagggggacccggccaugaggagccuauccccauggcuaccuacggguggaaccucgugaagcuucacucuggaaaagacguguuuuucaugccuccggaaaagugugauacgcugcugugcgacaucggcgagagcucccccaauccuaccauugaagaggggcgcacacuccggguccugaagaugguggagcccuggcuuagaggaaaccaguuuuguaucaaaauucugaauccuuauaugcccucuguuguggaaacccucgagcagaugcagcgcaagcacggcggcaugcugguccggaacccgcugagcagaaauuccacacaugaaauguacugggugagcugcgggaccggaaacaucguuucugccgugaauaugacaucccgcaugcuccugaaccgguucaccauggcucacagaaaaccuacguaugagcgcgaugucgaccuuggcgccgggacacggcauguggcgguggaacccgaggucgccaaccuggauauuaucggacaaagaauugagaauaucaagaacgaacacaaaagcaccuggcacuacgacgaggauaaucccuauaagaccugggcuuaccauggcucuuaugaaguuaagccuuccgggagcgccucuuccauggugaacggagugguccgccuccugacaaaacccugggacgugaucccuaugguuacgcagauugcuaugaccgauacaaccccguuuggccagcaaagaguguucaaggagaaagucgacacacggaccccccgcgccaagagaggcacagcucagaucauggaagugaccgccaaauggcuuuggggguuucugagccggaauaagaagccuagaauuuguacgcgggaggaguucacccgcaaaguuagauccaacgcggccaucggagcuguguuugucgacgaaaaucaguggaacagcgccaaggaggcuguggaagaugagcgguucugggaccucguucaccgcgaaagagagcugcauaaacagggcaagugcgccacaugcguguacaauaugauggggaaacgggagaagaagcugggagaauuuggcaaagccaaggggucucgcgcgauuugguacauguggcucggcgcuagauuccuggaguucgaagcccuuggauuuaugaacgaggaucacugguucagccgggagaauucccugucuggcgucgaaggggagggacuccauaaacugggcuauauccuucgcgacaucagcaagauucccgggggaaacauguacgccgaugacaccgcuggcugggauacaagaaucaccgaagacgaucugcaaaaugaggccaaaauuacggacaucauggaaccugagcacgcucuccuggccacauccauuuuuaagcugaccuaucagaacaaagugguccgggugcagcgccccgcgaagaaugggacaguuauggaugugaucucuagacgggaccagcgcggcagcggacaagucggcaccuacgggcucaacacguucaccaacauggaggugcagcugaucagacagauggaauccgagggaauuuuuuucccgucugaacuugagagcccuaaucuggccgaacgggugcucgauuggcuggagaagcacggcgcugagagacuuaaacgcauggccaucuccggggacgacuguguugugaagcccauugaugaccgguuugcuacagcccugaucgcgcucaacgauaugggaaaagucagaaaggacauuccucagugggaacccagcaaaggcuggaaugauuggcaacaggugccuuucugcucucaucacuuucaucagcugaucaugaaggacgggcgcgagaucguugugcccugucggaaccaggaugaacuggucggcagagcccgcgugucccaaggagcuggcuggagccuccgggagaccgccugccuggggaagucuuaugcucagauguggcagcuuauguacuuccacagacgcgaccugcggcucgccgcuaaugccauuuguuccgcggucccgguggauuggguuccuacaagcagaaccacaugguccauccacgcccaucaccaauggaugaccacggaagacaugcugucuguguggaaccgcgucuggauugaggagaaucccuggauggaagauaaaacacaugugagcuccugggaggaaguucccuaucuuggaaagcgggaggaccaguggugcggcagccugaucgggcucaccgcuagagccaccugggccacaaacauucagguggcuaucaaucagguccggagacugauuggaaacgagaauuaccuggacuacaugaccucuaugaaacgcuuuaagaacgaauccgauccugagggcgcccucugguga

SEQ ID NO: 19527 - RNA, 9879 nt, Artificial Sequence
  derived and/or modified CDS sequence (opt5) from DENV-1__AF311957__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagagcaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggacguccuaugugauguguacaggcagcuucaagcuggagaaggaagucgccgagacccagcacggaaccgugcuuguucaggugaaauacgagggcacagaugcgccgugcaagauuccuuucucuacccaagacgaaaaaggggucacacagaacggaagacucaucacggcuaaucccaucgugaccgauaaggagaaaccugugaacauugaaacagagccccccuuuggcgaguccuauaucguugucggggccggagaaaaggcccugaagcugagcugguucaaaaagggcucuagcauugggaaaauguuugaggcuaccgcccggggcgcuagacgcauggccauccucggagacacagcgugggauuucggcuccauugggggaguguuuaccucugugggcaagcugguccaucagguguucgggacggccuacggaguucuuuuuagcggcguguccuggaccaugaaaaucgggaucggcauucugcucacauggcugggacugaauagccggucuaccucccuuagcaugacauguaucgcugucggcauggugacccucuaccuggggguuauggugcaggccgacucuggaugcgucauuaacuggaagggcagagaacugaaguguggguccggaaucuucgugacaaacgagguucacaccuggacggaacaauauaaauuucaggcugauagcccuaagcgccucuccgccgcgauuggccgggccugggaggagggggugugcggcaucagaucugcuacacgccuggaaaauauuauguggaaacagaucagcaacgagcuuaaucauauccugcucgaaaacgacauuaaguucaccgucguggugggaaaugccaacggcauccuggcucaggggaaaaagaugauucggccgcaacccauggagcacaaauacuccuggaagucuuggggaaaggccaaaaucauuggcgccgacauccagaauaccacauuuaucauugaugggccugacacccccgaauguccugaugagcagagagcuuggaacaucugggaggucgaagacuauggauucggcauuuuuacgacaaauaucuggcugaagcuucgcgauagcuacacccagaugugcgaccaccggcucauguccgcggccauuaaagauagcaaggcuguucaugccgacaugggcuauuggaucgagucugaaaaaaacgagacauggaagcuggccagagcuuccuucaucgaagugaagaccuguauuuggcccaaaagccacacacuguggucuaauggggugcucgaguccgagaugaucauuccgaagauguacggaggcccuaucagccaacauaacuaucgccccggguacuucacccagacggccggaccuuggcaccugggcaaacuugaacuggauuuugaccucugcgaggggaccacagucgugguugaugaacacugcggaucucggggccccagccugagaaccacaaccgugacgggcaagauuauccaugagugguguugccgguccuguacacugccuccccuucgcuucagaggggaggacggaugcugguacggcauggaaauccggccggucaaagagaaggaagagaaucucgugagaagcaugguuucugcgggguccggagaaguggauagcuuuucccugggcauucugugugucucuaucaugauugaggaggugaugcgcagccggugguccagaaagaugcucaugaccgggacacuggcuguuuuccuucugcucaucaugggacagcugaccuggaacgaccugauucgccuuugcaucauggugggcgccaaugccucugacaaaaugggcauggggaccacauaucuggcucucauggccacguuuaagaugagaccuauguucgcggucggacugcucuuucggcgccugaccagcagagaagugcuucugcucacaauuggccugucccugguggcuucugucgagcuucccaacagccuggaagagcucggggauggacuggccaugggcaucaugaugcucaaacugcuuaccgaauuccaaccccaccagcuguggacaacccuccugucccugacguuuaucaagacaacccuuagccuggacuacgccuggaaaaccacagcuaccguucucucuauugugucccuguucccucucugucugagcacaacgucucagaagaccacauggcuuccggugcugcugggguccuuuggaugcaagccccucaccauguuccugaucacagagaacgagauuuggggccggaaaagcuggccucuuaaugaaggcaucauggccauugggaucgucucuauccugcucuccagccugcucaagaacgaugugccccuggcuggaccucuuauugccggcgggaugcugaucgcguguuauguuauuuccggaagcucugccgaccugagccucgagaaagcugccgaaguguccugggaggaagaggcugagcauucuggcaccagccacaauauccuggucgaagugcaggaugacgggacgaugaagauuaaagaugaggaacgcgacgauacccuuacaauccugcucaaggccacccugcucgccguuuccggaguguaccccaugucuaucccugcuacacuguuugucugguauuucuggcaaaaaaagaagcagagaagcggcgugcuuugggacacccccuccccgccugaggucgagcgggcggugcuggaugacggcauuuaccgcauccugcagagagggcuccugggacggucucagguuggcgugggggucuuccaagauggaguguuucauacaauguggcacguuacgcgcggcgccgugcuuauguaucaggggaaaagacuggaacccagcugggcuuccgucaagaaagaccucauuagcuacggaggcggcuggcgguuccaggggucuuggaacaccggagaggaagugcaggugaucgccguugagccuggcaagaaucccaaaaacguccaaacaaccccggggaccuuuaagacaccugaaggagaggugggcgccauugcucuggacuucaagcccgggacguccggaagcccuaucgugaauagagagggcaaaauugucggccucuacgggaacggagugguuaccacaucuggcaccuauguguccgccaucgcgcaggcuaaggccagccaggaagggccccugcccgagaucgaagaugaggucuuuaaaaagcgcaaucuuacaauuauggaccugcacccuggauccggcaaaacccggagauaccugccggccaucgugcgcgaagcuauuaagcggaagcucagaacgcugauccuugcccccacacgcguuguggcgucugagauggcugaggcccugaaagggaugccuauucgguaucaaaccaccgccgucaagagcgaacauacaggcagagagaucguggaucucaugugccacgcuaccuucacaaugcgccugcugucccccguucgggugccuaacuacaauaugaucauuauggacgaagcccauuuuaccgaucccgcuagcaucgccgcgagaggauauauuucuacgcgggucggcaugggggaggccgcugccaucuucaugacagcuaccccuccgggauccguggaagccuuuccccagagcaacgccgugauucaggacgaggagcgcgauaucccugaaagaucuuggaauagcggcuacgacuggaucacagauuuccccgggaaaaccgucugguuuguuccuuccauuaagucuggaaacgacaucgcuaauugucuccggaaaaacggcaagcgcgugauucagcuuagcagaaagacguucgauaccgaguaucaaaaaacaaagaacaaugacugggacuacguggucaccacagauaucuccgaaaugggggcgaacuuccgggccgacagagugauugauccccgccggugccugaaaccgguuauccugaaggacggcccugagagagugauucucgcuggacccaugcccgucaccguggccucugccgcucagcgccggggcagaaucgggcgcaaucagaacaaagagggagaucaguacguuuauaugggccaaccucugaauaacgacgaagaucacgcccauuggacagaggcgaagaugcuucuggacaauaucaacacccccgaagggauuaucccugcucucuuugagccggaacgggagaagagcgccgccauugauggagaguacagacugcgcggcgaagcuagaaaaacguucguggagcugaugcggcgcggggaccuccccgucuggcuuuccuauaagguggccagcgaaggcuuucaguacucugauagacgguggugcuucgacggagagcgcaauaaccagguccuggaagagaauauggauguggagaucuggacaaaagaaggcgagagaaagaaacugcggccuagauggcucgacgcgcgcaccuauuccgacccccuggcccuucgggaauuuaaggaguucgcugccgggagacgcagcguuuccucugaucugauucucgaaaucggaaaacugccucagcaccugacccuccgggcucaaaacgcccuugacaaucuggugaugcugcacaacagcgagcagggcgggaaggcuuacagacaugccauggaggaacuccccgauacaaucgagacccugaugcuucuggcgcucauugccgugcugacaggaggcgucacgcuguuuuuccucuccggcaaggggcuuggaaaaaccucuaucggccugcuguguguuacagcuagcuccgcccuccuguggauggcuagcguggaaccgcacuggauugccgccucuaucauucuugaguuuuuccugauggugcuccugaucccugagcccgaccggcagcgcaccccucaggauaaucaacuggcuuaugucgugaucgggcuccuuuuuaugauucugacaguugcggccaacgaaaugggacugcucgagaccacgaagaaagaccugggcaucgggcauguggcugccgaaaaccaccagcacgccaccaugcuugaugucgaccugcaucccgcuuccgccuggacacucuacgcgguggccaccacagucauuaccccuaugaugagacacacgaucgagaauacaaccgcuaacauuagccugacagccaucgcuaaucaggccgcgauucugaugggacucgauaagggcuggcccaucucuaaaauggaccuuggcgugccgcugcuggcccucgggugcuacucccaaguuaacccucugacccuuaccgcugccgugcugaugcucgucgcucauuaugccaucauuggacccggccugcaggcuaaggccacacgggaagcgcagaagcgcacggccgcugggaucaugaaaaaucccaccguggauggaauuguugccaucgaccuggauccuguggucuacgacgcuaaguucgagaaacagcucggccaaauuaugcuucugauccuguguacaagccagauccuccugaugagaaccacaugggcccuuugcgagucuauuacccuggccacggggccgcucacaacccugugggaaggaagccccggcaaguuuuggaacaccacaaucgcgguguccauggcuaauauuuuccggggcucuuaucuggccggggcuggacucgccuucagccuuaugaaaucccugggcgggggacgcagaggcaccggggcccagggagagacacugggcgaaaaguggaagcggcagcucaaccaacugagcaaauccgaguuuaauacguacaagcgcucuggcaucauggaaguggacagaagcgaggcuaaagaggggcuuaagcggggagaaaccacaaaacacgccguuuccagaggcaccgcgaagcugcgcugguucgucgagcggaaccucgugaagccugaagggaaagugauugaucugggauguggcagagggggauggucuuauuacugcgccggccugaagaaagucacagagguuaagggcuauaccaaagggggacccggccaugaagagccuauccccauggcuacguacggguggaaucucgugaagcuucacagcggaaaagacguguuuuucaucccuccggagaagugugauacccugcugugcgacauuggcgaauccucucccaacccuacaaucgaggaagggcgcacccuccggguccugaagaugguggagcccuggcuuagaggaaaucaguuuuguauuaaaauccugaacccuuacaugcccagcguuguggagacacucgaacagaugcagcgcaagcacggcggcaugcugguccggaauccgcuguccagaaacagcacccaugagauguauugggugucuugcgggacaggaaauauuguuuccgccgugaacaugaccagccgcaugcuccugaaccgguucacgauggcucacagaaaaccuacauacgaacgcgaugucgaccuuggcgccgggacccggcauguggcgguggagcccgaagucgccaaucuggauaucauuggacaaagaaucgagaacaucaagaaugagcacaaaucuaccuggcacuaugacgaagauaaccccuacaagacaugggcuuaucauggcuccuacgagguuaagccuagcgggucugccuccagcauggugaauggagugguccgccuccugacgaaacccugggacgugauuccuaugguuacccagaucgcuaugacagauaccacaccguuuggccagcaaagaguguucaaggaaaaagucgacacccggacaccccgcgccaagagaggcaccgcucagauuauggaggugacggccaaauggcuuuggggguuucugucccggaacaagaagccuagaaucuguacccgggaagaguucacacgcaaaguuagaagcaaugcggccauuggagcuguguuugucgacgagaaccaguggaauucugccaaggaagcuguggaggaugaacgguucugggaccucguucaccgcgagagagaacugcauaaacagggcaagugcgccaccugcguguauaacaugauggggaaacgggagaagaagcugggagaguuuggcaaagccaaggggagccgcgcgaucugguacauguggcucggcgcuagauuccuggaauucgaggcccuuggauuuaugaaugaagaucacugguucucccgggagaacucucugagcggcgucgagggggaaggacuccauaaacugggcuacauccuucgcgacauuuccaagauccccgggggaaauauguaugccgaugacacagcuggcugggauaccagaauuacggaggacgaucugcaaaacgaagccaaaaucacagacauuauggagccugaacacgcucuccuggccaccucuaucuuuaagcugacauaccagaauaaagugguccgggugcagcgccccgcgaagaacgggaccguuauggaugugaucagcagacgggaccagcgcggcuccggacaagucggcacguaugggcucaacaccuucacaaauauggaggugcagcugauuagacagauggagucugaaggaaucuuuuucccgagcgagcuugaauccccuaaccuggccgagcgggugcucgauuggcuggaaaagcacggcgcugagagacuuaaacgcauggccauuagcggggacgacuguguugugaagcccaucgaugaccgguuugcuaccgcccugauugcgcucaaugauaugggaaaagucagaaaggacaucccucagugggagcccucuaaaggcuggaacgauuggcaacaggugccuuucugcucccaucacuuucaucagcugaucaugaaggacgggcgcgaaauuguugugcccugucggaaucaggaugagcuggucggcagagcccgcgugagccaaggagcuggcuggucucuccgggaaacagccugccuggggaaguccuacgcucagauguggcagcuuauguauuuccacagacgcgaccugcggcucgccgcuaacgccaucuguagcgcggucccgguggauuggguuccuaccuccagaacaaccuggucuauucacgcccaucaccaauggaugacgacagaggacaugcugagcguguggaaucgcgucuggaucgaagagaaccccuggauggaggauaaaacccauguguccagcugggaagagguucccuaccuuggaaagcgggaagaccaguggugcggcucucugauugggcucaccgcuagagccacaugggccaccaauauccagguggcuauuaaccagguccggagacugaucggaaaugagaacuaucuggacuacaugacauccaugaaacgcuuuaagaaugagagcgauccugaaggcgcccucugguga

SEQ ID NO: 19528 - RNA, 9879 nt, Artificial Sequence
  derived and/or modified CDS sequence (opt5) from DENV-1__EU280167__SS-prME
agcgugaccaugcugcucacacugaugcccacggcccuugcuuuccaccugaccacaagaggaggggagccucauaugaucgucuccaagcaggaacggggaaaaucucuccuguuuaagaccuccgccggcguuaauaugugcacacuuauugcgauggaccugggggagcucugugaagauaccgugacauacaaaugcccgcgcaucaccgaggcugaacccgacgauguggacuguuggugcaaugccacggauaccugggucacauauggaaccuguucccaaacaggcgagcacagacgggacauucgcucuguggcccuggcuccucauguugggcugggacucgagaccagaacggaaacauggaugagcuccgagggcgccuggaagcagauccagcggguggauaccugcguccugcgccaccccggcuucacagugauugcucuuuuucuggcccaugcgaucgggaccucuaucagccagaaaggaauuaucuucauucuccugaugcuuguuaccccuuccaugacaaugagaugugugggcaucgggagccgggacuuugucgaaggacugucuggcgccacguggguggaugugguccucgagcacggguccugcguuaccagcauggcuaaggacaagcccacacuggauauugagcugcucaaaaccgaagugccuaacccggccgugcugcgcaaacuuuguaucgaggcuaaaauuucuaauacaaccacggacuccagaugccccacacaaggagaagccacccuggucgaggaacaggaugcgaacuucgugugucggcgcaccuuuguugacagaggcuggggcaaugggugcggacucuucggcaaggggagccugcuuacaugcgacaaauuuaagugugugaccaagcuggagggaaaaaucauccaguacgagaacuucaaguauucugucauugugacaguucacacgggcgaucagcaucaaguggggaaugaauccaccgagcacggaacaaccgccacaaucaccccucaggcucccacgaccgaaauucagcucacagacuacggcgcccugacccuggauugcagcccucggacaggccucgacuuuaacgagaugguccugcuuaccaugaaagaaaaguccuggcuggugcauaaacagugguuccucgaucugccccuuccguggacgucuggggcuagcacaucccgcgagaccuggaauagacaagaccugcucgucacauuuaagaccgcccacgccaaaaagcaggaggugguugugcugggaagccaggaaggcgcuaugcacaccgcgcugacaggggccacggagauccaaaccucuggaacaaccacaauuuucgcuggccaucucaagugucggcugaaaauggauaaacuuacccugaaagggauguccuaugucaugugcacgggcagcuucaagcucgaaaaagagguggccgaaacacagcacggaaccguucuggugcagaucaaguacgagggcaccgacgccccuuguaagauccccuuuucuacacaggaugagaaaggggucacccaaaacggaagacugauuacagcuaauccuaucgugacggacaaggaaaaacccgugaacauugaggccgaacccccuuucggcgagagcuauaucguuauuggggucggagagaaggcgcuuaaacucuccugguuuaagaagggcucuagcaucgggaaaauguucgaagcuaccgcccgcggcgcccggagaauggcuauccugggagauacagccugggacuuuggcuccauugggggaguguucaccagcgugggcaagcugguccaucagaucuuugggacagcuuacggagugcuguucucuggcguuuccuggaccaugaaaauugggaucggcgugcugcuuacguggcugggacucaauagccgcucuaccucccugagcaugacaugcauugccgucggccuggugacccuuuaccucgggguuauggugcaggcggacuccggaugugucaucaacuggaagggccgggggcugaaaugcggaucuggcauuuuugugacaaaugagguucacaccuggacagggcaguauaaguuccaagccgauagcccgaagggccuguccgcugccaucggaaaggcuugggaagagggcgugugugggaucagaucugccacccgccucgaaaacauuauguggaagcagaucagcaacgagcugaaucauauucuucuggagaacgacaugaaauuuacggucguggugggagaugucgcgggcauccucgcccaggggaagaaaaugauucggccccagccuauggaacacaaguacuccuggaaaaauuggggaaaggcuaagaucaucggcgccgacguucaaaacagcacauucauuaucgauggccccaauaccccugagugcucugacgaucagagagcuuggaacauuugggaaguggaggacuauggguuuggaaucuucaccacaaauauuuggcugaaacugcgcgauuccuacacccaggugugugaccaccggcuuaugagcgccgccaucaaggauucuaaagcuguccaugcggacaugggcuauuggaucgaauccgagaagaacgagacguggaaacucgccagagcuagcuucauugaagugaagacaugcaucuggcccaagucucacacccuguggagcaaugggguucuggaguccgaaaugauuaucccgaaaauuuacggaggcccuaucagccagcauaacuaucgccccggguacuuuacacaaaccgccggaccuuggcaccucggcaagcuggagcuugauuucgaccugugcgaaggcacaaccguggucguggacgagcacugugggaaucggggacccucucucggcacgaccacaguuaccgggaaaaucauucaugaguggugcuguagauccugcacacugccuccccugcgguuucgcggagaagauggcuguugguacgggauggagaucagaccggugaaggaaaaagaggagaaccuugucaagagcaugguguccgccggaucuggcgaaguugacagcuucucccucggccugcugugcauuucuaucaugauugaggaagugaugcggagcagauggucccgcaagaugcucaugaccgggacgcuggcugucuuuuuccuucugaucaugggacagcucacauggaaugaucugauucggcuguguaucauggugggcgccaacgcgucugacagaauggggaugggaaccacauaucuugcucugauggccaccuuuaaaaugcgcccuauguucgccgugggccuccuguuuagacggcucaccagccgcgagguccugcuucugacaaucgggcucucccugguugcuagcguggaacugcccaauucucuugaggagcugggagauggccucgccaugggcauuaugauccugaagcuccugacggacuucagaucccaccagcuuugggcgacccugcucagcaugacauuuauuaaaaccgcuuucucucugcauuacgccuggaagacaauggccauggugcuguccaucgucagccuuuuuccccugugccucuauaccacgucucagaagacaaccuggcugccugugcuccuggggucccuuggauguaagccgcugaccauguuccugauugcugaaaacaagaucuggggccggaaaagcuggccccucaacgaggggaucauggccguuggaauuguguccauccugcuuagcucucugcucaagaaugaugucccucuggcuggcccccucauugccgggggaaugcugaucgcgugcuacgugauuagcggcuccucugccgaccuuagccuggaaaaagcugccgagguuuccugggaagaggaggcugaacacucuggcgccagccauaacauccugguggagguccaggaugacgggacaaugaagaucaaagaugaagaaagagacgauacccucacaauucugcuuaaggccacgcugcucgcuguguccggagucuauccucugucuauccccgcgacccucuucgugugguguuuuuggcagaaaaagaagcagagaagcggcguucugugggacacaccuucucccccgaaaguggaacgggccguccuugacgaugggauuuaccgcaucaugcaaagaggacugcugggccggagccagguggggguuggaguguuccaggagaaugucuuucacaccauguggcacgugacacgcggcgcugugcucauguaucagggcaagagacuggagccuagcugggccuccguuaaaaaggaccuuauuagcuacgggggaggcuggcggcugcaagggucuuggaacaccggagaagagguccaggugaucgccguggaacccggcaaaaauccuaagaacguccagacggcucccgggaccuucaagacaccggagggagaggugggcgccauugcgcucgauuuuaaaccuggcaccuccgggagccccaucguuaauagagaaggaaagaucgugggccuguacgggaacggagucgugacaaccuccggcacauauguuucugcuauugcccaggccaaagcuagccaagaggggccucuccccgaaaucgaggacgaaguguuccgcaagcggaaucugacgauuauggaucuucaucccggcuccggaaaaaccagacgcuaccugccugccaucguccgggaggcgauuaagagaaagaugcgcacacugauccucgcuccgacccgggugguugccagcgagauggccgaagcucugaaaggcaugcccaucagauaucagaccacagccgugaagucugagcacacggggaaagaaauugucgaccuuaugugccaugcuaccuuuacaaugcgccugcucuccccugugcgggugcccaacuacaauaugaucauuauggaugaggcccacuucaccgacccuagcucuaucgcggccagaggauauauuagcacacgggucggcaugggggaagcugccgcuaucuuuaugaccgccacgcccccuggauccguugaggccuucccgcagucuaacgcugugauccaagaugaggaacgcgacauucccgagagaagcuggaacuccggcuacgaauggaucacagauuuuccugggaagaccgugugguucguccccucuauuaaagcgggcaacgacaucaccaauugccugcggaagaacggaaagcgcgugauucagcugagcagaaaaacauucgacaccgaguaucagaagaccaagaauaaugauugggacuacguugugaccacggauaucuccgaaaugggcgccaacuuucgggcugacagagucauggauccucgccggugucucaagcccgugauucuuaaagacgggccggagagaguuauccuggccggaccuaugcccgugacagucgccagcgcugcccagcgccggggcagaaucgggcgcaaucauaacaaggagggagaucaauacauuuauaugggccagccccugaccaaugacgaagaucacgcgcacuggacagaggcuaagaugcuccuggacaacaucaauaccccugaagggauuauccccgcccuuuucgagccugagcgggaaaaaucugccgcuauugauggcgaguacagacugcgcggagaagccagaaagacguuuguggagcucaugcggcgcggcgaccugccggucuggcugucccauaaaguggcgagcgaaggguuccaguauuccgauagacgguggugcuuugacggagagcgcaacaaucagguucucgaggaaaacauggacguggagaucuggaccaaggaaggcgagcgcaagaaacuucggcccagauggcuggaugcccgcacauacucugacccucuggcucuccgggaguucaaagaguuugccgcugggagacgcagcguguccggagaucugauccuugagauuggcaagcugccccaacaccucacccagcgggcccagaaugcucuggacaaccuggucaugcuccauaauucugaacagggcgggagagccuaucggcacgcgauggaggaacuuccugauacaaucgagacccugaugcugcucgcccugauugcuguucuuacaggaggcgugacccuguucuuucucagcgggaagggacugggcaaaacguccaucgggcugcucugugugauggccagcucuguccuucuguggauggcuuccguggaaccccacuggauugccgccagcaucauccuggaguucuuucucaugguucugcuuauuccggagccugaccgccaaagaacaccccaggauaaccagcuggcuuacguggucaucggacuccuguucaugauucugaccguggcggccaaugaaaugggccuccuugagaccacaaagaaagaccugggcaucgggcaugucgcuguggaaaaccaccaucacgccgccaugcuggauguugaccuccauccugcuucugccuggacccuguaugcgguggccacaacgauuaucacccccaugaugcggcacacaauugagaacaccacagcuaauaucucccuuaccgccaucgcuaaccaggccgcgauucugaugggacucgauaagggcuggccuaucagcaaaauggacauuggggucccccugcuggcccucggaugcuacucucaagugaauccgcuuacgcugaccgcugccguucugaugcucguggcucacuacgccaucauuggcccugggcugcaggcuaaggccacacgcgaggcgcagaagagaaccgccgcuggaaucaugaaaaaccccacaaucgauggcauugucgccaucgaccuugaccccgugguguaugaugcuaaguuugaaaaacaacugggccagauuaugcuccugauccuguguaccagccagauucuccuuaugcggacgacaugggcccugugcgaguccaucacccuggccacagggccucucaccacccugugggaaggaucuccgggcaaguucuggaauacaacgaucgcgguuagcauggcuaacauuuuccgcggguccuaccuugccggagcuggccuggccuuuagccucaugaaaucccucgggggaggcagacggggcaccggggcccagggagagacacugggcgaaaaguggaagcgccaacucaaucagcuuucuaaaagcgaguucaacaccuauaagagauccgggaucauggaggucgaccggucugaagcuaaagagggacugaagagaggcgaaacaaccaaacaugccgugagccgcgggacggcgaagcugcggugguuuguggagagaaaucucgucaagcccgaaggaaaaguuauugaucugggcuguggccgcgggggaugguccuacuauugcgccggccuuaagaaagugacagaggugaagggguacaccaaaggaggcccugggcacgaggaacccaucccuauggcuaccuauggauggaaccuggucaagcuccauucuggcaaagacguguucuuuauucccccugagaagugugauacacugcugugcgacaucggcgaaagcuccccgaaucccaccauugaggaagggcggacacucagaguucuuaagaugguggagccuuggcugcgcggaaaccaguucuguaucaaaauccugaaucccuacaugccuagcgucguggagacgcucgaacagaugcaacggaagcacggcgggaugcugguuagaaacccccuuucucgcaauuccacccacgagauguacugggugagcugcggaacaggcaacauugucucugccgugaauaugaccucccggaugcugcucaacagauuuacaauggcucaucgcaaaccgaccuaugaacgggauguggaccugggggccggaacgagacacgucgcgguugagccugagguggccaaccuggauaucauuggccagcgcaucgaaaauauuaagcaugagcacaaaagcaccuggcauuacgacgaagauaaccccuauaagacaugggcuuaccacggcucuuaugaggugaagcccuccgggagcgccuccagcauggucaauggagugguuaaacuccugaccaagccuugggacgugauccccauggucacacagaucgcuaugaccgacacaaccccuuucggccagcaaagaguguuuaaagaaaagguugauacgcggacaccgaaagccaagcgcgggaccgcucagauuaugguggucaccgccagauggcuuuggucuuuccugagccggaacaagaaacccagaaucugcacacgggaggaguuuacgcgcaaggugagauccaaugcggccauuggagcuguuuucguggacgaaaaccaguggaacucugccaaagaggcugucgaagaugaccgguuuugggaucucgugcaccgcgagagagaacugcauaagcaaggcaaaugugccacaugcgucuacaacacaauggggaagcgggagaagaaacuuggcgaguucggaaaggccaaaggcagccgcgcgaucugguauauguggcugggggcuagauuccucgaauuugaggcccugggauucaugaaugaagaccacugguuuucccgggagaacucucugagcggcguggaaggggagggacuccauaagcugggcuacauucuucgcgauaucuccaaaaucccugggggcaauauguacgccgacgauaccgcuggaugggacacaagaauuaccgagggcgaucugcagaacgaagccaagaucacagacauuauggagcccgaacacgcucuccuggccaaaucuaucuucaaacuuaccuaucagaauaagguugugcggguccagcgcccugcgaaaaacgggacggugauggaugugauuagcagacgggaccaacgcggauccggccagguugggaccuacggacugaauacauuuaccaacauggaggcccagcucaucagacagauggagagcgaaggcaucuucucucccaacgagcuggaaacaccgaaucuggcugagcgggugcucgacuggcuggaaaaguauggggucgagagacuuaaacgcauggccauuuccggcgaugacugugugguuaagccuaucgaugaccgguuugcuaccgcccugacggcgcucaacgauaugggaaaagugagaaaggacauuccccaaugggagccuagcaagggcuggaaugauuggcagcagguccccuucugcucucaccauuuucaccagcugaucaugaaagacgggcgcgaaauuguggucccuugucggaaccaagaugagcuugugggcagagcccgcguuucccagggcgcuggguggagccugcgggaaacagccugccucggaaaguccuacgcucagauguggcagcugauguauuuccauagacgcgaccugcggcucgccgcuaaugccaucuguucugcggugcccgucgauugggugccgaccagcagaacaaccugguccauucacgcccaucaccaauggaugacgaccgaggacaugcugagcguuuggaaccgcguguggaucgaagagaauccuuggauggaggacaaaacacggaucucuuccugggaagauguccccuaccuuggcgagagagaagaccaguggugcgggagccugauuggccucaccgcucgggccacaugggccaccaacgugcaaguggcuaucaaucaaguuagacgccugauuggaaacgagaauuauucugauuacaugacaagcaugaagcgguuuaaaaacaaguccgaacccgagggcgcccuuugguga

SEQ ID NO: 19529 - RNA, 9876 nt, Artificial Sequence
  derived and/or modified CDS sequence (opt5) from DENV-2__AJ968413__SS-prME
accgccggaaugaucauuaugcugauccccacagugauggcuuuccaccugacgaccagaaauggggaaccucauaugauugucagccggcaggaaaagggaaaaucccugcuuuuuaagacagaagacggaguuaauaugugcacccugauggccauggaucucggggaacugugugaggacacaaucaccuacaaaugcccgcuucugcgccaaaacgaacccgaggauauugacuguuggugcaauucuacaagcaccugggugacguauggaaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacacacuuucagagagcucuuauuuucauccugcucacggccguugcgccuuccaugaccaugcggugcauuggaaucucuaaccgcgauuuuguggaaggcgucagcgggggauccuggguggacauuguucuggagcacggcagcugugugacaaccauggccaagaauaagcccacacuugauuucgaacugaucaaaaccgaggcuaagcagcucgccacgcugagaaaauauugcaucgaagcuaagcugacaaacaccaccacagagucucgguguccuacccaaggggagccgucccucaaugaagaacaggacaaacgcuuugucugcaagcauagcaugguggauagaggauggggcaacggcugugggcuguucggaaagggcgggauugugacaugcgccauguuuacgugcaaaaagaauauggaaggaaaaaucguccagcccgagaaccuugaauacaccauuguuaucacaccucacucuggcgaggagcaugcgguggggaaugacaccggaaagcacggcaaagaaauuaagaucacaccccaguccagcaucaccgaggccgaacugacgggcuaugggaccgugacaauggaguguucuccucggaccggacucgauuucaacgaaaugguccugcuucaaauggagaauaaggcuuggcuggugcaccgccagugguuucucgaccugccccugccguggcucccuggcgccgauacacagggguccaacuggauucagaaggagacccugguuacguucaagaauccccaugcuaaaaagcaagacguggucgugcuuggaagccaggaaggcgccaugcacacagcccugaccggggcuacagagauccagauguccucuggcaaccuccuguuuaccggacaucuuaaaugcagacugcggauggacaagcuccaacugaaaggcaugagcuacuccauguguaccgggaaguucaagguugugaaagaaauugcggagacacagcacggaacgaucgucgugagaguccaguaugagggcgaugggagcccuugcaagauucccuucgaaaucauggaccuggagaaacgccaugugcucggacggcugaucaccguuaaccccauugugacagaaaaggauucuccugucaauaucgaggccgaaccgcccuuuggcgacuccuacgugauuaucgggguugagccuggccagcuuaaacugaacugguucaagaagggaagcucuauuggccaaauguuugagaccacaaugagaggggcuaaacgcauggccauccucggagauaccgccugggacuucggcagccucgggggaguguuuacguccauuggcaaggcucugcaccaggucuucggggccaucuacggcgcggcuuuuucuggagugagcuggacaaugaaaauccuuauuggcgugaucauuaccuggaucgggaugaacucccggagcaccucucucuccguuagccugguccuggugggaguggucacacucuaucugggcgugguugugcaggccgauucugggugugucguguccuggaagaacaaagaacuuaagugcggaagcggcauuuucaucaccgacaauguucacacauggacggagcaguacaaguuucaacccgaauccccuucuaaacuggccagcgcuauccagaaggcccaucaggaggggauuuguggcaucagauccgugacccgccucgaaaaccugauguggaaacagauuacacccgagcugaaucacauccuuucugagaacgaagucaagcucaccauuaugacaggagauaucaaaggcaucaugcaugcugggaagcggagccugagaccgcaaccuaccgagcugcgcuauuccuggaaaacguggggaaaggccaagauucucagcaccgaaucucacaaucagacauuccugaucgacggccccgagaccgcggaaugcccuaacacaaaucgggccuggaacucccuugagguggaggauuacggguuuggaguuuucaccacaaauauuuggcugaaacucagagaaaagcaggacguguuuugugacagcaaacugaugucugcugccaucaaggauaaccgcgcuguccacgccgacaugggcuauuggauugaguccgcgcugaaugauaccuggaaaaucgaaaaggccagcuucaucgaggugaagucuugccauuggcccaaaagccacacgcuuugguccaacggcgugcucgagagcgaaaugauuaucccuaagaacuucgcugggcccgucucucagcauaauuaccggccgggauaucacacacaaaccgccggcccuuggcaucuggggaaacuggagauggacuuugauuucugugaaggaaccacaguuguggugaccgaggacugcggcaacagagggcccucccuccggacgacaaccgcuagcggaaagcugauuacagaauggugcugucgcuccugcacccuucccccucugagauaccggggcgaggauggcuguugguacgggauggagaucagaccgcucaaagaaaaggaggaaaaucuggucaacucucuggugacagccggacacggccagauugacaauuuuagccuugggguucucggaauggcccuguuccuggaggaaaugcuccgcacccgggugggcacgaagcacgcuacccugcuugucgcgguguccuuuguuacacugaucaccgggaacaugucuuucagagaucucggacgcgugauggucauggugggcgccacaaugaccgacgauauuggcauggggguuacguaucuggcucugcuugccgccuuuaaagugagacccacauucgcugccggacugcuccugcggaagcucaccagcaaagagcugaugaugacaaccaucggcgucgugcuucugucccagucuaccaucccugagacaauucucgaacugacggacgcgcuggcucuugggaugauggugcugaagaucguccgcaaaauggagagauaccaacucgccguuaccauuacagccauccugugcgugcccaaugcugugauucuccagaacgccuggaaggucagcuguaccauccuggcggugguuuccgugagcccucuucugcucacaucuucccagcagaaggcugauuggaucccccuggcccugaccauuaaaggacuuaauccuacggccaucuuucugacaacccucagccggaccucuaagaaacgcuccuggccccugaacgaagcuauuauggccgucggcauggugagcauccucgcuucuucccugcuuaagaaugacauuccgaugacagggccucugguugccggaggccugcucaccgugugcuauguccugacaggcagaagcgcggaccuugagcuggaaaaagccgcugaugugcggugggaggaccaagccgagaucuccgggagcucucccauccucagcauuacgaucuccgaagauggaucuaugagcauuaagaacgaggaagaggagcagacccugacaauccucauucgcaccggccugcuugucaucuccgggcuguucccugugucuauucccaucacagcugccgccugguaccugugggaaguuaaaaagcagagagcuggagugcucugggacgucccgagcccucccccugugggcaaggcggagcuggaagauggggccuaucggaucaaacagaagggcauucuuggcuacucccaaaucggcgcugggguuuauaaagagggaaccuuucauacgauguggcacgugacccgcggcgccguccugaugcauaaggggaaaagaauugaacccucuugggccgacgugaagaaggaucucaucagcuacggaggcggguggaaacuggagggagaguggaaggaaggcgaggaagugcagguucucgcucuggagcccggcaaaaauccucgggccguccagacaaagccggggcuuuucaaaaccaacacaggaaccauuggcgcggugucccuggacuuuagccccgggacaucuggauccccuaucaucgauaagaagggcaaaguggucgggcuguacggaaauggcgugguuacgagaaacggcgcuuaugugagcgccauugcccagaccgaaaagucuaucgaggacaaccccgagauugaagaugacaucuuccgcaaaaagcggcucacaauuauggaucugcacccuggggcuggaaaaaccaagagauaccuucccgccaucguccgcgaggcgaucaagcggggccugagaacccucauucuggcuccuacacgcgugguugccgccgaaauggaggaagcucuccgggggcugccgaucagauaucaaacgcccgccauucgcgcugagcauaccggacgggagaucguggaccuuaugugucacgccacauucaccaugagacugcuguccccuguccgggugcccaauuacaaccucauuaucauggacgaagcgcacuuuacagauccugccagcauugcugcccgcggcuauaucuccaccagaguugagaugggggaagcugccggcaucuucaugacggccacacccccgggaucucgggacccuuuuccccagagcaaugcucccauuauggaugaggagcgcgaaaucccugagagauccuggaacagcggccaugaaugggugaccgacuucaaagggaagaccgucugguuugugcccucuauuaaagcgggaaaugauaucgccgcuugccugcggaagaacggcaaaaaggugauucagcuuuccagaaagacauucgacagcgaguacgucaaaacccgcacaaaugauugggacuuuguugugaccacggauaucucugaaaugggggccaacuucaaggccgagcgggugaucgacccuagacgcuguaugaaaccggucauucugacagauggagaggaacgggugauccucgcuggccccaugccuguuacccacagcuccgccgcgcaaagacgcgggcggauuggcagaaaucccaagaacgagaaugaccaguauaucuacaugggagaaccucuggagaacgacgaagauugcgcucauuggaaagaggccaagaugcugcucgacaauauuaacacacccgagggcaucaucccgucuauguuugaaccugagcgcgaaaaaguggaugccauugacggggaguacagacuucggggagaagcucgcaagaccuucgucgaucugaugagacggggcgaccugcccguguggcucgccuauaagguugcggccgaggggaucaauuacgcugaucgcagaugguguuuugacggcauucggaacaaccagauccuggaggaaaauguggaggucgaaauuuggacgaaagagggagagagaaagaaacuuaagccucgcuggcuggaugcccggaucuauagcgacccccucgcucugaaagaguucaaggaguucgccgcugggagaaagucccugacccucaaccuuauuacagaaaugggccgccugccuaccuuuaugacacagaaagcccgggaugcgcuggacaaucucgccgugcugcacaccgcugaggccggaggcagagcuuacaaccacgcccuuucugaacugcccgagacacucgagacccugcugcuccuuacgcugcuggccacagucaccgggggaaucuuccucuuucugaugagcggccgggggaucggaaagaugacccuuggcaugugcugcauuaucacagcuuccauucugcucugguaugcgcaaauccagccgcauuggauugccgcuagcaucauccuggaguucuuucugauugugcuccuuaucccugagcccgaaaaacagcgcacaccccaggauaaucaacugacauacguugugauugccauccugacgguggucgccgcuaccauggccaacgagaugggcuuccucgaaaagaccaagaaagaccuggggcuuggaucuauuaccacacagcagccugaguccaauauccuggacaucgaucucagaccggcgagcgccuggacccuguaugcuguugccacgaccuuugugacacccaugcugcggcacuccauugagaacucuagcgugaaugucucccucaccgcuaucgccaaccaggcgacagugcuuaugggccuggggaagggauggccucugucuaaaauggacauuggcguuccccuccuggccaucggguguuacagccaagugaauccuauuacccuuacggcugcccugcuccugcuggucgcucauuacgccaucauuggacccggccuccaggcuaaggccacacgcgaagcgcagaaaagagccgcugccggcaucaugaagaacccuaccguggaugggaucacagucauugaccuugauccgauccccuaugacccuaaauucgagaagcagcugggacaagugaugcugcucguucugugcgugacccagguccuuaugaugcggaccacaugggcucugugugaagcccucacgcuggccaccggccccauuuccacacugugggaggggaauccuggacgcuuuuggaacaccacaaucgcggugagcauggcuaauauuuucagaggcucuuaccucgccggggcuggacuucuguuuuccaucaugaagaacaccacgaauacacggcgcggcaccggcaacaucggggaaacccugggagagaaauggaagaacagacucaaugcccugggcaaaagcgaguuccagauuuauaagaaaucugggauccaagaaguugaucggacacuugccaaggagggaauuaaaagaggcgaaaccgaccaccaugcugugucccgcgggagcgccaagcugcggugguuugucgagagaaacauggugacacccgagggaaaggugguugaucucggcugcggccgcgggggauggucuuacuauuguggcgggcugaaaaauguccgggaagugaagggacugacgaaaggcgggccgggacacgaggaaccuauccccaugagcaccuacggcuggaaccucgugagacuucaguccggcgucgacguuuucuucacacccccugagaagugcgauacccugcugugugacauuggggaaucuagccccaauccuacaguggaggcgggacgcacccuccgggugcugaaccuugucgagaauuggcugaacaauaacauccaguuuugcaucaaagugcucaauccguauaugcccuccguuauugaaaagauggaggcccugcagagaaaguacggcggggcucuggugcgcaacccucucagcagaaauuccacgcacgaaauguacugggucucuaacgccagcggaaauaucguguccucuguuaacaugauuagcagaaugcuuaucaaccgcuucaccaugaaacauaagaaagcuacauaugagcccgauguggaccugggcuccgggacccggaauauuggaaucgaaucugaggucccuaaccuggacaucauuggcaagagaaucgagaaaauuaagcaagaacacgagacaagcuggcauuacgaucaggaccaccccuauaagaccugggccuaccacggcuccuaugaaacaaaacagaccgggagcgcgucuuccauggugaauggagugguccgccuccugacgaagccgugggauguugugccuauggugacacagauggccaugaccgacaccacacccuuuggccaacagagagucuucaaagagaagguggauacgcggacccaggaaccuaaagaggggacaaagaaacuuaugaaaaucaccgcugaguggcuguggaaggaacucggcaagaagaaaacaccccgcauguguaccagagaggaauuuacacggaagguuagaagcaacgccgcucugggcgccauuuucaccgacgagaauaaauggaagucugcucgggaggccguggaagauucccgcuuuugggggcuggucgacaaggagagaaaccuccaucuggaaggaaaaugcgagacguguguguacaauaugaugggcaagcgggagaagaaacuuggcgaguucgggaaagcgaaaggaagccgcgccaucugguauauguggcugggcgcuagauuucucgaguucgaagcccugggguuucuuaacgaggaucacugguucucucgggaaaauucccugagcggaguugagggcgaagggcuccauaagcugggcuacauucugcgcgacguguccaaaaaggagggaggcgcuauguacgccgaugacaccgccgggugggacacaagaaucacccucgaggaucugaaaaacgaagagauggucacaaaucacauggaaggagagcauaagaaacuugcggaagcuaucuuuaagcugaccuaucagaacaaggugguucgggugcaacgcccuacgcccagaggcacagucauggacauuaucagccggcgcgaucagagagggucuggacaggugggcaccuacgggcucaauacauucaccaacauggaggcccaacugauucggcagauggagggcgaaggagucuucaaaagcauccagcaccuuacggugaccgaggaaauugccguucagaauuggcuggcucgcgugggcagagagcggcucuccagaauggccaucucuggggacgauugcgucgugaagccgcuggacgaucgcuuugcuagcgcccugacagcgcucaacgacaugggaaaagugcggaaggauauccaacagugggagccuuccagaggcuggaacgacuggacccagguucccuucugcucucaccauuuucacgaacugauuaugaaagaugggcgcgugcuugucgugcccugucggaaucaggacgagcugaucggacgggcccgcauuagccaaggcgcuggguggucccuccgggaaacagccugccugggcaagucuuaugcucagauguggagccuuauguacuuccauagacgcgaucugcggcucgccgcgaacgccaucuguuccgcuguuccuagccacugggugccgaccucuagaacaaccugguccauucacgccaagcaugaguggaugacgacagaagacaugcugaccgucuggaaucgcguguggauccaggagaaccccuggauggaggacaaaaccccugucgaaagcugggaggaaauccccuaucugggaaagcgggaggaucaguggugcggcucucucauugggcugacauccagagcuaccugggccaaaaauauccaaacagcuauuaaccaggugcggagccuuaucggaaaugaagaguacacggacuauaugccuuccaugaagagauuucgccgggaggaagaggaagccggcguucugugguga

SEQ ID NO: 19530 - RNA, 9876 nt, Artificial Sequence
  derived and/or modified CDS sequence (opt5) from DENV-2__AB543624__SS-prME
agcgccggcaugaucauuaugcugauccccaccgugauggcuuuccaccugaccacgagaaauggggaaccucauaugauuguuggaauccaggaaaagggcaagucccugcuuuuuaagaccgaggacgggguuaauaugugcacacugauggccauggaucucggagaacugugugaggacaccauuacauacaaaugcccccuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauuguuaccugcgcuauguuuacaugcaagaaaaacauggaaggcaagaucguccagccugagaaucucgaauacacgauuguggugacaccccacucuggggaggagcaugccgucggaaacgacacaggcaaacacggcaaggaaaucaaagugaccccucaguccagcaucacagaggcggaacugauuggguauggaaccguuacgauggaguguucucccagaaccggccuugauuucaaugaaauggugcugcuccaaauggagaacaaggccuggcugguccaccggcagugguuucuugaccugccgcucccuuggcugcccggggcugauaagcaggaguccaauuggauccagaaagaaacacuggugaccuucaagaacccucaugccaaaaagcaagacguugugguccucggaagccccgagggcgcuaugcacacagcccugaccggggccacggaaauucagauguccucuggcaaucuucuguuuacaggacaucucaaaugccgccugagaauggacaaacuucagcugaagggcaugagcuacuccauguguaccgggaaauucaagguggucaaagagaucgcugagacacaacacggaaccauugugauccggguucaguaugaaggcgaugggagccccugcaagaucccuuucgagauuauggaccucgagaagcgguacgugcugggacgccugaucaccgucaacccgauugugacagagaaggauaaccccguuaauaucgaagcggagccucccuuuggcgacucuuacauuaucauugggguggagccuggccagcucaagcugaacugguucaaaaagggauccagcaucggccagauguuugaaacgaccaugagaggggcuaaaagaauggcuauccuuggagauacagccugggacuucggcucucucgggggagucuuuaccagcauuggcaaggcccuccaucaaguguucggggcuaucuauggcgccgcguuuuccggagugucuuggacaaugaaaauucugaucggcguuauuaucaccuggaucgggaugaauagccgcuccacgagccugucugucucccuugugcucgugggaauugucacacuguaccugggcgugaugguucaggcugauagcggguguguggucucuuggaagaacaaggagcucaaaugcggauccggcaucuucauuaccgacaaugugcacaccuggacagaacaguauaaguuucagcccgagagcccguccaaacuggccucugccauccaaaaggcucaggaagaggggauuuguggcauccggagcguuaccagacuugagaaccugauguggaaacagaucgccccugaacucaaucacauucuggcugagaacgaagugaagcugacaaucaugacgggagauauuaaaggcaucaugcaggccgggaagcgcucccuucggccccaaccuaccgagcucaaguacucuuggaaaacauggggaaaggcgaaaaugcugagcaccgaauccuauaaucagacauuccugauugacggccccgagaccgccgagugcccuaacacgaauagagcuuggaacagccucgaagucgaggauuacggguuuggaguguucaccacaaauaucuggcugaaacuuaaagaacgccaggacgccuuuugugacucuaagcugauguccgcugccaucaaggauaaccgggcgguucaugccgacaugggcuauuggauugagagcgcucucaaugauaccuggaaaaucgagaaggccucuuucauugaagugaaaaacugccacuggcccaagucccauacacuguggagcaacggcguccuggagucugaaaugaucauuccgaaaaaucuugcugggccugugagccagcacaacuacagacccggauaccacacccaaaucgccggccccuggcaucucgggaagcuggagauggacuucgauuuuugugacggaacaaccgugauugucacggaagauugcggcaaucgcgggccuucccugcggacaaccaccgccagcggaaagcucaucacagaguggugcuguagaucuugcacccugccgccccuucgguaucgcggcgaggacggcuguugguacgggauggaaaucagaccucugaaagagaaggaagagaaccucguuaauucccuggugacggcuggacacggccagguggauaacuucagccuggggguccuuggaauggcgcucuuucuggaagagaugcugcggacaagagugggcaccaaacaugccauucuccugguugcuguguccuucgucacacuuaucaccgggaauaugucuuuuaaggaccugggacgcgugguugugauggucggcgccacaauggccgaugacauuggcaugggggugaccuaucucgcucugcuggccgcguucaaaguucggcccacguuugcugccggacuucugcucagaaagcugaccagcaaggagcucaugaugacaaccaucggcauugugcugcuuucccagucuacaaucccugaaaccguccuggagcucacggaugcccuggcucuggggaugauggugcuuaaaaucgugcgcaacauggaaaaguaccaacuggccgucacaauuauggcgauccucugcguucccaaugcugugauucugcagaacgccuggaaagugagcuguaccauccucgccgucguguccguuucuccucugcuucugacaagcucccagcagaagaccgacuggauuccccucgcucugaccaucaaaggacugaauccgacagccaucuuccuuacgacccugagcagaacaaacaagaaacggucuuggccucucaaugaggcuauuauggccgugggcauggucuccauccuggcgagcucucuccugaagaacgacauucccaugaccgggccucuuguggccggaggccugcugacaguuugcuaugugcucaccggccgcuccgcugaucuggaacuugagagagccacggacgucaagugggaggaucaagcugaaaucagcgggucuucccccauucugagcaucacaauuuccgaggacggaagcaugucuaucaaaaaugaagaggaggaacagacccucaccauccugauucggacaggccuccuggugaucagcgggcuuuuuccgauuuccaucccuauuaccgccgccgcuugguaccugugggaggucaagaaacagcgcgcgggagugcugugggauguucccucuccuccgcccaugggcaaggccgaacucgaggacggggcuuauagaaucaaacagaagggaauccugggcuacagccaaauuggcgccgggguguacaaggaaggaacauuccacacgauguggcaugucacccggggcgccgugcuuaugcacaaagggaagcgcaucgagccuuccugggcugauguuaaaaaggaccugauuucuuauggaggcggguggaaacucgagggagaauggaaggagggcgaagaggugcagguccuggcccucgaaccgggcaagaaccccagagcggugcagacaaaaccugggcuguuuaagaccaacaauggaacaaucggcgcugugagccuugauuucucccccgggaccucuggaagcccuauuaucgacaaaaagggcaaaguugucgggcuguacggaaacggcguggugacgcgguccggcgccuaugucagcgccaucgcucagaccgagaagucuauugaggauaaucccgaaaucgaggacgauauuuuucgcaagagacggcugacaaucauggaccuccacccuggggccggaaaaaccaagagauaccugccggcgauugugcgcgaagcuaucaaacggggccuuagaacacugauucucgcccccacccgcguuguggccgcugagauggaagaggcccugcgggggcucccuaucagauaucaaacacccgcuauccgcgccgagcauacgggacgggaaauugucgaccugaugugucacgcgaccuucacaaugagacuucuguccccugugcgcguucccaacuacaaucugaucauuauggaugaggcccauuucaccgacccggcuagcaucgccgcucggggcuauauuucuaccagaguggaaaugggggaggccgccggcaucuuuaugacagcuacgccucccggaucccgggaucccuucccucagagcaacgcgcccaucauugacgaggaacgcgagaucccugaaagauccuggaacucuggccacgagugggucaccgauuuuaaggggaaaacagugugguucguuccgagcauuaaggccggaaacgacaucgcugccugccuccggaagaauggcaaaaaggugauucagcugucccgcaaaaccuuugauagcgaauacgucaagacaagaaccaacgacugggauuucguggugacgacagacaucucugagaugggggccaauuuuaaagcugagcgggucaucgaucccagacgcuguaugaagccuguuauucuuaccgacggagaggaacgggugauccuggccggccccaugccugugacccauuccagcgcggcucaaagacgcgggcggauuggcagaaaccccaaaaaugaaaacgaccaguacaucuauaugggagagccgcucgaaaaugaugaggacugcgcccacuggaaggaggccaagaugcugcuggauaacauuaacacaccugaaggcaucauucccucuauguucgagccugaacgcgagaaagucgacgcuaucgauggggaauaccggcucagaggagaggcccgcaagaccuuuguggaccuuaugagacggggcgaucugcccguuuggcuggcguauaaaguggccgcugaggggaucaauuacgccgaccgcagaugguguuucgauggaauuaagaacaaucagauccucgaagagaacgucgaaguggagauuuggacaaaagagggcgaacggaagaagcugaaaccucgcuggcuugacgcuagaaucuauagcgauccccuggcccucaaggaguuuaaagaguucgcugccgggcggaagucccugacccugaaucucauuacggagaugggcagacuuccgacauucaugacccagaaaacacgcgacgcgcuggauaaccuggccguucuccacaccgcugaagccggaggccgggcuuacaaucaugcccugucugagcuuccugagacgcuggaaacccuccugcugcucacacuucuggccaccgugacagggggaaucuuucuguuccucaugagcggcagagggaucggaaagaugacccugggcaugugcugcauuaucacagcuuccauucuucugugguaugcgcaaauccagccccacuggauugccgcuucuaucauccucgaguuuuuccugauuguccugcucauccccgaaccugagaagcagcgcaccccgcaggacaaccaacuuacguacguggucauugccauccugacagugguugccgcuaccauggccaaugaaaugggcuuucuggagaaaaccaagaaagaccucgggcugggaagcauugcgacacagcaucccgaguccaacauccuugauauugaccugcggccugccagcgcuuggacccucuacgccguggcuacaacguucaucacccccaugcugagacacucuaucgaaaauuccagcgugaacgucucccugacagccauugcgaaucaggccaccguucucaugggccuugggaagggauggccucugucuaaaauggauaucggcgugccccugcucgcuauuggguguuauagccaggugaacccuaucacacugaccgccgcccuucugcuccuggucgcccacuacgcuauuaucggaccgggccugcaagccaaggcgacgcgggaggcccagaagcgcgcugccgcuggcaucaugaaaaaucccaccguggacgggauuacaguuaucgaucucgacccuauucccuaugauccuaaguuugaaaaacagcuuggacaggugaugcugcugauccucugcgucacccaagugcugaugaugagaacaaccugggcccuuugugaggcccugacgcucgcgacaggccccauuuccccgcugugggaagggaacccuggacgguucuggaauaccacaaucgcugucucuauggccaacaucuuucgcggcagcuaccuggcuggggccggacuccuuuucuccauuaugaagaacaccaccaauacaagacggggcacgggcaacaucggggagacccugggagagaaauggaaaagccgccugaaugcccucggcaaaucugaauuucagauuuauaagaaguccgggauccaggagguggacagaacacuggcuaaagaaggaauuaagcggggcgagaccgaucaucacgccguuagccgcgggucugcgaaacuuagaugguucguggagcggaacauggucacacccgaaggaaaggugguugaccugggcugcggcagagggggaugguccuacuauuguggcgggcucaaaaaugugcgcgaggucaagggacugaccaagggcgggcccggacaugaagaaccuauccccaugagcacguacggcuggaaccuggugcggcuccaaucuggcguggaugucuuuuucaucccuccggaaaaaugcgacacacuucugugugauauuggggagagcucccccaauccuaccgucgaggccggaagaacccugcgcgugcucaaccugguggaaaauuggcuuaacaaucacacacauuucugcaucaagguccugaaccccuacaugccuucuguucucgagaaaauggaagcucugcagcggaaguauggcggggcccuggugagaaauccccucagccgcaacuccacccacgagauguacugggugagcaaugcuuccggaaacauugucucuagcgugaacaugaucucccggaugcuuauuaauagauuuacaaugcgccacaaaaaggccacguaugaaccggacguugaccugggcucugggacccggaacaucggaauugagagcgagaucccuaaucuggauaucauuggcaagagaaucgagaagauuaagcaggagcaugaaacauccuggcacuacgaccaggaucaucccuauaaaaccugggcguaccacggcucuuaugagacaaagcaaaccgggagcgccuccagcauggugaacggagucgugcgccuccugacgaaaccuugggacguucuucccaccgugacacagauggcuaugaccgauacaaccccuuucggccagcagcgggucuuuaaggaaaagguggacacaagaacccaagagcccaaagaggggacgaagaaacugaugaagaucacagccgaauggcucuggaaagagcugggaaagaaaaagaccccgcgcauguguaccagagaagaguucacacggaaggugcgcucuaaugcugcccugggcgcuauuuuuacggaugagaacaaauggaaguccgccagagaagcggucgaggacagccgguucugggaacucguugauaaagagagaaaucugcaccuugaagggaagugcgagaccuguguguacaacaugaugggaaaacgggagaagaagcugggcgaauuuggcaaagccaaggggucucgcgcuaucugguacauguggcucggagccagauuccuggaguuugaagcucuuggcuuccugaaugaggaccauugguuuucccgggaaaacagccucucugggguggagggagagggccugcacaaacugggguauauccuccgcgaugucuccaagaaagaaggcggagccauguacgccgacgacacagcgggcugggauaccagaauuacacuggaggaccuuaagaaugaagagauggugaccaaccauauggaaggggagcacaagaaacuggcugaggccaucuucaagcucacauaucagaauaaaguugugcggguccagcgcccuacccccagaggaacggugauggauauuaucagccggcgcgaccagagaggcuccgggcaaguuggaaccuacggccugaacacauuuaccaauauggaagcccagcuuauucggcagauggagggggaaggcguguucaagaacauccaacgccugacagucaccgaggagguggcuguucauaacuggcucgccagagugggacgggaacgccugagcagaauggcuaucucuggcgaugacugcgucgugaaaccccuggaugaccgguucgccaaugcgcucacggcccugaacgauauggggaagauuagaaaggacauccagcagugggagccuagcaaaggauggaaugauuggacacaggucccguuuugcucccaccacuuccaugaacuuauuaugaaggacggccgcgugcugguugugcccugucggaaccaagaugagcucaucgggagagcucgcauuucucagggagccggcuggagccugcgggaaaccgcuugccuugggaaauccuaugcccagauguggucucugauguacuuucacagacgcgaccuccggcuggcggccaaugcuaucuguagcgccgucccuucccauugggugcccacaucuagaaccacguggagcauucacgcuaagcacgaguggaugaccacagaggacaugcugaccguguggaaccgcguuuggauccgggaaaauccuuggauggaggauaaaacacccguggaauccugggaggaaaucccuuaucucggcaagagagaggaccaguggugcggaagccugauuggccuuaccucucgcgccacaugggcuaagaacauccaagccgcgauuaaucagguccggucccugaucgggaacgaggaauacaccgauuacaugcccagcaugaaaagauuccggagagaggaagaggaagccggagugcucugguga

SEQ ID NO: 19531 - RNA, 9876 nt, Artificial Sequence
  derived and/or modified CDS sequence (opt5) from DENV-2__AB189122__SS-prME
accgccggcgugaucauuaugaugauccccaccgucauggcuuuccaccugacgaccagaaacggggagccucauaugauuguuagccggcaggaaaagggaaaaucccuccuguuuaagacggagaauggcgugaacaugugcacccuuauggccauggaccugggggaacucugugaggauacaaucaccuacaauugcccgcugcuucgccaaaacgaacccgaggacauugauuguuggugcaauucuacaagcaccugggugacguauggaaccuguacagcgaccggcgagcacagacgggaaaaacgcuccgucgcucuggccccucauguggggaugggacucgagacaagaaccgaaacguggaugucuagcgagggcgccuggaagcacgcucagcggaucgagacauggguucugcgccaucccggcuucaccaucauggccgcuauucuggccuacacaaucgggaccaccuauuuucagagagugcucauuuucauccugcuuacagcggucgccccuuccaugacgaugcggugcauuggaaucucuaaccgcgacuuuguggaaggcguuagcgggggauccuggguggauauuguccuggagcacggcagcugugugaccacaauggcuaaaaauaagcccacccucgacuucgaacugaucaagacagaggccaaacacccugcuacccuuagaaaguacugcaucgaagccaaacugacgaacacaaccaccgcgucucgguguccgacacagggggagcccucccucaaugaggaacaagauaagcgcuuugugugcaaacauagcauggucgacagaggauggggcaacggcugugggcuguucggaaagggcgggauuguuaccugcgccauguuuacaugcaagaaaaauauggagggaaagguggugcagccugaaaaccuggaguauacgaucgucauuacaccccacucuggcgaagagaaugcuguggggaacgauacaggaaaacauggcaaggagaucaaaguuaccccucaguccagcauuacagaagccgagcucaccggcuacgggacggugaccauggaauguucuccccggacaggacuggacuucaaugagaugguccuucugcagauggaaaacaaggcuuggcucgugcaccgccaaugguuucuggaucuuccgcugccuuggcuccccggcgccgacacccagggguccaacuggauccagaaagagacacugguuaccuucaagaauccucacgccaagaaacaggauguggucgugcugggaagccaagagggcgcuaugcauacggcgcucacaggggccaccgaaauccagauguccucuggcaaccugcuuuuuacaggacaccugaagugcagacuccggauggacaaacugcagcuuaagggcaugagcuauuccauguguaccgggaaauucaaggucgugaaggagauugcugaaacccaacauggaacaaucguuauuagagugcaguacgagggcgacgggagccccugcaaaauccccuucgagauuauggaucuggaaaagcgccacguccucggacggcugaucacggugaauccuaucguuaccgagaaagacucuccggugaacauugaagccgagcccccuuuuggcgauuccuacaucauuaucggggucgaacccggccagcugaagcucaauugguucaaaaagggaagcucuauuggccagauguuugagacaaccaugagaggggccaagcgcauggcuauccugggagacacagccugggauuucggcagccuugggggaguguuuaccuccauuggcaaagcgcugcaucaaguguucggggcuaucuauggcgccgccuuuucuggaguuagcuggacgaugaagauccucauuggcgucgugaucacauggauugggaugaacucccggagcaccucucuguccgugagccugguccuugugggaguugugacccucuaccugggcgucauggugcaggcugacucuggguguguuguguccuggaaaaauaaggagcugaaaugcggaagcggcaucuucauuacagauaacguccacaccuggacagaacaguauaaguuucagccugagucccccucuaagcucgccagcgcuauccaaaaagcccacgaagaggggaucuguggcauuagauccgugacgcgccuggaaaaucuuauguggaagcagaucaccccggagcugaaccauauucucucugagaaugaaguuaaacugacaaucaugaccggagacauuaagggcaucaugcaggcggggaaacggagccugagaccucagcccacagagcuuaaguacuccuggaaagccuggggaaaggcuaagaugcucagcaccgaacugcacaaccauacguuccugaucgauggcccugagaccgccgaaugccccaauacaaaccgcgcuuggaacucucucgagguggaggacuauggguuuggagucuucaccacaaacauuuggcugaaacuuaaggaacggcaagauguguuuugugacuccaaacugaugagcgccgcgaucaaggacaacagagccgugcacgcugauaugggcuacuggauugagucugcccucaaugacaccuggaaaaucgaaaaggcuuccuucauugaggucaagagcugccacuggccuaaaucucauacacuguggagcaacggcguucuggaguccgaaaugaucauccccaagaauuucgccgggccggugagccagcacaacuaucgcccuggauaccauacccagacggccggccccuggcaccuugggaaacucgagauggauuuugacuucugugaaggaacaaccguggucgugaccgaggauugcggcaaucgggggcccucucugagaacaaccacggcuuccggaaagcugauuacagaauggugcugucggagcugcacccucccuccgcugcgcuacagaggcgaggacggcuguugguaugggauggagauccggccccuuaaagaaaaggaggaaaaccugguuaauucccucgugacagcgggacauggccagauugauaacuuuucucuggggguccugggaauggcccuuuuccucgaggaaaugcugagaacccgcgugggcacaaagcacgcuauccugcucguugccgugagcuuugucacccugauuacggggaauauguccuuccgggaccuuggaagagugaugguuauggugggcgccaccaugacagaugacaucggcaugggggucaccuaccuggcucuccuggccgcguuuaaagugcgcccuacauucgcugccggacugcuucugagaaagcucaccucuaaagagcugaugaugacgacaauuggcaucgugcuccugagccaauccaccauccccgagacaauucuugaacugaccgaugcccucgcucuggggaugaugguccugaagaucguucggaacauggagaaauaucagcuugccgugaccauuauggcgauccugugcgugccuaaugcugucauucuccagaacgccuggaaggugucuuguacaacgcuggccguugugagcgucagcccccuccugcuuaccagcucucaacagaaggcugacuggaucccucuggcccucacaaucaaaggacugaaucccaccgcuauuuuucugacaacccuuucccgcacgagcaagaaaagaucuuggccgcugaacgaagccaucauggcggugggcaugguuuccauucucgccagcucucugcucaagaaugauaucccuaugacagggccccugguggcuggaggccuucugaccgucugcuacgugcugaccggccgguccgccgaccucgagcuggaacgcgcugccgacgucagaugggaggagcaggccgaaauuagcggguccagcccuauccuuucuaucacaauuagcgaggauggauccaugucuaucaaaaacgaagaggaggaacagacccugacaauucucauccggacgggccugcucgugauuagcgggcuguuccccguuuccaucccgauuaccgcugcggccugguaucuuugggaggugaagaaacaacgcgcuggaguccugugggacgugccuucucccccucccguuggcaaggccgaacuggaggauggggccuacagaaucaagcagaaaggaauccucggcuauagccagauuggcgugggggucuacaaggaaggaacauuucacaccauguggcaugugacacggggcgcugugcugaugcacaaagggaagcgcaucgagcccuccugggccgacguuaaaaaggaucuuauuucuuacggaggcggguggaagcuggagggagaauggaaagagggcgaagagguccaggugcucgcgcuggaaccuggcaagaacccgagagcugugcaaaccaaacccggacucuucaagacgaauaccggaacaaucggcgccgucagccuggacuuuuccccugggaccagcggaucucccauuguggauaaaaagggcaagguuguggggcuuuauggaaacggcgucgugacacgguccggcaccuacguuagcgccaucgcucagacagagaaaaauaucgaggacaacccugaaauugaggaugacaucuucagaaagaaacgccugacgauuauggaucugcaucccggggccggaaagaccaaacgguaucucccugcgaucgugagagaagcuauuaagcgcggccugcggacacuuauccuggccccgaccagagucguggccgcugagauggaagaggcccuccgcgggcugcccauccgguaccagaccccugcuauuagagccgagcacacaggacgcgaaaucguugaccucaugugucaugcgacguucaccaugcggcugcuuucucccauuagagugccuaauuauaaccugaucauuauggaugaggcccacuuuacagaccccgcuuccaucgccgcucggggcuacauuagcacccgcgucgaaaugggggaggccgccggcaucuucaugacagcuaccccgccuggauccagagaccccuuuccccagucuaaugcgccuaucauggaugaggaacgggagauucccgaacgcagcuggaacuccggccacgagugggugacggacuucaaggggaaaacagugugguuugucccuagcaucaaggccggaaaugauauugcugccugccugcgcaaaaauggcaagaaaguuauccaacucucucggaagaccuucgacuccgaauauauuaagaccagaacaaaugauugggacuuuguggugaccacagauaucagcgagaugggggccaacuucaaagcugagcgcgucaucgacccgcggagauguaugaagcccgugauucugaccgauggagaagaaagaguuauccuugccggcccuaugcccgugacgcauucuagcgcggcucagcggagagggcgcgucggccggaauccuaaaaacgaaaaugaccaguacauuuacaugggagagccccuggaaaacgaugaggacugcgcccacuggaaggaggccaaaaugcuccuggacaacaucaauacaccggaaggcauuaucccuuccauguuugagcccgaaagagagaagguggaugcuaucgacggggaauaucgccugagaggagaggcccggaaaaccuucguugaucucaugcgcagaggcgaccuuccuguguggcuggcguaccgggucgccgcugaggggauuaacuaugccgaucgcagaugguguuuugacggagugaagaauaaccaaauccuggaagagaaugucgaaguggagauuuggacaaaggagggcgaacggaaaaagcucaaacccagauggcuggaugcucgcaucuacucugacccucuugcccugaaggaguucaaagaguucgcugccgggcggaagucccucacccugaaccugauuacggagaugggcagacuccccaccuuuaugacacagaaggcgcgcaaugcccuugauaaccuggcuguucugcauaccgccgaagcuggaggccgggccuauaaucacgcccucuccgagcugccggagacacuugaaacccugcuccugcugacacuccuugcuaccgugacaggcgggaucuuccuguuucugaugucugggaaagggauuggaaagaugacacucggcaugugcugcaucaucaccgcgagcgugcugcuuugguacgcccagauucagccucacuggaucgcugccuccauuauccuggaguucuuucucauuguccugcugauccccgaacccgagaaacaaagaaccccucaggacaaccagcucacauauguugugaucgccauucuuaccguggucgcugccacaauggcgaaugaaaugggcuuccuggagaagacgaaaaaggauuuugggcugggaagcaucgccacccagcaaccggagucuaacauucucgacaucgaucugcggcccgcuuccgccuggacacuuuacgcuguggccaccacauucauuaccccuaugcugcgccauagcaucgaaaauuccucuguuaacgugagccucacggcgaucgccaaucaggcuaccguccugaugggccuggggaagggauggccccucuccaaaauggacauuggcgugccucuucuggccaucggguguuacucucaggucaaccccauuacacugaccgcugcccuccugcuucugguggcucacuaugccaucauuggaccuggccuccaggcgaaggccacaagagaggcucaaaaacgggccgcugccggcaucaugaagaauccgaccguugacgggauuacggugaucgaucuggaccccaucccuuacgaucccaaauuugaaaagcagcugggacaggucaugcuccuugugcugugcguuacacaggugcugaugaugcgcaccacaugggcccucugugaggcgcugacccuugcuaccggcccuauuagcacacugugggaagggaaccccggaagauucuggaacacgaccaucgccgucuccauggcuaauauuuuucggggcagcuaucucgccggggccggacugcuguucucuaucaugaagaacacagcuaauacccgcagaggcacaggcaacaccggggagacgcucggagagaaauggaagaaucggcuuaacgcccugggcaaauccgaauuucaaguguacaagaaaagcgggauucaggagguggaccgcacacuggcgaaggaaggaaucgagagaggcgagaccgaucaucacgccguuucucggggguccgcuaaacucagaugguucgucgaacgcaaucuggugaccccggagggaaagguggucgaccuuggcugcggcagagggggauggagcuauuacuguggcgggcugaagaacguuaaagaagugaagggacucacaaaaggcgggccuggacaugaggaacccauccccaugucuaccuauggcuggaaucuggugcggcugcagagcggcgucgauguguucuuuacaccucccgagaagugcgacacgcuccuuugugauauuggggaguccucuccuaacccgaccguugaagccggacgcacacugcgggugcugaaucucgucgagaacuggcugaauaacaauacccaauucugcaucaaagugcuuaaccccuacaugccuagcguuauugaaaagauggaggcucugcagagaaaguacggcggggcccucgugcgcaacccccugucccggaauagcacacacgaaauguauugggucuccaacgcgucuggaaauaucgugagcuccgugaacaugauuucuagaaugcugaucaaucgcuuuaccaugcggcacaaaaaggccacguacgagccugacgucgaucucggcagcgggaccagaaacaucggaauugaguccgaaauccccaaucuugacauuaucggcaaacgcauugagaagaucaaacaggaacaugagacaucuuggcacuaugaucaggaccauccguacaagaccugggcuuaucacggcagcuacgaaacaaagcaaaccggguccgccagcucuaugguuaacggaguggugcggcugcugacaaaaccuugggacgucauccccauggugacccagauggcuaugacggauacaaccccuuucggccagcagagaguuuuuaaggagaaaguggacacccgcacacaagagcccaaggaagggacgaaaaagcucaugaagauuaccgccgaguggcuguggaaagaacuuggaaagaaaaagacaccuagaauguguacccgggaggaguucacacgcaaagucagauccaaugcugcccugggcgcgaucuuuaccgaugaaaacaaguggaaaagcgcccgggaggcuguggaagacucuggguucugggagcucguugauaaggaaagaaaucugcaccuggagggaaagugcgagacauguguguauaacaugaugggcaaacgggaaaagaaacucggcgaguuugggaaggccaaaggaucccgcgcuauuugguacauguggcugggcgccagauuccuugaauuugaggcccugggguuccucaaugaagaccauugguuuagccgggagaacucucuguccggagucgagggcgaagggcuucacaagcugggcuacauccuccgcgaugugagcaagaaagagggaggcgcgauguaugcugacgauaccgccgggugggacacgagaauuacccuggaagaucugaagaaugaggaaaugguuacaaaccauauggagggagagcacaaaaagcucgccgaagcuaucuucaaacugaccuaccagaacaaggugguccgggugcagcgccccacaccgagaggcaccgucauggacauuaucucccggcgcgaccagagagggagcggacaagugguuacguauggccuuaauacauucaccaacauggaggcccagcugauccggcagauggaaggggagggcguguuuaagucuauucaacaucucacagucaccgaggaaaucgcugugaaaaauuggcuggcccgcgugggaagagagcggcuuagccgcauggcgauuuccggcgaugacugcguugugaagccucuggaugacagauucgccucugcucucacggcccugaacgauauggggaaaguccggaaggacauccagcagugggaacccagcagaggauggaaugauuggacccaggugcccuuuugcucccaccacuuccaugagcugauuaugaaagacggccgcguucucguggucccuugucggaaccaagaugaacugaucgggagagcucgcaucucucagggagccggcuggagccuucgggagacagcgugccuggggaaguccuacgcccagauguggucucucauguauuuucacagacgcgaccugcggcuugcugccaaugcuauuuguagcgccgugccgucccauuggguccccaccagcagaacaaccuggucuauccacgcuacacacgaguggaugaccacggaagauaugcugacaguguggaaccgcguuuggauucaggagaauccuuggauggaagacaagacccccguggaguccugggaagagaucccuuaccucggcaaacgggaggaucaauggugcggaagccugauuggccugaccucuagagccacaugggcgaagaacauccagaccgccaucaaucagguccgcucccucauugggaacgaagaguauacagacuacaugcccagcaugaaacgguucagacgggaagaggaagaggcuggagugcugugguga

SEQ ID NO: 19532 - RNA, 9876 nt, Artificial Sequence
  derived and/or modified CDS sequence (opt5) from DENV-2__AB189123__SS-prME
accgccggagugaucauuaugaugauccccaccgucauggcuuuccaccugacgaccagaaacggggaaccucauaugauuguuagccggcaggaaaagggaaaaucccuccuguuuaagacggagaauggcgugaacaugugcacccuuauggccauggaccugggggaacucugugaggauacaaucaccuacaauugcccgcugcuucgccaaaacgaacccgaggacauugauuguuggugcaauucuacaagcaccugggugacguauggaaccuguacagcgaccggcgagcacagacgggaaaaacgcuccgucgcucuggccccucauguggggaugggacucgagacaagaaccgaaacguggaugucuagcgagggcgccuggaagcacgcucagcggaucgagacauggguucugcgccaucccggcuucaccaucauggccgcuauucuggccuacacaaucgggaccaccuauuuucagagagugcucauuuucauccugcuuacagcggucgccccuuccaugacgaugcggugcauuggaaucucuaaccgcgacuuuguggaaggcguuagcgggggauccuggguggauauuguccuggagcacggcagcugugugaccacaauggcuaaaaauaagcccacccucgacuucgaacugaucaagacagaggccaaacacccugcuacccuuagaaaguacugcaucgaagccaaacugacgaacacaaccaccgcgucucgguguccgacacagggggagcccucccucaaugaggaacaagauaagcgcuuugugugcaaacauagcauggucgacagaggauggggcaacggcugugggcuguucggaaagggcgggauuguuaccugcgccauguuuacaugcaagaaaaauauggagggaaagguggugcagccugaaaaccuggaguauacgaucgucauuacaccccacucuggcgaagagaaugcuguggggaacgauacaggaaaacauggcaaggagaucaaaguuaccccucaguccagcauuacagaagccgagcucaccggcuacgggacggugaccauggaauguucuccccggacaggacuggacuucaaugagaugguccuucugcagauggaaaacaaggcuuggcucgugcaccgccaaugguuucuggaucuuccgcugccuuggcuccccggcgccgacacccagggguccaacuggauccagaaagagacacugguuaccuucaagaauccucacgccaagaaacaggauguggucgugcugggaagccaagagggcgcuaugcauacggcgcucacaggggccaccgaaauccagauguccucuggcaaccugcuuuuuacaggacaccugaagugcagacuccggauggacaaacugcagcuuaagggcaugagcuauuccauguguaccgggaaauucaaggucgugaaggagauugcugaaacccaacauggaacaaucguuauuagagugcaguacgagggcgacgggagccccugcaaaauccccuucgagauuauggaucuggaaaagcgccacguccucggacggcugaucacggugaauccuaucguuaccgagaaagacucuccggugaacauugaagccgagcccccuuuuggcgauuccuacaucauuaucggggucgaacccggccagcugaagcucaauugguucaaaaagggaagcucuauuggccagauguuugagacaaccaugagaggggccaagcgcauggcuauccugggagacacagccugggauuucggcagccuugggggaguguuuaccuccauuggcaaagcgcugcaucaaguguucggggcuaucuauggcgccgccuuuucuggaguuagcuggacgaugaagauccucauuggcgucgugaucacauggauugggaugaacucccggagcaccucucuguccgugagccugguccuugugggaguugugacccucuaccugggcgucauggugcaggcugacucuggguguguuguguccuggaaaaauaaggagcugaaaugcggaagcggcaucuucauuacagauaacguccacaccuggacagaacaguauaaguuucagccugagucccccucuaagcucgccagcgcuauccaaaaagcccacgaagaggggaucuguggcauuagauccgugacgcgccuggaaaaucuuauguggaagcagaucaccccggagcugaaccauauucucucugagaaugaaguuaaacugacaaucaugaccggagacauuaagggcaucaugcaggcggggaaacggagccugagaccucagcccacagagcuuaaguacuccuggaaagccuggggaaaggcuaagaugcucagcaccgaacugcacaaccauacguuccugaucgauggcccugagaccgccgaaugccccaauacaaaccgcgcuuggaacucucucgagguggaggacuauggguuuggagucuucaccacaaacauuuggcugaaacuuaaggaacggcaagauguguuuugugacuccaaacugaugagcgccgcgaucaaggacaacagagccgugcacgcugauaugggcuacuggauugagucugcccucaaugacaccuggaaaaucgaaaaggcuuccuucauugaggucaagagcugccacuggccuaaaucucauacacuguggagcaacggcguucuggaguccgaaaugaucauccccaagaauuucgccgggccggugagccagcacaacuaucgcccuggauaccauacccagacggccggccccuggcaccuugggaaacucgagauggauuuugacuucugugaaggaacaaccguggucgugaccgaggauugcggcaaucgggggcccucucugagaacaaccacggcuuccggaaagcugauuacagaauggugcugucggagcugcacccucccuccgcugcgcuacagaggcgaggacggcuguugguaugggauggagauccggccccuuaaagaaaaggaggaaaaccugguuaauucccucgugacagcgggacauggccagauugauaacuuuucucuggggguccugggaauggcccuuuuccucgaggaaaugcugagaacccgcgugggcacaaagcacgcuauccugcucguugccgugagcuuugucacccugauuacggggaauauguccuuccgggaccuuggaagagugaugguuauggugggcgccaccaugacagaugacaucggcaugggggucaccuaccuggcucuccuggccgcguuuaaagugcgcccuacauucgcugccggacugcuucugagaaagcucaccucuaaagagcugaugaugacgacaauuggcaucgugcuccugagccaauccaccauccccgagacaauucuugaacugaccgaugcccucgcucuggggaugaugguccugaagaucguucggaacauggagaaauaucagcuugccgugaccauuauggcgauccugugcgugccuaaugcugucauucuccagaacgccuggaaggugucuuguacaacgcuggccguugugagcgucagcccccuccugcuuaccagcucucaacagaaggcugacuggaucccucuggcccucacaaucaaaggacugaaucccaccgcuauuuuucugacaacccuuucccgcacgagcaagaaaagaucuuggccgcugaacgaagccaucauggcggugggcaugguuuccauucucgccagcucucugcucaagaaugauaucccuaugacagggccccugguggcuggaggccuucugaccgucugcuacgugcugaccggccgguccgccgaccucgagcuggaacgcgcugccgacgucagaugggaggagcaggccgaaauuagcggguccagcccuauccuuucuaucacaauuagcgaggauggauccaugucuaucaaaaacgaagaggaggaacagacccugacaauucucauccggacgggccugcucgugauuagcgggcuguuccccguuuccaucccgauuaccgcugcggccugguaucuuugggaggugaagaaacaacgcgcuggaguccugugggacgugccuucucccccucccguuggcaaggccgaacuggaggauggggccuacagaaucaagcagaaaggaauccucggcuauagccagauuggcgcugggguguacaaggaaggaacauuucacaccauguggcaugucacacggggcgccgugcugaugcacaaagggaagcgcaucgagcccuccugggcggacgugaaaaaggaucuuauuucuuacggaggcggguggaagcuggagggagaauggaaagagggcgaagagguucagguccucgcucuggaaccuggcaagaacccgagagccgugcaaaccaaacccggacucuucaagacgaauaccggaacaaucggcgccgugagccuggacuuuuccccugggaccagcggaucucccauugucgauaaaaagggcaaggugguugggcuuuauggaaacggcguggucacacgguccggcaccuacgugagcgcuaucgcccagacagagaaaaauaucgaggacaacccugaaauugaggaugacaucuucagaaagaaacgccugacgauuauggaucugcaucccggggcgggaaagaccaaacgguaucucccugcuaucguuagagaagccauuaagcgcggccugcggacacuuauccuggccccgaccagaguggucgcugccgagauggaagaggcucuccgcgggcugcccauccgguaccagaccccugccauuagagcggagcacacaggacgcgaaaucguggaccucaugugucaugccacguucaccaugcggcugcuuucucccauuagaguuccuaauuauaaccugaucauuauggaugaggcucacuuuacagaccccgccuccaucgcugcccggggcuacauuagcacccgcguggaaaugggggaggccgcuggcaucuucaugacagcgaccccgccuggauccagagaccccuuuccccagucuaaugccccuaucauggaugaggaacgggagauucccgaacgcagcuggaacuccggccacgagugggucacggacuucaaggggaaaacagugugguuugugccuagcaucaaggcuggaaaugauauugccgccugccugcgcaaaaauggcaagaaagucauccaacucucucggaagaccuucgacuccgaauauauuaagaccagaacaaaugauugggacuuuguugugaccacagauaucagcgagaugggggcuaacuucaaagccgagcgcgugaucgacccgcggagauguaugaagcccgucauucugaccgauggagaagaaagagugauccuugcgggcccuaugcccguuacgcauucuauugcugcccagcggagagggcgcgugggccggaauccuaaaaacgaaaaugaccaguacaucuacaugggagagccccuggaaaacgaugaggacugcgcccacuggaaggaggcuaaaaugcuccuggacaacauuaauacaccggaaggcaucaucccuagcauguuugagcccgaaagagagaaggucgaugccauugacggggaauaucgccugagaggagaggcgcggaaaaccuucguggaucucaugcgcagaggcgaccuuccuguuuggcuggccuaccggguggcugccgaggggaucaacuaugcugaucgcagaugguguuuugacggagucaagaauaaccaaauucuggaagagaauguggaagucgagaucuggacaaaggagggcgaacggaaaaagcucaaacccagauggcuggaugcccgcauuuacuccgacccucuugcucugaaggaguucaaagaguucgccgcggggcggaagucucucacccugaaccugaucacggagaugggcagacuccccaccuuuaugacacagaaggcccgcaaugcucuugauaaccuggccgugcugcauaccgcugaagccggaggccgggccuauaaucacgcucucagcgagcugccggagacacuugaaacccugcuccugcugacacuccuugcgaccguuacaggcgggauuuuccuguuucugauguccgggaaagggaucggaaagaugacacucggcaugugcugcaucauuaccgccucugugcugcuuugguacgcucagauccagccucacuggauugccgccagcaucauucuggaguucuuucucaucgugcugcugauccccgaacccgagaaacaaagaaccccucaggacaaccagcucacauaugucguuauugcuauccuuaccgugguggccgcgacaauggccaaugaaaugggcuuccuggagaagacgaaaaaggauuuugggcugggauccauugcuacccagcaaccggagagcaacauccucgacauugaucugcggcccgccucugcuuggacacuuuacgccgucgcgaccacauucaucaccccuaugcugcgccauuccaucgaaaauagcuccgugaacguuucucucacggccauugcuaaucaggccaccgugcugaugggccuggggaagggauggccccucagcaaaauggacaucggcgucccucuucuggcuauuggguguuacucccaggugaaccccaucacacugaccgccgcucuccugcuucuggucgcccacuaugcgauuaucggaccuggccuccaggccaaggcuacaagagaggcccaaaaacgggcugccgccggcauuaugaagaauccgaccguggacgggaucacgguuaucgaucuggaccccauuccuuacgaucccaaauuugaaaagcagcugggacaggugaugcuccuuguccugugcgugacacagguucugaugaugcgcaccacaugggcgcucugugaggcucugacccuugccaccggcccuaucucuacacugugggaagggaaccccggaagauucuggaacacgaccauugcugugagcauggccaauaucuuucggggcuccuaucucgccggggcuggacugcuguucagcauuaugaagaacacagccaauacccgcagaggcacaggcaacaccggggagacgcucggagagaaauggaagaaucggcuuaacgcgcugggcaaaucugaauuucaaaucuacaagaaauccgggauccaggaggucgaccgcacacuggccaaggaaggaauugagagaggcgagaccgaucaucacgcugugagccgggggucugccaaacucagaugcuucguggaacgcaaucugguuaccccggagggaaaggucguggaccuuggcuguggcagagggggaugguccuauuacugcggcgggcugaagaacgugaaagaagucaagggacucacaaaaggcgggccuggacaugaggaacccauccccaugagcaccuauggcuggaaucugguucggcugcagucuggcguggauguguucuuuacaccucccgagaagugugacacgcuccuuugcgauauuggggagagcuccccuaacccgaccgucgaagcuggacgcacacugcgggugcugaaucucguugagaacuggcugaaaaauaacacccaauucuguaucaaggugcuuaaucccuacaugccuucugucauugaaaagauggaggcccugcagagaaaauacggcggggcgcucgugcgcaacccccugagccggaacuccacacacgaaauguauuggguuagcaaugccuccggaaacaucgugucuagcgucaauaugaucuccagaaugcugauuaaccgcuuuaccaugcggcacaagaaagcuacguacgagccugacguggaucucggcucugggaccagaaauaucggaauugagagcgaaauccccaaccuugacauuaucggcaagcgcaucgagaaaauuaagcaggaacaugagacauccuggcacuaugaucaggaccauccguacaagaccugggccuaucacggcucuuacgaaacaaaacaaaccgggagcgcuuccagcauggugaauggagucguucggcugcugacaaagccuugggacgugauccccauggugacccagauggccaugacggauacaaccccuuucggccagcagagagucuuuaaagagaagguggacacccgcacacaagagcccaaagaagggacgaagaagcucaugaaaauuaccgcugaguggcuguggaaggaacuuggcaaaaagaaaacaccuagaaugugcacccgggaggaguucacacgcaagguuagaucuaacgccgcgcugggcgccaucuuuaccgaugaaaauaaauggaaguccgcucgggaggccguggaagacagcggguucugggagcucgucgauaaggaaagaaaccugcaccuggagggaaaaugugagacaugcguguauaauaugaugggcaagcgggagaaaaagcucggcgaguuugggaaagcuaagggaucucgcgccauuugguacauguggcugggcgccagauuccuugaauuugaggcgcugggguuccucaacgaagaccauugguuuucccgggagaauagccugucuggaguugagggcgaagggcuucacaagcugggcuacauccuccgcgauguguccaaaaaggagggaggcgcuauguaugccgacgauaccgccgggugggacacgagaauuacccuggaagaucugaaaaacgaggaaauggucacaaaucauauggagggagagcacaagaaacucgcugaagccaucuucaagcugaccuaccagaacaaggugguucgggugcagcgccccacaccgagaggcaccguccuugacaucauuagccggcgcgaccagagaggguccggacaaguggucacguauggccugaacacauucaccaauauggaggcucagcucauccggcagauggaaggggagggcguguuuaaaagcauucaacaucugacaguuaccgaggaaaucgccgugaagaacuggcuugcgcgcgucggaagagagcggcugucucgcauggccauuagcggcgaugacugcguggugaaaccucucgaugacagauucgcuuccgcccugacggcucugaaugauauggggaagguucggaaagacauccagcagugggaacccucuagaggauggaacgauuggacccaggugcccuuuuguagccaccacuuccaugagcucaucaugaaggacggccgcguccuggugguuccuugccggaaucaagaugaacuuauugggagagcccgcaucucccagggagcgggcuggucucugcgggagacagccugucucgggaaguccuacgcucagauguggucccugauguauuuucacagacgcgaccuucggcuggccgcuaacgccauuugcucugcugugccgagccauuggguccccaccuccagaacaaccuggagcauccacgccacacacgaguggaugaccacggaagauaugcucacaguguggaaucgcgucuggauucaggagaacccuuggauggaagacaaaacccccguggagucuugggaagagaucccuuaccugggcaagcgggaggaucaaugguguggaucccugaucggccucaccagcagagcgacaugggccaaaaauauucagaccgcuaucaaccagguucgcucucugauugggaaugaagaguauacagacuacaugcccuccaugaagcgguucagacgggaagaggaagaggccggagugcuuugguga

SEQ ID NO: 19533 - RNA, 9876 nt, Artificial Sequence
  derived and/or modified CDS sequence (opt5) from DENV-2__AB189124__SS-prME
accgccggagugaucauuaugaugauccccaccgucauggcuuuccaccugacgaccagaaacggggagccucauaugauuguuagccggcaggaaaagggaaaaucccuccuguuuaagacggagaauggcgugaacaugugcacccuuauggccauggaccugggggaacucugugaggauacaaucaccuacaauugcccgcugcuucgccaaaacgaacccgaggacauugauuguuggugcaauucuacaagcaccugggugacguauggaaccuguacagcgaccggcgagcacagacgggaaaaacgcuccgucgcucuggccccucauguggggaugggacucgagacaagaaccgaaacguggaugucuagcgagggcgccuggaagcacgcucagcggaucgagacauggguucugcgccaucccggcuucaccaucauggccgcuauucuggccuacacaaucgggaccaccuauuuucagagagugcucauuuucauccugcuuacagcggucgccccuuccaugacgaugcggugcauuggaaucucuaaccgcgacuuuguggaaggcguuagcgggggauccuggguggauauuguccuggagcacggcagcugugugaccacaauggcuaaaaauaagcccacccucgacuucgaacugaucaagacagaggccaaacacccugcuacccuuagaaaguacugcaucgaagccaaacugacgaacacaaccaccgcgucucgguguccgacacagggggagcccucccucaaugaggaacaagauaagcgcuuugugugcaaacauagcauggucgacagaggauggggcaacggcugugggcuguucggaaagggcgggauuguuaccugcgccauguuuacaugcaagaaaaauauggagggaaagguggugcagccugaaaaccuggaguauacgaucgucauuacaccccacucuggcgaagagaaugcuguggggaacgauacaggaaaacauggcaaggagaucaaaguuaccccucaguccagcauuacagaagccgagcucaccggcuacgggacggugaccauggaauguucuccccggacaggacuggacuucaaugagaugguccuucugcagauggaaaacaaggcuuggcucgugcaccgccaaugguuucuggaucuuccgcugccuuggcuccccggcgccgacacccagggguccaacuggauccagaaagagacacugguuaccuucaagaauccucacgccaagaaacaggauguggucgugcugggaagccaagagggcgcuaugcauacggcgcucacaggggccaccgaaauccagauguccucuggcaaccugcuuuuuacaggacaccugaagugcagacuccggauggacaaacugcagcuuaagggcaugagcuauuccauguguaccgggaaauucaaggucgugaaggagauugcugaaacccaacauggaacaaucguuauuagagugcaguacgagggcgacgggagccccugcaaaauccccuucgagauuauggaucuggaaaagcgccacguccucggacggcugaucacggugaauccuaucguuaccgagaaagacucuccggugaacauugaagccgagcccccuuuuggcgauuccuacaucauuaucggggucgaacccggccagcugaagcucaauugguucaaaaagggaagcucuauuggccagauguuugagacaaccaugagaggggccaagcgcauggcuauccugggagacacagccugggauuucggcagccuugggggaguguuuaccuccauuggcaaagcgcugcaucaaguguucggggcuaucuauggcgccgccuuuucuggaguuagcuggacgaugaagauccucauuggcgucgugaucacauggauugggaugaacucccggagcaccucucuguccgugagccugguccuugugggaguugugacccucuaccugggcgucauggugcaggcugacucuggguguguuguguccuggaaaaauaaggagcugaaaugcggaagcggcaucuucauuacagauaacguccacaccuggacagaacaguauaaguuucagccugagucccccucuaagcucgccagcgcuauccaaaaagcccacgaagaggggaucuguggcauuagauccgugacgcgccuggaaaaucuuauguggaagcagaucaccccggagcugaaccauauucucucugagaaugaaguuaaacugacaaucaugaccggagacauuaagggcaucaugcaggcggggaaacggagccugagaccucagcccacagagcuuaaguacuccuggaaagccuggggaaaggcuaagaugcucagcaccgaacugcacaaccauacguuccugaucgauggcccugagaccgccgaaugccccaauacaaaccgcgcuuggaacucucucgagguggaggacuauggguuuggagucuucaccacaaacauuuggcugaaacuuaaggaacggcaagauguguuuugugacuccaaacugaugagcgccgcgaucaaggacaacagagccgugcacgcugauaugggcuacuggauugagucugcccucaaugacaccuggaaaaucgaaaaggcuuccuucauugaggucaagagcugccacuggccuaaaucucauacacuguggagcaacggcguucuggaguccgaaaugaucauccccaagaauuucgccgggccggugagccagcacaacuaucgcccuggauaccauacccagacggccggccccuggcaccuugggaaacucgagauggauuuugacuucugugaaggaacaaccguggucgugaccgaggauugcggcaaucgggggcccucucugagaacaaccacggcuuccggaaagcugauuacagaauggugcugucggagcugcacccucccuccgcugcgcuacagaggcgaggacggcuguugguaugggauggagauccggccccuuaaagaaaaggaggaaaaccugguuaauucccucgugacagcgggacauggccagauugauaacuuuucucuggggguccugggaauggcccuuuuccucgaggaaaugcugagaacccgcgugggcacaaagcacgcuauccugcucguugccgugagcuuugucacccugauuacggggaauauguccuuccgggaccuuggaagagugaugguuauggugggcgccaccaugacagaugacaucggcaugggggucaccuaccuggcucuccuggccgcguuuaaagugcgcccuacauucgcugccggacugcuucugagaaagcucaccucuaaagagcugaugaugacgacaauuggcaucgugcuccugagccaauccaccauccccgagacaauucuugaacugaccgaugcccucgcucuggggaugaugguccugaagaucguucggaacauggagaaauaucagcuugccgugaccauuauggcgauccugugcgugccuaaugcugucauucuccagaacgccuggaaggugucuuguacaacgcuggccguugugagcgucagcccccuccugcuuaccagcucucaacagaaggcugacuggaucccucuggcccucacaaucaaaggacugaaucccaccgcuauuuuucugacaacccuuucccgcacgagcaagaaaagaucuuggccgcugaacgaagccaucauggcggugggcaugguuuccauucucgccagcucucugcucaagaaugauaucccuaugacagggccccugguggcuggaggccuucugaccgucugcuacgugcugaccggccgguccgccgaccucgagcuggaacgcgcugccgacgucagaugggaggagcaggccgaaauuagcggguccagcccuauccuuucuaucacaauuagcgaggauggauccaugucuaucaaaaacgaagaggaggaacagacccugacaauucucauccggacgggccugcucgugauuagcgggcuguuccccguuuccaucccgauuaccgcugcggccugguaucuuugggaggugaagaaacaacgcgcuggaguccugugggacgugccuucucccccucccguuggcaaggccgaacuggaggauggggccuacagaaucaagcagaaaggaauccucggcuauagccagauuggcgcugggguguacaaggaaggaacauuucacaccauguggcaugucacacggggcgccgugcugaugcacaaagggaagcgcaucgagcccuccugggcggacgugaaaaaggaucuuauuucuuacggaggcggguggaagcuggagggagaauggaaagagggcgaagagguucagguccucgcucuggaaccuggcaagaacccgagagccgugcaaaccaaacccggacucuucaagacgaauaccggaacaaucggcgccgugagccuggacuuuuccccugggaccagcggaucucccauugucgauaaaaagggcaaggugguugggcuuuauggaaacggcguggucacacgguccggcaccuacgugagcgcuaucgcccagacagagaaaaauaucgaggacaacccugaaauugaggaugacaucuucagaaagaaacgccugacgauuauggaucugcaucccggggcgggaaagaccaaacgguaucucccugcuaucguuagagaagccauuaagcgcggccugcggacacuuauccuggccccgaccagaguggucgcugccgagauggaagaggcucuccgcgggcugcccauccgguaccagaccccugccauuagagcggagcacacaggacgcgaaaucguggaccucaugugucaugccacguucaccaugcggcugcuuucucccauuagaguuccuaauuauaaccugaucauuauggaugaggcucacuuuacagaccccgccuccaucgcugcccggggcuacauuagcacccgcguggaaaugggggaggccgcuggcaucuucaugacagcgaccccgccuggauccagagaccccuuuccccagucuaaugccccuaucauggaugaggaacgggagauucccgaacgcagcuggaacuccggccacgagugggucacggacuucaaggggaaaacagugugguuugugccuagcaucaaggcuggaaaugauauugccgccugccugcgcaagaauggcaagaaagucauccaacucucucggaagaccuucgacuccgaauauauuaagaccagaacaaaugauugggacuuuguugugaccacagauaucagcgagaugggggcuaacuucaaagccgagcgcgugaucgacccgcggagauguaugaagcccgucauucugaccgauggagaagaaagagugauccuugcgggcccuaugcccguuacgcauucuagcgcugcccagcggagagggcgcgugggccggaauccuaaaaacgaaaaugaccaguacauuuacaugggagagccccuggaaaacgaugaggacugcgcccacuggaaggaggcuaaaaugcuccuggacaacaucaauacaccggaaggcauuaucccuuccauguuugagcccgaaagagagaaggucgaugccaucgacggggaauaucgccugagaggagaggcgcggaaaaccuucguggaucucaugcgcagaggcgaccuuccuguuuggcuggccuaccggguggcugccgaggggauuaacuaugcugaucgcagaugguguuuugacggagucaagaauaaccaaauccuggaagagaauguggaagucgagauuuggacaaaggagggcgaacggaaaaagcucaaacccagauggcuggaugcccgcaucuacucugacccucuugcucugaaggaguucaaagaguucgccgcggggcggaagucccucacccugaaccugauuacggagaugggcagacuccccaccuuuaugacacagaaggcccgcaaugcucuugauaaccuggccgugcugcauaccgcugaagccggaggccgggccuauaaucacgcucucuccgagcugccggagacacuugaaacccugcuccugcugacacuccuugcgaccguuacaggcgggaucuuccuguuucugaugucugggaaagggauuggaaagaugacacucggcaugugcugcaucaucaccgccagcgugcugcuuugguacgcucagauucagccucacuggaucgccgccuccauuauccuggaguucuuucucauugugcugcugauccccgaacccgagaaacaaagaaccccucaggacaaccagcucacauaugucguuaucgcuauucuuaccgugguggccgcgacaauggccaaugaaaugggcuuccuggagaagacgaaaaaggauuuugggcugggaagcaucgcuacccagcaaccggagucuaacauucucgacaucgaucugcggcccgccuccgcuuggacacuuuacgccgucgcgaccacauucauuaccccuaugcugcgccauagcaucgaaaauuccucugugaacguuagccucacggccaucgcuaaucaggccaccgugcugaugggccuggggaagggauggccccucuccaaaauggacauuggcgucccucuucuggcuaucggguguuacucucaggugaaccccauuacacugaccgccgcucuccugcuucuggucgcccacuaugcgaucauuggaccuggccuccaggccaaggcuacaagagaggcccaaaaacgggcugccgccggcaucaugaagaauccgaccguggacgggauuacgguuaucgaucuggaccccaucccuuacgaucccaaauuugaaaagcagcugggacaggugaugcuccuuguccugugcgugacacagguucugaugaugcgcaccacaugggcgcucugugaggcucugacccuugccaccggcccuauuagcacacugugggaagggaaccccggaagauucuggaacacgaccaucgcuguguccauggccaauauuuuucggggcagcuaucucgccggggcuggacugcuguucucuaucaugaagaacacagccaauacccgcagaggcacaggcaacaccggggagacgcucggagagaaauggaagaaucggcuuaacgcgcugggcaaauccgaauuucaaauuuacaagaaaagcgggauccaggaggucgaccgcacacuggccaaggaaggaaucgagagaggcgagaccgaucaucacgcugugucucggggguccgccaaacucagaugguucguggaacgcaaucugguuaccccggagggaaaggucguggaccuuggcugcggcagagggggauggagcuauuacuguggcgggcugaagaacgugaaagaagucaagggacucacaaaaggcgggccuggacaugaggaacccauucccaugucuaccuauggcuggaaucugguucggcugcagagcggcguggauguguucuuuacaccucccgagaagugcgacacgcuccuuugugauaucggggaguccucuccuaacccgaccgucgaagcuggacgcacacugcgggugcugaaucucguugagaacuggcugaaaaauaacacccaauucugcauuaaggugcuuaaucccuacaugccuagcgucaucgaaaagauggaggcccugcagagaaaauacggcggggcgcucgugcgcaacccccugucccggaacagcacacacgaaauguauuggguuuccaaugccucuggaaacauugugagcuccgucaauaugaucucuagaaugcugaucaaccgcuuuaccaugcggcacaagaaagcuacguacgagccugacguggaucucggcagcgggaccagaaauauuggaaucgaguccgaaauucccaaccuugacaucauuggcaagcgcaucgagaaaaucaagcaggaacaugagacaucuuggcacuaugaucaggaccauccguacaagaccugggccuaucacggcagcuacgaaacaaaacaaaccggguccgcuagcucuauggugaauggagucguucggcugcugacaaagccuugggacgugauucccauggugacccagauggccaugacggauacaaccccuuucggccagcagagagucuuuaaagagaagguggacacccgcacacaagagcccaaagaagggacgaagaagcucaugaaaaucaccgcugaguggcuguggaaggaacuuggcaaaaagaaaacaccuagaauguguacccgggaggaguucacacgcaagguuagauccaacgccgcgcugggcgccauuuuuaccgaugaaaauaaauggaaaagcgcucgggaggccguggaagacucuggguucugggagcucgucgauaaggaaagaaaccugcaccuggagggaaaaugcgagacauguguguauaauaugaugggcaagcgggagaaaaagcucggcgaguuugggaaagcuaagggaucccgcgccaucugguacauguggcugggcgccagauuccuugaauuugaggcgcugggguuccucaacgaagaccauugguuuagccgggaaaauucucuguccggaguugagggcgaagggcuucacaagcugggcuacauucuccgcgaugugagcaaaaaggagggaggcgcuauguaugccgacgauaccgccgggugggacacgagaaucacccuggaagaucugaaaaacgaggaaauggucacaaaucauauggagggagagcacaagaaacucgcugaagccauuuucaagcugaccuaccagaacaaggugguucgggugcagcgccccacaccgagaggcaccgucauggacaucaucucccggcgcgaccagagagggagcggacaaguggucacguauggccuuaacacauucaccaauauggaggcucagcugauucggcagauggaaggggagggcguguuuaaaucuauccaacaucucacaguuaccgaggaaauugccgugaagaacuggcuggcgcgcgucggaagagagcggcuuagccgcauggccaucuccggcgaugacugcguggugaaaccucuggaugacagauucgcuucugcccucacggcucugaaugauauggggaagguucggaaagacauucagcagugggaacccagcagaggauggaacgauuggacccaggugcccuuuugcucccaccacuuccaugagcugaucaugaaggacggccgcguccucgugguuccuugucggaaucaagaugaacugaucgggagagcccgcauuucucagggagcgggcuggagccuucgggagacagccugccuggggaaguccuacgcucagauguggucucucauguauuuucacagacgcgaccugcggcuugccgcuaacgccaucuguagcgcugugccgucccauuggguccccaccagcagaacaaccuggucuauucacgccacacacgaguggaugaccacggaagauaugcugacaguguggaaucgcgucuggauccaggagaacccuuggauggaagacaaaacccccguggaguccugggaagagauuccuuaccucggcaagcgggaggaucaauggugcggaagccugaucggccugaccucuagagcgacaugggccaaaaauauccagaccgcuauuaaccagguucgcucccucaucgggaaugaagaguauacagacuacaugcccagcaugaagcgguucagacgggaagaggaagaggccggagugcugugguga

SEQ ID NO: 19534 - RNA, 9876 nt, Artificial Sequence
  derived and/or modified CDS sequence (opt5) from DENV-2__AB122020__SS-prME
acagccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaagaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggugcugaaaauuguccggaacauggaaaaguaccaacucgccgugaccaucauggcgaucucuugcguuccuaaugcugugauucugcagaacgccuggaaggucagcuguacaauccucgccgcuguguccgugagcccccugcuucugaccucuucccagcagaaagccgacuggauuccucucgcucugacaaucaagggccugaaucccaccgccauuuuucuuacgacacugagccgcaccucuaaaaagagauccuggccgcucaacgaggcgaucauggccgucgggaugguuagcauccuggcuucuucccuccugaaaaaugacauuccuaugaccggaccccuuguggccggcggccugcugacagugugcuauguccucaccgggcggagcgcugaucuggaacuugagcgcgccgccgacgugaagugggaggaucaagcugaaaucuccggaagcucuccuauucugagcaucacaauuuccgaggacggcucuaugagcaucaaaaacgaagaggaggaacagacgcucaccauucugaucagaacagggcuccugguuaucuccggaguguuccccgucucuauuccgaucaccgcggccgcuugguaccuuugggaggugaagaagcagcgggccggcguucugugggaugugccuucucccccucccgucgggaaagccgaacuggaggacggagcuuaucgcauuaagcagagaggcauccucggcuacucccaaauuggggccggaguguauaaagaaggcacauuucacaccauguggcaugucacgagaggggcggugcugaugcaccgcggaaagagaaucgagcccuccugggcugauguuaaaaaggaccuuaucagcuacggcgggggauggaagcuggagggcgaauggaaagagggcgaagaggugcagguccucgcccuggaaccugggaagaauccgcgggccgugcagaccaaacccggaauuuucaagacaaacaccggcacaaucggggcuguuucccucgauuuuagcccuggaaccucuggcucccccauuguggacagaaaagggaaggucgugggacuguacggcaauggcgugguuacacgcagcggggccuaugucucugcgaucgcucagacggagaaguccauugaggauaacccugaaaucgaggacgauaucuuccggaaaaagagacuuaccauuauggaccugcaucccggagccggcaaaacaaagcgcuaccugccugccaucgugcgggaagcuauuaaaagagggcuccgcacccugauccuugccccgacccggguggucgcugccgagauggaagaggcgcugagaggacuccccauucgcuaucaaaccccugccauccgggcugagcacacgggcagagaaauuguggaccugaugugucaugccaccuucacaaugcggcuccugagccccguucgcgugccuaacuacaaucuuaucaucauggaugaggcucacuuuaccgaccccgccuccauugccgcuagaggguauaucucuacacgggucgaaaugggcgaggcggccggaauuuucaugaccgcuacgccgccuggcagccgcgaucccuuuccccaguccaacgccccuaucauggacgaggaaagagagauucccgaacggagcuggaacucugggcacgagugggugacagauuucaagggaaagaccguuugguuugugccuuccaucaaagccggcaacgacaucgcugccugccugagaaagaaugggaaaaaggucauucagcugagccgcaaaaccuucgauucugaauacgugaagacacgggcgaacgacugggauuuuguugugaccacagacaucagcgagaugggagcuaauuucaaggccgagagagucauugauccgcgccgguguaugaaacccgugauccucaccgacggcgaagagagagugauucuggccgggccuaugcccgucacgcauuccucugcugcccaacgccggggcagaaucggacgcaacccuaagaaugaaaacgaccaguauaucuacaugggcgagccccuugaaaaugaugaggacugcgcgcacuggaaagaggccaagaugcugcucgauaacauuaauacaccggaagggaucauuccuagcauguuugagcccgaaagagagaaaguugacgcuaucgauggagaauaccggcugcgcggcgaggccagaaagaccuucguggaccugaugcggcgcggggaucucccuguguggcuugcuuauaaagucgccgcugagggaauuaacuacgccgacagaaagugguguuuugauggcaucaagaauaaccagauucuggaagagaacguggaaguugagaucuggacaaaagagggggaacggaagaaacugaagcccagauggcucgacgcgcgcaucuauuccgauccucuggcccuuaaagaguucaaggaguucgcugccggccggaagucucugacccucaaucugauuacggagaugggaagacugcccaccuuuaugacacagaaagcucgcaacgcccucgacaaucuugccgugcugcauaccgcugaagucggcgggcgggcguacaaccacgcccugagcgagcucccggagacacuggaaacccuucugcuccugacacugcucgcuaccgugacgggaggcaucuuccuuuuucugauguccgggaagggaauuggcaaaaugacacugggcaugugcugcaucauuaccgccagcauccuccugugguaugcccaaauccagccucacuggauugcugccucuaucauucuugaguucuuucugaucguucuccugauucccgaacccgagaagcagagaaccccucaggauaaucaacugacauacguggucaucgcgauccucaccguggucgccgcuacaauggccaacgaaaugggguuccuugagaaaacgaagaaggaccugggauuuggcuccauuaccacacaggagagcgaauccaauauccuggacauugaucuccggccggcuucugccuggacccuguaugcgguggccacaaccuucguuacgcccaugcuucgccauagcaucgagaacuccucugugaaugugagccugaccgcuauugccaaccaggcuacaguccucauggggcugggaaaaggcuggccucuguccaagauggacaucgggguuccccuccuugccauuggauguuacagccaggugaauccuaucacccugacagcugcccugcuccugcuuguggcgcacuacgccaucauuggccccggccugcaagcuaaagccaccagagaagcucagaagcgggccgccgcggggaucaugaaaaacccuacggucgauggaauuacagugaucgaccucgagccgauucccuaugauccuaaguuugaaaagcagcugggccagguuaugcugcucauccuuugcgugacccaaguccugaugaugcgcacaaccugggcucugugugaggcccucacccuggcuacagggcccaucucuacgcuuugggagggaaauccuggcagauucuggaacaccacaauugccguguccauggccaauaucuuucgggggagcuaccuggcuggagccggccuccuguucucuauuaugaaaaacaccacaaauacccgcagaggcacggggaacgucggagaaacacugggcgagaaguggaaaucccggcucaacgcgcuuggaaagagcgaauuucagaucuauaaaaagucuggcauucaggagguggaccgcacccuggccaaagagggcaucaagagaggggaaaccgaucaucacgcuguuagccggggauccgccaagcugagaugguucguggagcgcaauauggucacacccgaaggcaaagugguugaccucggcugcgggcggggaggcuggucuuacuauugugggggacugaagaacgugagagaggucaaaggccuuaccaaagggggaccgggccaugaggaaccuauccccaugagcacauacggcuggaaucuggugcgccuccaauccgggguggauguuuucuuuacgcccccugagaaaugcgacacccugcugugugauauuggagaaagcucccccaacccuacaaucgaggcuggccggacccucagaguccuuaaucugguggaaaacuggcugaauaacaauacacaguucugcauuaaggugcucaacccguauaugcccucugucaucgagaagauggaaacccugcagcgcaaauacgggggagcccuuguucggaauccucugagcagaaacuccacgcacgagauguacugggugucuaaugcgaccggcaacauugugagcuccgucaauaugaucucucgcaugcucaucaaccgguuuacaaugaagcacaaaaaggccaccuaugagcccgacguggaucuggggagcggaacaagaaacauuggcaucgaauccgagauuccuaaucuggacaucauuggcaaacgcaucgaaaagauuaagcaggagcaugaaaccagcuggcacuacgaccaagaucaucccuauaaaacaugggcuuaccacgggucuuaugagaccaagcagacgggauccgccagcucuaugguuaacggcgugguccggcuccuuacaaaaccgugggacgugguuccuauggugacccagauggcuaugaccgauacaacgcccuucgggcagcaaagagucuuuaaggagaaaguggacacccgcacacaggaaccuaaggagggaaccaagaaacugaugaagaucacagccgaauggcuguggaaagagcucggcaaggagaaaacccccagaauguguacacgggaagaguucacccgcaaggugagauccaaugcugcccugggggcgaucuuuacggaugaaaacaaauggaaaagcgcccgggaggcugucgaagacggaagauucugggagcuuguugaucgggagcgcaaucugcaccucgaaggcaagugcgagaccuguguguacaacaugaugggcaaaagagaaaagaaacugggggaguuuggaaaggccaaaggcucucgggcuauuugguauauguggcugggggcccgcuuccucgaauuugaggcccugggauuccuuaaugaggaccauugguuuuccagaggcaacagccuguccgggguggaaggcgagggacuccaccggcugggcuacauccuucgcgaagucgggaagaaggagggaggcgcgauguacgcugaugacacagccgggugggauaccagaauuacacuggaagaccucaaaaaugaggagauggugaccaaccauaugaagggagaacacaaaaagcuggccgaggcuaucuucaaacugacguaucagaauaagguugugcggguccagcgcccuacacccagaggcaccgugauggacauuaucagccggaaggaucaacgcgggucuggccagguuggaacauacggccucaacaccuucacgaauauggaagcccagcugaucagacaaauggagggggagggaauuuuuaaaagcauccagcaucuuaccgcuacagaagagauugccgugcagaacuggcuggcgcgggucggccgcgaaagacucucccggauggccaucucuggggacgauugcgugguuaagccgauugacgauagauucgcuagcgcccugaccgcucuuaaugacaugggaaaagugcgcaaggauauccagcaaugggagccuucccggggcuggaacgacuggacacagguccccuuuugcucucaccacuuccaugaacuggugaugaaagaugggagaguccucgugguucccugucgcaaccaggacgagcugaucggccgggccagaauuagccagggagcgggcuggucccugaaggagaccgccugccucgggaagucuuaugcucaaauguggacacugauguacuuucaccgccgggaucuuagacuggccgcuaaugccaucuguagcgcugugccuucccauugggucccgaccagccgcacgacauggucuauucacgccaaacacgaauggaugaccaccgaggacaugcucgcgguguggaaccggguguggauccaggaaaaucccuggauggaggauaagacaccuguugaauccugggaggaggugcccuaucugggaaaaagagaagaccaguggugcggcagccuuauugggcugaccucucgcgccacaugggcuaagaacauccagacggccauuaaucaaguccggucccucaucggaaacgaggaauacaccgacuauaugccuagcaugaaaagauuccggagagaggaagaggaggccggcgugcugugguga

SEQ ID NO: 19535 - RNA, 9876 nt, Artificial Sequence
  derived and/or modified CDS sequence (opt5) from DENV-2__LC121816__SS-prME
accgugggaaugaucauuaugcugauccccaccgccauggcuuuccaccugacgaccagaaauggggaaccucauaugauugucucccggcaggaaaagggaaaaucccugcuuuuuaagacggaagacggcguuaauaugugcacccugauggccauggaucuuggggaacugugugaggacacagugaccuacaauugcccgcuucugagacaaaaugaacccgaggauaucgacuguuggugcaacucuacaagcaccugggugacguauggaaccuguacagcgaccggcgagcacagacgggaaaaacgcuccgucgcucucgugccucauguugggaugggacuggagacaagaaccgaaacguggaugucuagcgagggcgccuggaagcacgcccagcggauugagacauggauccugcgccaucccggcuucaccaucauggcugccauucucgcucacacaaucgggaccaccuacuuucagagagugcugauuuucauccuucugacagccgucgcgccuuccaugacgaugcggugcauuggaaucucuaaucgcgauuuuguggaaggcguuagcgggggauccuggguggacauuguccucgagcacggcagcugugugaccacaauggccaaaaacaagcccacccuggauuucgaacuuaucaagacagaggcuaaacagccugccacccugagaaaguauugcaucgaagcuaaacucacgaauacaaccaccgccucucgguguccgacacaaggggagcccucccugaacgaggaacaggacaagcgcuuugugugcaaacauagcauggucgauagaggauggggcaauggcugugggcuguucggaaagggcgggauuguuaccugcgcgauguuuacaugcaagaaaaacauggagggaaagaucgugcagccugaaaaucucgaguacacgauugugaucacaccccacucuggcgaagagaacgccgucgggaaugacacaggaaaacauggcaaggaggugaaaguuaccccucaguccagcauuacagaagcugagcugaccggcuaugggacggugaccauggaauguucuccccggacaggacuugauuucaacgagaugguccugcuccaaauggaaaauaaggccuggcuggugcaccgccagugguuucuugaccugccgcucccuuggcugcccggcgcugauacccagggguccaacuggauccagaaagagacacugguuaccuucaagaacccucacgccaagaaacaagacguggucgugcucggaagccaggagggcgccaugcauacggcucugacaggggcgaccgaaauccagauguccucuggcaaucuucuguuuacaggacaccucaagugcagacugcggauggacaaacuucaacugaagggcaugagcuacuccauguguaccgggaaauucaaggucgugaaggagauugccgaaacccagcauggaacaaucguuauuagagugcaguaugagggcgaugggagccccugcaaaauccccuucgagauuauggaccucgaaaagcgccacguccugggacggcugaucacggugaacccuaucguuaccgagagagauucuccggugaauauugaagcugagcccccuuuuggcgacuccuacaucauuaucggggucgaacccggccagcucaaacugagcugguucaagaaaggaucuagcauuggccaaauguuugagacaaccaugcgcggggccaagcggauggccauccuuggagauacagcuugggacuucggcucccucgggggaguguuuaccucuauuggcaaggcccuccaucagguguucggggcgaucuacggcgcugccuuuagcggaguuuccuggacgaugaaaauccugauuggcgucgugaucacauggauugggaugaacagcagaucuaccucccugagcgugucucuuguccucgugggaguugugacccuguaucugggcgucauggugcaggccgauuccggguguguugugagcuggaagaauaaagagcucaagugcggauccggcaucuucauuacagacaacguccacaccuggacagaacaguacaaauuucaaccugagucucccagcaagcuggcuuccgccauccagaaggcuuaugaagaggggaucuguggcauucgcucugugacgcggcuugaaaaucugauguggaaacagaucaccccggagcucaaccacauucugagcgagaaugaaguuaagcugacaaucaugaccggagauauuaaaggcaucaugcaggccgggaagagaucccuucgcccucaacccacagagcucaaauacagcuggaagaccuggggaaaagcgaagaugcugucuacggaacaucacaaccagacccugcucaucgacggcccugagacagccgaaugccccaauaccaaccgggcuuggaacucccuggagguggaggauuauggguucggagucuuuacaaccaacauuuggcuuaagcugaaagaaagacaggacguguucugugacagcaagcucaugucugccgcuaucaaagauaaucgcgccgugcaugcggacaugggcuacuggauugaguccgcccugaacgauacauggaagaucgaaaaagcuagcuuuauugaggucaagucuugccacuggccuaagagccacacccugugguccaacggcguucuugagagcgaaaugaucauccccaaaaauuucgccgggccggugucucagcauaacuaucggccuggauaccacacgcaaacagcuggccccuggcaucucgggaagcuggagauggacuucgauuuuugugaaggaaccaccguggucgugacagaggacugcggcaauagagggcccucccugcggaccacgacagccagcggaaaacucauuaccgaauggugcugucgcuccugcacacugccuccgcuuagauaccggggcgaggauggcuguugguaugggauggagaucagaccccugaaggaaaaagaggaaaaccucguuaauucucuggugaccgccggacacggccagauugacaacuucagccuggggguccuuggaauggcucucuuucuggaggaaaugcugcgcacacgggugggcaccaagcaugcgcuccugcuuguugccguguccuucaugacgcugaucaccgggaauaugucuuuuagagaucucggacgcgucauggugaugguuggcgcugccaugacagacgauauuggcaugggggugaccuaccuggcccugcuugcugccuucaaggucagaccuacauuugcggcuggacugcuccugcggaaacucaccagcaaggagcugaugaugacgacaaucggcauugugcuucugucccagucuaccauccccgagacaauccucgaacugaccgacgcccuggcccuugggaugaugauucugaaaaucgugcgcaacauggagaaguaucaacucgcugucaccauuauggccauccugugcguuccuaaugcggugauucuccagaacgcuuggaaagugagcuguacaauccuggccgucguguccguuacgccccuucugcucaccagcucuagacagaaggccgauuggaucccucuggcucugacaauuaagggacuuaaucccaccgccaucuuccugacaacccucucccggacgaacaaaaagcgcagcuggccgcugaaugaagcuauuauggccgugggcauggucucuauccucgcguccagccugcuuaaaaacgacauuccuaugacagggccccugguggccggaggccugcucaccguuugcuacgugcugaccggcagaucugcugaccuugagcuggaacgggccgcugauguccgcugggaggaccaggccgagaucuccgggagcuccccuauccucagcauuacaaucucugaagauggaagcauguccauuaagaaugaggaagaggagcaaacccugacaauccucauuagaacgggccugcuugugaucucugggcuguuucccgucagcauuccgaucaccgccgcugcgugguaucugugggaagugaaaaagcagcgggccggaguucucugggacgugccuucucccccucccgucggcaaagcugagcuggaagauggggccuaccgcaucaagcagaagggcauucuuggcuauagccagaucggcgccgggguguacaaagagggaacauuccacaccauguggcacguuacaagaggcgcugugcugaugcauaaggggaaacggauugaacccagcugggccgacgucagaaaggaucucaucuccuacggaggcggguggaaacuggagggagaguggaaggaaggcgaggaagugcaagugcucgcgcuggagccuggcaagaacccgcgcgcuguucagaccaaacccgggcuuuuuaagacggacaccggaacaauuggcgccgucucucuggauuucagcccugggaccuccggaagccccaucguggacaaaaagggcaaaguggucgggcuguauggaaacggcgugguuacacggucuggcaccuacguguccgccaucgcucagacagaaaagagcauugaggauaauccugagaucgaagacgauauuuuuagaaagcgccggcucacgaucauggaccugcaccccggggccggaaaaaccaagagauaucuuccugcgauuguccgcgaggcuaucaaacggggccugagaacacucauccuggccccgacccgcgugguugccgcugaaauggaggaagcccuccgggggcugcccauuagauaccagaccccugcuauccgggccgagcauacaggacgcgagauuguggaccuuaugugucacgcgacguucaccaugagacugcugucucccguccgggugccuaacuauaaucucaucauuauggaugaagcccauuucacagaccccgcuuccaucgccgcucgcggcuacauuagcaccagaguugagaugggggaagccgccggcaucuuuaugacagcuaccccgccuggaucccgggaucccuucccccaaucuaacgcgccuaucauggacgaggagagagaaauucccgagcgcagcuggaacuccggccacgaaugggugacggauuuuaaggggaaaacagucugguucgugccuagcaucaaggccggaaacgacauugcugccugccugcggaagaauggcaaaaaggugauccagcuuucuagaaaaaccuuugauuccgaguauauuaagacccgcacaaacgacugggauuucgucguuaccacagacaucagcgaaaugggggccaauuuuaaagcugagcgggugaucgauccgagacgcuguaugaagcccgugauucugaccgacggagaggaacgggucauccucgccggcccuaugcccgugacgcacucuagcgcggcucagagacgcgggagaauuggccggaacccuaagaaugagaacgaccaauacaucuacaugggagaaccccuggagaaugaugaagacugcgcccauuggaaagaggccaagaugcugcucgauaacauuaauacaccggagggcaucaucccuuccauguucgaacccgagcgcgaaaaaguugacgcuauugauggggaguauagacuucggggagaagcccgcaagaccuuuguggaccugaugagacggggcgaucugccugucuggcucgcguacagaguggccgcugaggggaucaacuaugccgaccgccggugguguuucgauggaguuaaaaacaaucagauucuggaggaaaacguggaggucgaaaucuggacaaaggagggcgagcgcaagaaacuuaagccccgcuggcuggacgcucggauuuacucugauccucucgcccugaaagaauuuaaggaguucgcugccgggagaaaaagccugacccucaaucuuaucacggaaaugggccggcugcccaccuucaugacacagaaggcgcgcaacgcccuggacaaucucgcugugcugcacaccgccgaggcuggaggcagagccuauaaccaugcccuuuccgaacugccggagacacucgagacccugcugcuccuuacacugcuggcuaccgucacagggggaauuuuucucuuccugaugucuggcaaagggaucggaaagaugacacuuggcaugugcugcaucauuaccgcgagcauccugcucugguacgcccagauucaaccucacuggaucgcugccuccauuauccuggaauuuuuccugaucgugcuccuuauucccgagcccgaaaagcagcggaccccucaggauaaucagcugacauauguugugaucgccauucugaccguggucgcugccacaauggcgaacgagaugggcuuucucgagaagacgaagaaagacuucgggcugggaagcaucgccacccaacagccggagucuaauauucuugacaucgaucugcgccccgcuuccgccuggacacucuacgcuguugccaccacauuuaucaccccuaugcugagacacagcauugagaacuccucugugaaugugagccugacggcgaucgccaaccaggcuaccguccucaugggccuugggaagggauggccccuguccaaaauggacauuggcgugccucugcucgccaucggguguuacucucagguuaaucccauuacacugaccgcugcccuucugcuccugguggcucauuaugccaucauuggaccuggccugcaagcgaaggccacacgggaagcucagaagcgcgccgcugccggcaucaugaaaaacccgaccgucgaugggaucacggugauugaccucgaucccaucccuuacgaccccaaguucgagaaacagcuuggacaggucaugcugcuggugcucugcguuacacaagugcugaugaugagaaccacaugggcccuuugugaagcgcugacccucgcuaccggcccuauuagcacacugugggaggggaaucccggacgguuuuggaacacgaccaucgccgucuccauggcuaauauuuuccgcggcagcuaucuggccggggccggacuccucuuuucuaucaugaagaacacaaccaacacaagacggggcaccggcaauacgggggaaacacugggagagaaauggaagaacagacugaaugcucucggcaaguccgaguuccagaccuacaaaaagagcgggauccaggaaguggaucgcacccuggccaaagagggaauuaagcggggcgaaacagaccaccaugcgguuucuagaggguccgccaaacuucgcugguuuguggagcggaaccuggucaccccggagggaaaggugguggaucucggcugcggcagagggggauggagcuauuacuguggcgggcugaaaaauguucgcgaagucaagggacugacaaagggcgggccuggacacgaggaacccauccccaugucuacguauggcuggaaccucgugcggcuucaaagcggcguggacgucuucuucaccccucccgagaaaugcgauacacugcugugugacauuggggaauccucuccuaauccgaccguugaggcuggaagaacacuccgcgugcugaaccuuguggagaauuggcugaacaauaacacccaguuuugcaucaagguccucaaucccuacaugccuagcgugauugagaagauggaggcccugcagcggaaguacggcggggcucugguuagaaacccccucucccgcaauagcacgcaugaaauguauuggguguccaacgccucuggaaacaucgucagcuccgugaauaugaucucucggaugcuuauuaacagauucaccaugcgccacaaaaaggcgacauacgagccugauguugaccugggcagcgggaccagaaauaucggaauugaauccgagacacccaaccuggacaucauuggcaagcggaucgagaaaauccgccaggaacacgagaccucuuggcauuaugaucaagaccacccguacaagacaugggccuaucauggcagcuacgaaaccaaacagacgggguccgcuagcucuauggugaauggagucgugagacuccugacaaagccuugggaugugauucccauggucacccagauggccaugaccgacacaacgccuuuuggccagcaacggguuuucaaagagaagguggauaccagaacacaggaacccaaggaggggaccaagaaacuuaugaaaaucacagcuaaguggcuguggaaagagcucggaaagaagaaaaccccucggauguguacacgcgaagaguuuaccagaaaggugcgguccaacgccgcucugggcgccauuuucacggacgaaaauaaauggaaaagcgcgcgcgaggccgucgaggauucuagauuuugggaacugguggacaaagagcggaaccuccaccuggaagggaagugcgagaccuguguuuauaauaugaugggaaaacgcgaaaagaaacuuggcgaguucggcaaagcuaagggguccagagccaucugguacauguggcugggagcucgguuucucgaguucgaagcccugggcuuucuuaacgaggaucacugguucagccgcgaaaauucucuguccgggguggagggagaaggccuccauaaacugggguacauucugagagacgucagcaagaaagagggcggagccauguaugcggaugacacagcuggcugggacacccggaucacacucgaggaucugaagaacgaagagauggugaccaaucacauggaaggggagcauaagaaacuugccgaagccauuuuuaagcugacguaccagaacaaaguugugcgcguccagagacccacaccgcggggaaccgugauggacaucaucucccgcagagaucaacggggcagcgggcagguuggaacauauggccucaauaccuucacgaacaugggggcucagcugauuagacaaauggagggcgagggaguguucaagucuauccagcaccuuaccgccacagaagagauugcuguccaggacuggcuggcccgcgugggccgggaaagacucagccgcauggcgaucuccggggaugacugcgucgugaaaccucuggaugaccgguuugccucugcucugaccgcccucaacgauaugggaaagguuagaaaggacauucagcaaugggagcccagccgcggcuggaaugauuggacacaggugcccuucugcucccaucacuuucacgagcugaucaugaaagacgggcggguccuuguggugccuuguagaaaccaggaugaacugaucggacgcgcucggauuucucagggcgccggguggagccucagagagaccgcgugccugggcaaguccuacgcccaaauguggucucuuauguauuuccaucgccgggaccugagacucgcugccaaugcuaucuguagcgccguuccgucccacugggugcccacaagccggaccacguggucuauucaugcuaaacacgaauggaugacaaccgaggacaugcugaccgucuggaacagaguguggauccaggaaaauccuuggauggaggauaagacacccguugaguccugggaagagauuccuuaccugggaaaacgcgaagaccaguggugcggcagccucaucgggcugaccucucgggccacaugggcgaagaacauccagacggccauuaaucaagugagaucccuuaucggaaacgaggaauauaccgauuacaugcccagcaugaagcgcuuuagacgggaggaggaagaggcuggcguccugugguga

SEQ ID NO: 19536 - RNA, 9876 nt, Artificial Sequence
  derived and/or modified CDS sequence (opt5) from DENV-2__LC111438__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccacccacuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacauccugccacccuuagaaaguauugcauugaagcuaaacugacgaacacaaccaccgccucucgguguccgacacagggggagcccucccucaaugaggaacaagauaagcgcuuugugugcaaacacagcauggucgacagaggauggggcaacggcugugggcuguucggaaagggcgggaucguuaccugcgcgauguuuacaugcaagaaaaauauggagggaaagguggugcagccugaaaaccuggaguacacgauugucaucaccccccauucuggcgaagagaaugccguggggaacgauacaggaaaacacggcaaggagauuaaaguuaccccucaguccagcaucacagaagcugagcucaccggcuaugggacggugaccauggaauguucuccccggacaggacuggacuucaaugagaugguccuucugcagauggaaaacaaggccuggcucgugcaccgccaaugguuucuggaucuuccgcugccuuggcuccccggcgcugacacccagggguccaacuggauccagaaagagacacugguuaccuucaagaauccucaugccaagaaacaggauguggucgugcugggaagccaagagggcgccaugcacacggcucucacaggggcgaccgaaauucagauguccucuggcaaccugcuuuuuacaggacaucugaagugcagacuccggauggacaaacugcagcuuaagggcaugagcuacuccauguguaccgggaaauucaaggucgugaaggagaucgccgaaacccaacacggaacaauuguuaucagagugcaguaugagggcgacgggagccccugcaaaauucccuucgagaucauggaucuggaaaagcgccauguccucggacggcugaucacggugaauccuauuguuaccgagaaagacucuccggugaacaucgaagcugagcccccuuuuggcgauuccuacauuaucauuggggucgaacccggccagcugaagcucagcugguucaaaaagggaucuagcaucggccagauguuugagacaaccaugagaggggccaagcgcauggccauucugggagacacagcuugggauuucggcucccuugggggaguguuuaccucuaucggcaaagcccugcaccaaguguucggggcgaucuacggcgcugccuuuagcggaguuuccuggacgaugaagauucucaucggcgucgugauuacauggaucgggaugaauagccggucuaccucccugagcgugucucugguccuugugggaguugugacccucuaucugggcgucauggugcaggccgacuccggguguguugugagcuggaaaaacaaggagcugaaaugcggauccggcauuuucaucacagauaauguccacaccuggacagaacaguacaaguuucagccugagucucccccgaagcucgcuagcgccauccaaaaagcucaugaagaggggauuuguggcaucagauccgugacgcgccuggaaaaccuuauguggaagcagauuaccccugagcugaaucacauccucucugagaacgaaguuaaacugacaauuaugaccggagacaucaagggcaucaugcaggccgggaaacggagccugagaccccagccuacagagcuuaaguauuccuggaaagcguggggaaaggccaagaugcucagcaccgaacugcauaaucacacguuccugauugauggccccgagaccgcugaaugcccuaacacaaaucgcgccuggaacucucucgagguggaggacuacggguuuggagucuucaccacaaauaucuggcugaaacuuaaggaaaaacaagauguguuuugugacuccaagcugaugagcgcugccauuaaagacaaccgggcggugcacgccgauaugggcuauuggaucgagucugcucucaacgacaccuggaagauugaaaaggccuccuucaucgaggucaaaagcugccauuggcccaagucucacacacuguggagcaauggcguucuggaguccgaaaugaucauuccgaaaaacuucgcugggccugugagccagcauaauuacagacccggauaucacacccagacggccggccccuggcaucuugggucucucgagauggauuuugacuucugugaaggaacaaccguggucgugaccgaggauugcggcaaccgcgggccuucccugcggacaaccacggccagcggaaagcugaucacagaauggugcuguagauccugcacccucccgccccugcgguaccgcggcgaggacggcuguugguacgggauggagauuagaccucuuaaagaaaaggaggaaaaucugguuaacucucucgugacagcuggacacggccagaucgauaauuuuagccuggggguccugggaauggcgcuuuuccucgaggaaaugcugcggaccagagugggcacaaagcacgccauucugcucguugcuguguccuuugucacccugaucacggggaacaugucuuuccgcgaccuuggacgggugaugguuauggugggcgccaccaugacagaugacauuggcaugggggucaccuaucuggcccuccuggcugccuuuaaaaucagacccacauucgcggcuggacugcuucugcgcaagcucaccagcaaagagcugaugaugacgacaaucggcauugugcuccugucccaaucuaccaucccugagacaauucuugaacugaccgaugcccucgcccuggggaugauggugcugaagaucgucagaaauauggagaaauaccagcuugcuguuaccauuauggccauccugugcgugcccaacgcggugauccuccagaaugcuuggaaggucagcuguacaacgcuggccgugguuuccgugagcccucuccugcuuaccucuucccaacagaaggccgacuggauuccccuggcucucacaaucaaaggacugaacccgaccgccauuuuucugacaacccuuagccggacgucuaagaaacgcuccuggccucugaaugaagcuaucauggccgucggcauggugagcauucucgcgucuucccugcucaagaacgauauccccaugacagggccucugguugccggaggccuucugaccgugugcuauguccugaccggcagaagcgcugaccucgagcuggaacgggccgcugacgugcgcugggaggagcaggccgaaaucuccgggagcucucccauucuuagcaucacaauuuccgaggauggaucuaugagcaucaaaaaugaagaggaggaacagacccugacaauucucaucagaacgggccugcucgucauuuccgggcuguucccggugucuaucccuaucaccgccgcugcgugguaccuuugggagguuaagaaacaacgggccggagugcugugggacguccccagcccuccccccgugggcaaggcugaacuggaggauggggccuaucgcauuaagcagaaaggaauccucggcuacucccagauuggcgccgggguuuauaaggaaggaacauuucauaccauguggcacgugacaagaggcgcuguccugaugcauaaagggaagcggaucgagccuucuugggccgacgugaaaaaggaucuuauuagcuacggaggcggguggaagcuggagggagaauggaaagagggcgaagaggugcagguucucgcgcuggaaccgggcaagaacccccgcgcuguccaaaccaaaccugggcucuucaagacgaacaccggaacaaucggcgccgugucccuggacuuuagccccgggaccucuggauccccuaucguggauaaaaagggcaaggucguggggcuuuacggaaauggcguugugacaagaagcggcaccuaugucucugccauugcucagacagagaaauccaucgaggacaaccccgaaauugaggaugacaucuuccggaagaaaagacugacgauuauggaucugcacccuggggccggaaagaccaaacgcuaccucccggcgaucgugcgggaagcuaucaagagaggccugcgcacacuuauucuggcccccacccggguuguggccgcugagauggaagaggcccucagagggcugccuauccgcuaucagacccccgcuauucgggccgagcauacaggaagagaaaucgucgaccucaugugucacgcgacguucaccaugcgccugcuuagcccuauucgggugcccaauuacaaccugaucauuauggaugaggcccacuuuacagacccggcuuccaucgccgcuagaggcuauaucucuacccggguugaaaugggggaggccgccggcauuuucaugacagcuaccccucccggaagccgcgaccccuuuccucaguccaaugcgcccaucauggaugaggaaagagagauuccugaacggagcuggaacucuggccaugagugggugacggacuucaaggggaaaacagucugguuugugccguccaucaaggccggaaaugauauugcugccugccugcgcaaaaacggcaagaaagugauccaacucagcagaaagaccuucgacucugaauacaucaagacccggacaaaugauugggacuuugucguuaccacagauauuagcgagaugggggccaacuucaaagcugagagagugaucgacccccgccgguguaugaagccugugauucugaccgauggagaagagagagucauccuugccggccccaugccugugacgcacuccucugcggcucagcgccgggggagaguuggccgcaaucccaaaaacgaaaaugaccaguauauuuacaugggagagccgcuggaaaacgaugaggacugcgcccauuggaaggaggccaaaaugcuccuggacaauaucaacacaccugaaggcaucauucccagcauguuugagccugaacgggagaagguggaugcuaucgacggggaauacagacugcgcggagaggccagaaaaaccuucgucgaucucaugcggcgcggcgaccuucccguguggcuggcguauagaguugccgcugaggggauuaacuacgccgaucggcgcugguguuuugacggagugaagaauaaccaaauccuggaagagaaugucgaaguggagauuuggacaaaggagggcgaaagaaaaaagcucaaaccucgguggcuggaugcuagaaucuauuccgacccccuugcccugaaggaguucaaagaauucgcugccgggcgcaagucucucgcgcugaaccugauuaccgagaugggccggcucccgacguuuaugacccagaaggccagaaaugcucuugauaaccuggccguccugcacacagcugaagccggaggccgcgccuacaaucacgcucucagcgagcugccugagacccuugaaacacugcuccugcugacccuccuugcgacagugaccgggggaaucuuccuguuucugauguccggcaaagggaucggaaagaugacgaugggcaugugcugcauuaucacagccagcauucuccugugguaugcucagauccagccccauuggauugccgccucuaucauccuugaguucuuucugauuguucuccugauccccgaaccugagaaacaacggaccccgcaggacaaccagcugaccuacguggugauugcuauccucacagucguugccgcgaccauggccaaugaaaugggcuuccuugagaagacaaaaaaggauuuugggcugggauccauugcuacgcagcaacccgagagcaacauccuggacaucgaucucagaccugccuccgcuuggacccuguaugccguggcgacaaccuucauuacacccaugcuucggcacucuaucgaaaauagcuccgugaacgucucucugaccgccauugcuaaucaggccacggugcucaugggccuggggaagggauggccucugagcaaaauggacaucggcguuccccuccuugcuauuggguguuacucccaggugaacccuaucacccugauggccgcucugcuccugcuugucgcccauuacgcgauuaucggaccgggccugcaggccaaggcuacacgcgaggcccaaaaaagagcugccgccggcaucaugaagaaucccaccguggacgggauuacagucaucgaucucgacccuauucccuaugauccuaaauuugaaaagcagcugggacaggugaugcugcucguucuuugcgugacccagguccugaugaugcggacgacaugggcgcugugugaggcucucacccuggccacaggccccaucagcacccuuugggaagggaacccgggacgcuucuggaauaccacaauugcugugucuauggccaacaucuuuagaggcuccuaccuggccggggcuggacuccuguucagcaucaugaagaacacggccaauacccggcgcggcacaggcaacaccggggagacacugggagagaaauggaagaauagacucaacgcgcuuggcaaaucugaauuucaaauuuauaagaaauccgggauccaggagguugaccggacccuggccaaggaaggaauuaaacgcggcgagacggaucaccaugcugugagcagagggucugccaagcugcggugguucgucgagagaaaucucgugacaccugaaggaaaggugguugaccugggcugcggccgcgggggauggagcuacuauuguggcgggcuuaaaaacgucaaggaggugaaaggacugaccaagggcgggcccggacacgaagagcccaucccuauguccaccuacggcuggaaucucgugcggcugcagucuggcgucgauguuuucuuuacacccccugaaaaaugcgacacccugcucugugauauuggggagagcuccccgaaccccacaguggaggcuggaagaacgcuucgcgugcugaaucuggucgaaaacuggcucaauaacaauacccaauucugcaucaaggugcugaacccuuauaugcccagcguuaucgagaagauggaagcccuucagcggaaauacggcggggcgcuggugagaaauccucucucccgcaacucuacacacgagauguacugggucagcaacgccuccggaaauauugugucuagcguuaacaugaucucccggaugcugauuaauagauuuaccaugcgccauaagaaagcuacauaugaacccgacguggaucugggcucugggacccggaacaucggaauugagagcgagacgccgaaucucgacaucaucggcaagagaauugaaaaaaucaagcaggagcacgaaaccuccuggcauuacgaucaggaccacccuuauaagacaugggccuaccacggcagcuaugagaccaaacaaacagggucugcuuccagcauggucaacggaguggugcgccuucugaccaagcccugggacgucauuccuaugguuacacagauggccaugaccgauacgacacccuucggccagcagcggguguuuaaagaaaagguggacaccagaacccaagagccuaaagaggggacaaagaagcugaugaaaaucacggcuaaguggcucuggaaagaacugggaaagaaaaagaccccccgcauguguacaagagaggaauucacccggaaaguccgcucuaaugccgcgcuuggcgccauuuuuacagaugagaacaaguggaaguccgcuagagaggccguggaagacagcggguucugggagcugguugauaaagaacggaaucuccaucuggagggaaagugcgaaaccuguguguacaacaugaugggcaaaagagagaagaaacugggcgaguuugggaaggcuaagggaucucgggccaucugguauauguggcucggcgcccgcuuccuggaauuugaggcgcuuggguuccugaaugaagaccacugguuuuccagagagaacagccucuccggagucgaaggcgaggggcugcauaaacuuggcuacauucugcgggaugugagcaagaaagagggaggcgcuauguacgccgacgauacagccgggugggacacccgcaucacgcucgaagaucugaagaaugaggaaaucguuaccaacuauauggagggagaacacaaaaagcuggcugaggccauuuucaagcucacauaccagaauaaaguggucagagugcagcggccgaccccucgcggcacaguuauggacaucauuucuagacgggaccagcgcgggagcggacaaguggucaccuauggccugaacacguucacaaacauggaggcucagcuuaucagacagauggaaggggagggcguguuuaaguccauucaacaucugaccgucacagaagagaucgccguggagaauuggcucguucgggugggacgcgaaagacugucucggauggcgaucagcggcgaugacugcgucgugaaaccccuugaugaccgcuucgccuccgcucugaccgcccucaacgauauggggaaggugagaaaagacauucagcagugggagcccucucggggauggaaugauuggacgcagguuccuuuuugcagccaccacuuccaugaacugaucaugaaggacggcagagugcuggucgugccgugucgcaaccaagaugagcucauugggcgggcuagaaucucccagggagccggcuggucucugcgcgaaaccgcgugccuugggaagagcuacgcccagauguggucccugauguauuuucaccggagagaccuccgccuggcugccaaugcuauuuguagcgccguucccucucauugggugccuacaucccggaccacauggagcauccacgcuacccacgaguggaugacaaccgaggauaugcuuacggucuggaacagaguguggauccaggaaaaucccuggauggaggacaaaacaccugucgaaucuugggaggaaauucccuaccugggcaagcgcgaggaucaauggugcggaucccucaucggccugaccagccgggccaccugggcgaaaaacauucagacagccaucaaucaggugagaucccugauugggaacgaggaauauaccgacuacaugccuucuaugaagcgcuuccggagagaggaagaggaagcuggaguucucugguga

SEQ ID NO: 19537 - RNA, 9876 nt, Artificial Sequence
  derived and/or modified CDS sequence (opt5) from DENV-2__KF744400__SS-prME
accgccggcaugaucauuaugcugauccccaccgugauggcuuuccaccucacgaccagaaauggggaaccucauaugauugucagccggcaggaaaaggggaagucccugcuuuuuaagacagaaaauggcguuaauaugugcacccugauggccauggaccucggggaacugugugaagauacaaucaccuacaaaugcccccuucugagacaaaaugaacccgaggacauugauuguuggugcaacucuacaagcaccugggugacguaugggaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacacacuuucagagagcucuuauuuucauccugcucacggccguugcgccuuccaugaccaugcggugcauuggaaucucuaaucgcgacuuuguggaaggcgucagcgggggauccuggguggauauuguucuggagcacggcagcugugugacaaccauggccaagaacaagcccacacuugacuucgaacugaucaaaaccgaggcuaaggaaccugccacgcucagaaaauauugcaucgaggcuaagcugacaaauaccaccacagagucucgguguccgacccagggggaacccucccugaacgaggaacaagauaaacgcuuugucugcaagcauagcaugguggacagaggauggggcaauggcuguggacucuucggaaagggcgggauugugacaugcgccauguuuacgugcaaaaagaacauggagggaaaaaucguccagccugaaaaucuggaguacaccauuguuaucacaccccacucuggcgaggaacaugcgguggggaacgauaccggaaagcacggcaaagagauuaagaucacaccucaguccagcaccacggaagccgagcuuaccggcuaugggacagugaccauggaauguucuccccggacaggacuggacuucaaugagaugguccuccugcagauggagaacaaggcuuggcuugugcaccgccaaugguuucuggaucucccgcugccuuggcugcccggcgccgacacccagggguccaauuggauccagaaggaaacgcucguuacauucaagaacccucaugcuaaaaagcaggauguggucgugcugggaagccaagagggcgccaugcacaccgcccuuacaggggcuaccgacauucagauguccucuggcaaccugcucuuuaccggacaucugaaaugcagacuucggauggacaagcugcagcucaaaggcaugagcuacuccauguguacagggaaguucaagguugugaaagaaaucgcggagacgcaacacggaaccauugucgugagaguccaguaugagggcgaugggagccccugcaagauccccuucgaaauuauggaccuggagaaacgccaugugcugggacggcucaucacaguuaauccuaucgugaccgaaaaggauucuccggucaacauugaggccgaacccccuuuuggcgacuccuacgugaucauugggguugagcccggccagcugaaacuuaauugguucaagaagggaagcucuaucggccagauguuugagacaaccaugagaggggcuaaacgcauggccauucugggagauacggccugggacuucggcagccucgggggaguguuuacauccaucggcaaggcucugcaccaagucuucggggccauuuacggcgcggcuuuuucuggagugagcuggaccaugaaaauccugaucggcgugauuaucaccuggauugggaugaacucccggagcacaucucuuuccguuagccucguccuggugggaguggucacccuguaucucggcgugguugugcaggccgauucugggugugucguguccuggaagaauaaagaacugaagugcggaagcggcaucuucauuacagacaacguucacacguggaccgagcaguacaaguuucagccugaaucccccucuaaacuugccagcgcuauccaaaaggcccaucaggaggggaucuguggcauuagauccgugacacgccuggaaaaucucauguggaaacagaucaccccggagcugaaccacauucugucugagaaugaagucaaacuuacaaucaugaccggagauauuaaaggcaucaugcaugcugggaagcggagccucagaccucagcccacggagcugcgcuauuccuggaaaaccuggggaaaggccaagauccugagcacagaaucucacaaccaaaccuuccucauugacggcccugagacagcggaaugccccaauaccaaccgggccuggaacucccuggagguggaggauuacggguuuggaguuuucacaaccaacaucuggcuuaaacugagagaaaagcaggacgcuuuuugugacccuaaacucaugagcgccgcuauuaaggauaaucgcgccgugcacgcggacaugggcuauuggaucgagucugcccugaacgauacguggaaaauugaaaaggcuuccuucaucgaggucaagaacugccauuggcccaaaagccacacacuguggucuaauggcgugcuugagagcgaaaugaucauuccgaagaacuucgccgggccugugucccagcauaauuaccggcccggauaucacacccagaccgcuggccccuggcaucucgggaaacuggagcuggacuuugauuucugugaaggaacaaccgucguugugacggaggacugcggcaacagagggccuagccuccggacaaccacagccucuggaaagcugaucaccgaauggugcugucgcuccugcacacuuccgccccugagauacaaaggcgaggauggcuguugguacgggauggagauucggccucucaaggaaaaggaggaaaaucuggugagcucccuggucaccgccggacacggccaaaucgacaacuuuucucuuggggugcucggaauggcucuguuccuggaggaaaugcucagaacgcgcguuggcaugaaacacgcgauucugcuuguggccgucagcuuugugacccugaucacagggaauauguccuuccgggaucucggaagaguuauggugauggucggcgcuaccaugacagacgauauuggcaugggggugaccuaucuggcccugcuugccgcuuuuaagguucgccccacguucgccgcgggacugcuccugagaaaacucacaucuaaggagcugaugaugaccacaaucggcaucgugcuucugagccaguccaccauuccugagaccauccucgaacugacagacgcucuggcccuugggaugaugguccugaaaauugugcggaagauggagcgcuaccagcucgccgugacgaucauggcuauucugugcguccccaacucuguuauccuccaaaaugccuggaaggugagcuguaccauccuggcgguggucuccgugagcccucuucugcucacaucuucccagcagaaagcugauuggauuccccuggcccugaccaucaagggacuuaacccgacagccauuuuucugaccacgcucagcagaacaucuaaaaagcgguccuggccucugaaugaagcuaucauggccguuggcauggugagcauucucgcuucuucccugcuuaaaaacgacauccccaugaccgggccucuggucgccggaggccugcucaccgugugcuauguucugacaggccgcagcgcggaccuugagcuggaaaaggccgcugaugugagaugggaggaccaggccgagaucuccgggagcucucccauucucagcgucaucguguccgaagauggaucuaugagcauuaaaaaugaggaagaggagcaaauccugaccauucucauccggacaggccugcuugucauuuccgggcuguucccggugucuaucccuaucacggcugccgccugguaccugugggaaguuaagaagcagcgcgcuggagugcucugggacguccccagcccuccgcccgugggcaaagcggagcuggaagauggggccuauagaauuaagcagaaaggaauccuuggcuacucccagauuggcgcugggguuuauaaggagggaaccuuucauacaauguggcacgugacccggggcgccguccugaugcauaaagggaagcgcaucgaaccuucuugggccgacgugaagaaagaucucauuagcuacggaggcggguggaagcuggagggagaguggaaagaaggcgaggaagugcaaguucucgcucuggagccgggcaagaaccccagagccguccagacaaaaccugggcuuuucaagaccaaugcgggaacgaucggcgcugugucccuggacuuuagccccgggaccucuggauccccuaucauugauaagaaaggcaagguggucgggcuguacggaaacggcgugguuacacggaacggcagcuaugugucugccaucgcccagaccgaaaaauccauugaggacaaucccgagaucgaagaugacauuuucagaaagaaacgccucacaaucauggaucugcacccuggggcuggaaagaccaagcgguaccuuccggccaucgucagagaggcgauuaaacgcggccugcggacacucauccuggcucccacgagagugguugccgccgaaauggaggaagcucuccgcgggcugccuauucgguaucagacccccgccaucagagcugagcauacaggacgcgagauuguggaccuuaugugucacgccaccuucaccaugcggcugcugagcccuaucagaguccccaacuacaaucucauuaucauggacgaagcgcacuuuacagauccggccuccaucgcugcccggggcuauauuucuacgcgcguggagaugggggaagcugccggcaucuucaugaccgccacaccucccggaagcagagaccccuuuccucaauccaacgcucccauuauggaugaggagcgggaaaucccugagcgcagcuggaacucuggccaugaauggguuaccgacuucaaggggaaaacagugugguuugucccguccauuaaggcgggaaacgauaucgccgcuugccugcgcaagaauggcaagaaggugauccagcuuagccggaaaaccuucgacucugaguacgugaagacgagaacaaacgauugggacuuugucguuaccaccgauauuagcgaaaugggggccaauuucaaagccgagcgcgugaucgacccccggagauguaugaagccugugauucugacagauggagaggaacgcgucauccucgcuggccccaugccugugacccacuccucugccgcgcagcggagagggcgcauuggccggaaccccaaaaaugagaacgaccaauauaucuacaugggagaaccgcuggagaaugacgaagauugcgcucauuggaaggaggccaaaaugcugcucgacaacaucaauacaccugagggcauuauccccagcauguuugaaccugagagagaaaagguugaugccauugacggggaguaccgccuuagaggagaagcucggaagaccuucguggaucugaugcgcagaggcgaccugcccgucuggcucgccuauaaaguggcggccgaggggaucaacuacgcugaucggcgcugguguuuugacggaauuagaaacaaucagauccuggaggaaaacguugagguggaaauuuggacgaaggagggcgagcggaagaaacuuaaaccuagauggcuggaugcccgcaucuauuccgacccccucgcucugaaagaguucaaggaguucgccgcugggcggaaaucucugacacucaaucuuaucaccgaaaugggcagacugccgacauuuaugacccagaaggcccgcgaugcgcuggacaaccucgccguccugcacacggcugaggccggaggccgggcuuacaaucacgcccuuagcgaacugccugagacccucgagacacugcugcuccuuacccugcuggccacagugaccgggggaauuuuccucuuucugauguccggcagagggaucggaaaaaugacacuuggcaugugcugcauuaucaccgcuagcauucugcucugguaugcgcagauccaaccccauuggaucgccgcuucuauuauccuggaguucuuucugauuguccuccuuauccccgagccugaaaagcagcggacgccgcaggauaaccagcugacauacgugguuauugccauccugaccgugguggccgcuaccauggccaaugagaugggcuuccucgagaagacaaagaaggaccuggggcuuggauccaucgcgacccaacagcccgagagcaacauucuggacaucgaucuccgcccugccuccgcuuggacacuguaugccgucgcuacgaccuuuauuacacccaugcugagacacucuaucgagaauagcuccguuaacgugucucucaccgccauugcgaaucaggccacagugcuuaugggccuggggaaaggauggccucugagcaagauggacaucggcgucccccuccuggcuauuggguguuacucccaggugaacccuaucacccuuacggccgcucugcuccugcugguugcccauuacgcuaucauuggaccgggccuccaagccaaagcgacccgggaagcccagaagcgcgcugccgcuggcaucaugaaaaaucccacaguggaugggauuaccgccaucgaccuugauccuauucccuaugacccuaaguucgagaagcagcugggacaggucaugcugcucgugcugugcgucacacaagugcuuaugaugagaaccacgugggcccugugugaagcgcucacacuggcuaccggccccaucagcacacugugggaggggaacccgggacgguuuuggaauaccaccaucgccguuucuauggcuaacauuuuccgcggcuccuaccucgccggggccggacuucuguuuagcaucaugaaaaauacaacgaacaccagacggggcacaggcaacauuggggaaacccugggagagaaguggaaaucucgccucaaugcucugggcaaguccgaguuccagaucuauaaaaagagcgggauucaggaaguggauagaacacuugccaaagagggaaucaagcggggcgaaaccgaccaccaugcggucucuagagggagcgccaagcugcgcugguuuguggagcggaacaugguuacgccugagggaaaaguggucgaucucggcugcggcagagggggaugguccuacuauuguggcgggcugaagaaugugcgcgaagugaaaggacugacaaagggcgggcccggacacgaggaacccaucccuaugucuaccuacggcuggaaccucguucggcuucaaagcggcgucgacguguucuucacacccccugagaaaugcgauacacugcugugugacauuggggaauccagcccgaaucccaccguggaggcuggaagaacacuccgcguccugaaccuuguugagaauuggcugaacaauaacacgcaguuuugcaucaaggugcucaauccuuauaugcccuccgugauugaaaagauggaggcccugcagcggaaauacggcggggcucuggucagaaacccucucucucgcaauagcacccacgaaauguacuggguguccaacgccucuggaaauaucguuagcuccgugaacaugauuucucggaugcuuaucaacagauucacaaugaagcauaaaaaggcgaccuaugagcccgaugucgaccugggcagcgggacauguaauaucggaauugaauccgaggugccgaaccuggacaucauuggcaaacgcaucgagaagauuaagcaggaacacgagaccagcuggcauuacgaucaagaccacccuuauaaaacgugggccuaccacggcucuuaugaagcuaagcagaccggguccgccagcucuaugguuaauggagugguccggcuccugacaaaacccugggaugugaucccuauggugacccagauggcuaugacagacaccacacccuuuggccagcaaagagucuucaaggagaaaguugauacccgcacgcaggaaccuaaggaggggacaaagaaacuuaugaagauuaccgccgaguggcuguggaaagaacucggaaagaaaaagacccccagaaugugcacacgggaggaauuuacgcgcaaagugagauccaacgcugcccugggcgcgaucuucaccgacgagaauaaguggaaaagcgcccgggaggcuguggaagauucuagauuuugggagcuggucgacaaagaacggaaccuccaucuggaggggaagugugaaacaugcguguacaauaugaugggaaaacgcgagaagaaacuuggcgaguucggcaaggccaagggguccagagcuaucugguauauguggcugggagcccgguuucucgaguucgaggcccugggcuuucuuaacgaagaucacugguucagccgcgaaaauucccugagcgggguugaaggagagggccucuacaaacugggguacauucugagagacgugucuaagaaagagggcggagcgauguaugcugaugacaccgccggcugggacacacggaucacccucgaagaucugaagaacgaggaaauggucacaaaucauauggagggggaacacaagaaacuugccgaggcuauuuuuaaacugaccuaccagaacaaagugguucgcgugcagagaccgacgccucggggaaccgucauggacaucauuagccgcagagaucaacggggcuccggacaggugggaacauauggccucaauaccuucacaaacauggaggcccagcugauccgccaaauggaaggggagggcaucuucaagucuauucagcaucuuaccgcuacggaagagaucgccguucagaauuggcugacaagagugggacgggagcgccucagcagaauggcgauuuccggcgacgauugcgucgugaaaccccuggacgaucgguuugccucugcucugaccgcccucaacgacauggggaaggucagaaaagauauccagcaaugggaacccagccgcggauggaacgacuggacacaggugccuuucuguucccaccacuuucaugagcugauuaugaaggauggccggguucuuguggucccgugcagaaaucaggacgaacugaucgggcgcgcucggaucucucagggagccggcuggagccucagagagaccgcgugucuggggaaguccuacgcccaaauguggagccuuauguauuuccaccgccgggaucugagacucgcugccaacgcuauuugcucugccgugcccucccauugggugccuacgagccgcaccacauggucuauccacgcuaaacacgaauggaugaccacagaggacaugcugaccguuuggaaucggguguggauucaggagaaccccuggauggaagacaagacaccugucgaguccugggaagagauccccuaccugggcaaaagagaagaucagugguguggaagccucauuggccugaccucccgcgccacgugggcgaagaauauccagacagccauuaaccaagugcggucucuuaucgggaaugaggaguauaccgacuacaugccuagcaugaaaagauuucggagagaagaggaagaggcuggaguucugugguga

SEQ ID NO: 19538 - RNA, 9876 nt, Artificial Sequence
  derived and/or modified CDS sequence (opt5) from DENV-2__KF744401__SS-prME
accgccggaaugaucauuaugcugauccccacagugauggcuuuccaccucacgaccagaaauggggaaccucauaugauugucagccggcaggaaaaggggaagucccugcuuuuuaagacagagaauggcguuaauaugugcacccugauggccauggaccucggggaacugugugaggauacaaucaccuacaagugcccccuucugcgccaaaaugaacccgaggacauugauuguuggugcaacucuacaagcaccugggugacguauggaaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacacacuuucagagagcucuuauuuucauccugcucacggccguugcgccuuccaugaccaugcggugcauuggaaucucuaaucgcgacuuuguggaaggcgucagcgggggauccuggguggauauuguucuggagcacggcagcugugugacaaccauggccaagaacaagcccacacuugacuucgaacugaucaaaaccgaggcuaaggaaccugccacgcucagaaaauauugcaucgaggcuaagcugacaaauaccaccacagagucucgguguccgacccagggggaacccucccugaacgaggaacaagauaaacgcuuugucugcaagcauagcaugguggacagaggauggggcaauggcuguggacucuucggaaagggcgggauugugacaugcgccauguuuacgugcaaaaagaacauggagggaaaaaucguccagccugaaaaucuggaguacaccauuguuaucacaccccacucuggcgaggaacaugcgguggggaacgauaccggaaagcacggcaaagagauuaagaucacaccucaguccagcaccacggaagccgagcuuaccggcuaugggacagugaccauggaauguucuccccggacaggacuggacuucaaugagaugguccuccugcagauggagaacaaggcuuggcuugugcaccgccaaugguuucuggaucucccgcugccuuggcugcccggcgccgacacccagggguccaauuggauccagaaggaaacgcucguuacauucaagaacccucaugcuaaaaagcaggauguggucgugcugggaagccaagagggcgccaugcacaccgcccuuacaggggcuaccgaaauucagauguccucuggcaaccugcucuuuaccggacaucugaaaugcagacuucggauggacaagcugcagcucaaaggcaugagcuacuccauguguacagggaaguucaagguugugaaagagaucgcggagacgcaacacggaaccauugucgugagaguccaguaugaaggcgacgggagccccugcaagauccccuucgagauuauggaucuggaaaaacgccaugugcugggacggcucaucacaguuaauccuaucgugaccgagaaggacucuccggucaacauugaagccgagcccccuuuuggcgauuccuacgugaucauugggguugagcccggccagcugaaacuuaauugguucaagaagggaagcucuaucggccagauguuugaaacaaccaugagaggggcuaaacgcauggccauucugggagacacggccugggauuucggcagccucgggggaguguuuacauccaucggcaaggcucugcaccaagucuucggggccauuuacggcgcggcuuuuucuggagugagcuggaccaugaaaauccugaucggcgugauuaucaccuggauugggaugaacucccggagcacaucucuuuccguuagccucguccuggugggaguggucacccuguaucucggcgugguugugcaggccgacucugggugugucguguccuggaagaauaaagagcugaagugcggaagcggcaucuucauuacagauaacguucacacguggaccgaacaguacaaguuucagccugagucccccucuaaacuugccagcgcuauccaaaaggcccaucaggaagggaucuguggcauuagauccgugacacgccuggagaaucucauguggaaacagaucaccccggagcugaaccacauucugucugaaaaugaggucaaacuuacaaucaugaccggagacauuaaaggcaucaugcaugcugggaagcggagccucagaccucagcccacggaacugcgcuauuccuggaaaaccuggggaaaggccaagauccugagcacagagucucacaaccaaaccuuccucauugauggcccugaaacagcggagugccccaauaccaaccgggccuggaacucccuggagguggaagacuacggguuuggaguuuucacaaccaacaucuggcuuaaacugagagagaagcaggaugcuuuuugugacccuaaacucaugagcgccgcuauuaaggacaaucgcgccgugcacgcggauaugggcuauuggaucgaaucugcccugaacgacacguggaaaauugagaaggcuuccuucaucgaggucaagaacugccauuggcccaaaagccacacacuguggucuaauggcgugcuugaaagcgagaugaucauuccgaagaacuucgccgggccugugucccagcauaauuaccggcccggauaucacacccagaccgcuggccccuggcaucucgggaaacuggaacuggauuuugacuucugugagggaacaaccgucguugugacggaagauugcggcaacagagggccuagccuccggacaaccacagccucuggaaagcugaucaccgaguggugcugucgcuccugcacacuuccgccccugagauacaaaggcgaggacggcuguugguacgggauggaaauucggccucucaaggagaaggaagagaaucuggugagcucccuggucaccgccggacacggccaaaucgauaacuuuucucuuggggugcucggaauggcucuguuccuggaagagaugcucagaacgcgcguuggcaugaaacacgcgauucugcuuguggccgucagcuuugugacccugaucacagggaauauguccuuccgggaccucggaagaguuauggugauggucggcgcuaccaugacagaugacauuggcaugggggugaccuaucuggcccugcuugccgcuuuuaagguucgccccacguucgccgcgggacugcuccugagaaaacucacaucuaaggagcugaugaugaccacaaucggcaucgugcuucugagccaguccaccauuccugaaaccauccucgagcugacagaugcucuggcccuugggaugaugguccugaaaauugugcggaagauggaacgcuaccagcucgccgugacgaucauggcuauucugugcguccccaacucuguuauccuccaaaaugccuggaaggugagcuguaccauccuggcgguggucuccgugagcccucuucugcucacaucuucccagcagaaagcugacuggauuccccuggcccugaccaucaagggacuuaacccgacagccauuuuucugaccacgcucagcagaacaucuaaaaagcgguccuggccucugaaugaggcuaucauggccguuggcauggugagcauucucgcuucuucccugcuuaaaaacgauauccccaugaccgggccucuggucgccggaggccugcucaccgugugcuauguucugacaggccgcagcgcggaccuugaacuggagaaggccgcugacgugagaugggaggaucaggccgaaaucuccgggagcucucccauucucagcgucaucguguccgaggacggaucuaugagcauuaaaaaugaagaggaggaacaaacccugacaauccucauucggacgggccugcuugucaucuccgggcuguucccggugucuauuccuaucaccgcugccgccugguaccugugggagguuaagaagcagcgcgcuggagugcucugggauguccccagcccuccgcccgugggcaaagcggaacuggaggacggggccuauagaaucaagcagaaaggcauucuuggcuacucccagaucggcgcugggguuuauaaggaaggaacauuucauaccauguggcacgugacacggggcgccguccugaugcauaaagggaagcgcauugagccuucuugggccgaugugaagaaagaccucaucagcuacggaggcggguggaagcuggagggagaauggaaagagggcgaagaggugcaaguucucgcucuggaaccgggcaagaaccccagagccguccagaccaaaccugggcuuuucaagacgaaugcgggaaccauuggcgcugugucccuggauuuuagccccgggacaucuggauccccuaucaucgacaagaaaggcaagguggucgggcuguacggaaacggcgugguuacccggaacggcagcuaugugucugccauugcccagacagagaaauccaucgaggauaaucccgaaauugaggacgauaucuucagaaagaaacgccucaccauuauggaccugcacccuggggcuggaaagacaaagcgguaccuuccggccaucgucagagaagcgaucaaacgcggccugcggacgcucauucuggcucccaccagagugguugccgccgagauggaagaggcucuccgcgggcugccuauccgguaucagacacccgccauuagagcugagcauaccggacgcgaaaucguggaucuuaugugucacgccaccuucacaaugcggcugcugagcccuauuagaguccccaacuacaaucucaucauuauggacgaggcgcacuuuacggacccggccuccaucgcugcccggggcuauaucucuacccgcguggaaaugggggaggcugccggcauuuucaugacagccaccccucccggaagcagagaucccuuuccucaauccaacgcucccaucauggacgaggaacgggagauuccugaacgcagcuggaacucuggccaugaguggguuacagauuucaaggggaaaaccgugugguuugucccguccaucaaggcgggaaacgacauugccgcuugccugcgcaagaauggcaagaaggugauccagcuuagccggaaaacguucgauucugaauacgugaagacaagaaccaacgacugggauuuugucguuaccacagacaucagcgagaugggggccaauuucaaagccgagcgcgugauugauccccggagauguaugaagccugugauccugaccgacggagaagaaagagucauucucgcuggccccaugccugugacacacuccucugccgcgcagcggagagggcgcaucggccggaaccccaaaaaugaaaacgaucaauauauuuacaugggagagccgcuggaaaaugacgaggacugcgcucauuggaaggaggccaaaaugcugcucgauaacaucaauaccccugaaggcaucauucccagcauguuugagccugaaagagagaagguugacgccaucgauggggaauaccgccuuagaggagaggcucggaagacguucguggaccugaugcgcagaggcgaucugcccgucuggcucgccuauaaaguggcggccgaggggauuaacuacgcugaccggcgcugguguuuugauggaaucagaaacaaucagauucuggaagagaacguugaaguggagaucuggacaaaggagggcgaacggaagaaacuuaaaccuagauggcuggacgcccgcauuuauuccgauccccucgcucugaaagaguucaaggaguucgccgcugggcggaaaucucugacccucaaucuuaucacagagaugggcagacugccgaccuuuaugacgcagaaggcccgcgacgcgcuggauaaccucgccguccugcacaccgcugaagccggaggccgggcuuacaaucacgcccuuagcgagcugccugagacacucgaaacccugcugcuccuuacacugcuggccaccgugacagggggaaucuuccucuuucugauguccggcagagggauuggaaaaaugacccuuggcaugugcugcaucauuacggcuagcauccugcucugguaugcgcagauucaaccccauuggaucgccgcuucuaucauucuggaguucuuucugaucguccuccuuauucccgaaccugagaagcagcggacaccgcaggacaaccagcugaccuacgugguuaucgccauucugaccgugguggccgcuacaauggccaaugaaaugggcuuccucgagaaaaccaagaaggaucuggggcuuggauccaucgcgacacaacagcccgagagcaacauccuggacauugaccuccgcccugccuccgcuuggacgcuguaugccgucgcuaccacauuuaucacccccaugcugagacacucuauugaaaauagcuccguuaacgugucucucacagccaucgcgaaucaggccaccgugcuuaugggccuggggaaaggauggccucugagcaagauggauauuggcgucccccuccuggcuaucggguguuacucccaggugaacccuauuacgcuuaccgccgcucugcuccugcugguugcccauuacgcuaucaucggaccgggccuccaagccaaagcgacacgggaggcccagaagcgcgcugccgcuggcauuaugaaaaaucccaccguggacgggaucacagccauugaucuugacccuauccccuaugauccuaaguucgaaaagcagcugggacaggucaugcugcucgugcugugcgucacccaagugcuuguuaugagaacgacaugggcccugugugaggcgcucacccuggcuacaggccccauuagcacccugugggaagggaacccgggacgguuuuggaauaccacaaucgccgugucuauggcuaacaucuuccgcggcuccuaccucgccggggccggacuucuguuuagcauuaugaaaaauacgaccaacacaagacggggcaccggcaacaucggggagacacugggagagaaguggaaaucucgccucaaugcucugggcaaguccgaguuccagauuuauaaaaagagcgggauccaggaggucgacagaacccuugccaaagaaggaauuaagcggggcgagacggaucaccaugcggugucuagagggagcgccaagcugcgcugguuuguugagcggaacauggugacaccugaaggaaaagucguggaccucggcugcggcagagggggaugguccuacuauuguggcgggcugaagaaugugcgcgagguuaaaggacugaccaagggcgggcccggacacgaagaacccaucccuaugucuaccuacggcuggaaccucguccggcuucaaagcggcguggauguguucuucacacccccugaaaaaugcgacacccugcugugugauaucggggaguccagcccgaaucccacagucgaggcuggaagaacgcuccgcguucugaaccuuguggaaaauuggcugaacaauaacacccaguuuugcauuaaggugcucaauccuuauaugcccuccgucaucgagaagauggaagcccugcagcggaaauacggcggggcucuggugagaaacccucucucucgcaauagcacacacgagauguacuggguuuccaacgccucuggaaauauugugagcuccgucaacaugaucucucggaugcuuauuaacagauucaccaugaagcauaaaaaggcgacauaugaacccgacguggaucugggcagcgggacccgcaauaucggaaucgaguccgagguuccgaaccuggacauuaucggcaaacggauugaaaagaucaagcaggagcacgaaacgagcuggcauuacgaccaagaucacccuuauaaaaccugggccuaccacggcucuuaugaggcuaagcagacaggguccgccagcucuauggugaauggagucgugagacuccugaccaaacccugggacgugauuccuauggucacacagauggcuaugaccgauacaacccccuuuggccagcaacgcguuuucaaggaaaaaguggacacgagaacacaggagccuaaggaggggaccaagaaacuuaugaagaucaccgccgaauggcuguggaaagagcucggaaagaaaaagacaccccggauguguacgcgcgaagaguuuaccagaaaagugcgguccaacgcugcccugggcgcgauuuucacagaugagaauaaguggaaaagcgccagagaagcugucgaggacucucgguuuugggaacugguggauaaagagcgcaaccuccaucuggaagggaagugcgagaccuguguuuacaauaugaugggaaaaagagagaagaaacuuggcgaguucggcaaggccaaggggucccgggcuaucugguauauguggcugggagcccgcuuucucgaguucgaagcccugggcuuucuuaacgaggaccacugguucagcagagaaaauucccugagcgggguggagggagagggccucuacaaacugggguacauccugcgggaugucucuaagaaagaaggcggagcgauguaugcugacgauacagccggcugggacacccgcauuacacucgaggaccugaagaacgaagagauggugaccaaucauauggaaggggagcacaagaaacuugccgaggcuaucuuuaaacugacguaccagaacaaaguugugagaguccagcggccgaccccucgcggaacagugauggauauuaucagcagacgggaccaacgcggcuccgggcagguuggaaccuauggccucaauacauucaccaacauggaagcccagcugauuagacaaauggagggggaaggcaucuucaagucuauccagcaucuuacggcuacagaggagauugccgugcagaauuggcugacccgggucggacgcgaaagacucagccggauggcgaucuccggcgaugacugcguggucaaaccccuggaugacagauuugccucugcucugacagcccucaacgauauggggaaggugcgcaaagacauucagcaaugggagcccagccggggauggaacgauuggacccagguuccuuucugcucccaccacuuucaugaacugaucaugaaggacggcagagugcuugucgugccgugucgcaaucaggaugagcugauugggcgggcuagaaucucucagggagccggcuggagccuccgcgaaacggcgugccuggggaaguccuacgcccaaauguggagccuuauguauuuccaccggagagaccugcgccucgcugccaacgcuaucuguucugccgugcccucccauuggguuccuaccagccggacaaccuggucuauucacgcuaaacacgaguggaugacaaccgaggauaugcugacaguguggaauagagucuggauccaggaaaaccccuggauggaggacaagaccccuguggaauccugggaggaaauucccuaccugggcaaacgcgaggaccaguggugcggaagccucaucggccugacgucccgggccacaugggcgaagaauauucagaccgccaucaaccaaguuagaucucuuauugggaaugaggaauauaccgauuacaugccuagcaugaaacgguuuagacgcgaggaagaggaagcuggagugcugugguga

SEQ ID NO: 19539 - RNA, 9876 nt, Artificial Sequence
  derived and/or modified CDS sequence (opt5) from DENV-2__KF744402__SS-prME
acagccggaaugaucauuaugcugauccccacggugauggcuuuccaccucacgaccagaaauggggaaccucauaugauugucagccggcaggaaaaggggaaaucccugcuuuuuaagacagaggacggcguuaauaugugcacccugauggccauggaucucggggaacugugugaggacacaaucaccuacaaaugcccgcuucugcgccaaaacgaacccgaggauauugacuguuggugcaauucuacaagcaccugggugacguauggaaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacaaacuuucagagagcucuuauuuucauccugcucacggccguugcgccuuccaugaccaugcggugcauuggaaucucuaaucgcgauuuuguggaaggcgucagcgggggauccuggguggacauuguucuggagcacggcagcugugugacaaccauggccaagaacaagcccacacuugauuucgaacugaucaaaaccgaggcuaagcacccugccacgcucagaaaauauugcaucgaagcuaagcugacaaauaccaccacagagucucgguguccgacccagggggagcccucccugaacgaagaacaagacaaacgcuuugucugcaagcauagcaugguggauagaggauggggcaauggcuguggacucuucggaaagggcgggauugugacaugcgccauguuuacgugcaaaaagaacauggaaggaaaaaucguccagccugagaaucuggaauacaccauuguuaucacaccccacucuggcgaggagcaugcgguggggaacgacaccggaaagcacggcaaagaaauuaaggugacaccucaguccagcaucaccgaggccgaacuuacgggcuaugggaccgucacaauggaguguucuccccggaccggacuggauuucaaugaaauggugcuccugcagauggagaacaaggcuuggcuuguucaccgccaaugguuucuggaccucccgcugccuuggcugcccggcgccgauacacagggguccaauuggauccagaaggagacccucgugacguucaagaacccucaugcuaaaaagcaggacgucgugguucugggaagccaagaaggcgccaugcacacagcccuuaccggggcuacagagauucagauguccucuggcaaccugcucuuuaccggacaucugaaaugcagacuucggauggacaagcugcagcucaaaggcaugagcuacuccauguguaccgggaaguucaagguggucaaagaaaucgcggagacacaacacggaacgauuguggucagagugcaguaugagggcgaugggagccccugcaagauccccuucgaaauuauggaccuggagaaacgccauguucugggacggcucaucaccgugaauccuaucgucacagaaaaggauucuccggugaacauugaggccgaacccccuuuuggcgacuccuacguuaucauugggguggagcccggccagcugaaacuuaauugguucaagaagggaagcucuaucggccagauguuugagaccacaaugagaggggcuaaacgcauggccauucugggagauaccgccugggacuucggcagccucgggggagucuuuacguccaucggcaaggcucugcaccaaguguucggggccauuuacggcgcggcuuuuucuggagugagcuggacaaugaaaauccugaucggcguuauuaucaccuggauugggaugaacucccggagcaccucucuuuccgucagccucauccuggugggaguggucacacuguaucucggcgugguugugcaggccgauucugggugugucguguccuggagaaauaaggaacugaaaugcggaagcggcauuuucaucaccgacaacguucacacauggacggagcaguacaaguuucagccugaaucccccucuaaacuugccagcgcuauccaaaaagcccaucaggaggggauuuguggcauccgcuccgugacccggcuggaaaaucucauguggaagcagauuacaccggagcugaaccacauccugucugagaaugaagucaaacuuaccauuaugacaggagauaucaagggcaucaugcaugcugggaaaagaagccuccgcccucagcccaccgagcugcgguauuccuggaagacguggggcagagccaaaauucugagcaccgaaucucacaaccaaacauuccucaucgacggaccugagaccgcggaaugccccaauacaaaccgcgccuggaauagccuggagguggaggauuacggguuuggaguuuucaccacaaacauuuggcuuaagcugaaggaacggcaggacguguuuugugacagcaaacucaugucugcugccaucaaggauaauagagcuguccacgccgacaugggcuauuggauugaguccgcgcugaacgauaccuggaaaaucgaaaaggccagcuucaucgaggugaaaucuugccauuggccuaagagccacacgcugugguccaacggcgugcuugagagcgaaaugauuauccccaagaauuucgcugggccggucucucagcauaacuaccggccuggauaucacacacagaccgccggccccuggcaucucgggaaacuggagauggacuuugauuucugugaaggaaccacaguuguggugaccgaggacugcggcaaucgcgggcccucccugagaacgacaaccgcuagcggaaagcucauuacagaauggugcugucgguccugcacccugccuccgcuuagauaccgcggcgaggauggcuguugguacgggauggagauccggccccugaaagaaaaggaggaaaaccucgucaauucucuggugacagccggacacggccaaauugacaacuuuagccuggggguucuuggaauggcccucuuccuggaggaaaugcugagaacccgcgugggcacgaaacacaccauccuccuggucgcuguguccuuuguuacacuuauuaccgggaauaugucuuucagagaucugggacgggugauggucauggugggcgcgacaaugaccgacaacaucggcauggggguuacguaucucgcccugcuggcugccuuuaaggugcgcccuacauucgccgcuggacuucugcucagaaagcugaccagcaaagagcucaugaugacaaccaucggcauuguccugcuuucccagucuaccauccccgagacaauucuggaacucacggaugcccuggcgcuggggaugauggugcuuaagaucgugcggaauauggagaaauaccagcuggcugucaccauuauggccauccucugcguuccuaacgccgugauccugcaaaaugcuuggaaggugagcuguacaauucucgccgucguguccguuagcccccugcuucugaccucuucccagcagaaagcggacuggaucccucucgcucugacaauuaagggacugaaccccaccgccaucuuucuuacgacacugagccgcaccucuaagaaaagauccuggccgcucaaugaagccauuauggcugugggcauggucagcauccuggccucuucccuccugaagaacgauaucccuauuaccgggccccuuguggcuggaggccugcugacaguuugcuaugugcucaccggccggagcgccgaccuggagcuugaacgcgcggccgacgucagaugggaggagcaggcugaaaucuccgggagcucuccuauucugagcaucauuaucuccgaggauggaucuaugagcauuaaaaaugaagaggaggaacaaacacucacgauccugauccggaccggccuccuggugauuuccgggcuuuuccccgucucuaucccgauuacagccgcugccugguaccugugggaggugaagaaacagcgcgccggaguucugugggacgugccuucucccccucccgucggcaaggcugaacucgaggauggggcguauagaaucaaacagaagggcauucugggcuacucccagaucggcgccgggguguauaaggaaggaaccuuucauacaauguggcacguuacccggggcgcugugcuuaugcauaaagggaagagaaucgagcccuccugggccgacgucaaaaaggaucugauuagcuacggaggcggguggaaacucgagggagaauggaaggagggcgaagaggugcaagugcuggcccucgaaccuggcaagaacccgcgcgcuguucagacgaaacccgggcuguucaagaccaacgccggaacaaucggcgcggucucccuugacuuuagcccugggaccucuggaucccccauuaucgauaaaaagggcaaagugguggggcuguacggaaauggcgucgugacacggaacggcagcuauguuucugcuauugcccagaccgggaaguccaucgaggacaauccugagaucgaagaugacauuuucagaaagaaacgccugacaaucauggaucuccaccccggagccggcaagacgaaacgguaccugccugcuauugugagagaggccaucaagcgcgggcuucggacccugauucucgcgccgacaagagucguggcugccgaaauggaggaagcccugcgcggacuccccauccgguaucagaccccugcuauuagagccgagcauaccggccgggagaucguugaccugaugugucacgcuacauucacgaugcgccuucugagccccaucagagugccuaacuacaaucugauuaucauggaugaagcccacuuuaccgaccccgcguccauugccgcucggggguauaucucuacacgcgucgagaugggcgaagccgcuggaauuuucaugaccgccacaccgccuggcagcagagaccccuuuccccaauccaacgccccuaucauggaugaggagcgggaaauccccgagagaagcuggaacucugggcaugaaugggugaccgacuucaaaggaaagacgguuugguuugugccuuccauuaaggcuggcaacgauaucgcggccugccuccgcaaaaaugggaagaaagucauucagcugagccggaagacauucgacucugaguacgugaaaaccagaaccaacgauugggacuuuguggucacaaccgauaucagcgaaaugggagcuaauuucaaggccgagcgcguuauugacccgcggagauguaugaagcccgugauccuuacagauggcgaggaacgcgugauccuggccgggccuaugcccgucacccacuccucugcugcccagcggagaggccgcauuggaagaaacccuaaaaaugagaacgaccaauauaucuacaugggcgaaccccucgagaaugaugaagaccaugcgcacuggaaggaggcuaaaaugcugcuggacaacauuaacacgccggaggggaucauuccuagcauguuugaacccgagcgggaaaagguggaugccaucgacggagaguaccgccucagaggcgaagcccggaaaacauucguugaucuuaugcgcagaggggaccugccuguguggcuggcuuauaaggucgccgcggagggaauuaauuacgccgaucggagauggugcuuugacggcauccgcaacaaucagauccucgaggaaaacguggagguugaaauuuggaccaaagagggggagcggaagaagcugaaacccagauggcuugaugcucgcaucuauuccgacccucuggcccucaaggaguucaaagaguucgcugccggccggaagucucugacacugaaucucauuaccgaaaugggaagacuucccacguuuaugacccagaaagcucgggaugcccuggacaaccuggcggugcuccacacagccgaggcuggcgggcgcgccuacaaucaugcucugagcgaacuuccggagacccuggagacacuccugcugcucacccuucuggccacagucaccggaggcaucuuccuguuucucauguccgggaagggaauuggcaagaugacgcugggcauguguugcaucaucacagccagcgugcuucugugguaugcucagauucaaccucacuggaucgcggccucuauuauccucgaguucuuucugauuguccugcucauccccgagcccgaaaaacagagaaccccucaggauaaccagcuuaccuacgugguuaucgcuauucugacagugguggccgccaccauggcuaaugagaugggguuccuggaaaagacaaagaaagacuuuggacucggcuccaucgccacgcaacagccggagagcaacauucuggauaucgaccuucggcccgcguccgccuggacccuguaugcugucgccacaaccuucauuacaccuaugcuccgccauucuaucgagaauagcuccguuaacgugucucugaccgcuauugccaaucaggcgacggugcugauggggcucggaaaaggcuggccccuuagcaagauggacaucggggucccucugcuggccaucggaugcuacucccaggugaaccccauuacccucacagcugcccugcuucugcucguugcucacuacgccaucauuggcccuggccugcaagcuaaggccaccagagaagcgcagaaacgggccgcugccgggaucaugaagaauccgacaguggauggaauuaccgucaucgaccuggaucccaucccuuaugaccccaaauuugagaagcagcucggccaggugaugcuucugguccugugugugacgcaaguucucaugaugcgcacaaccugggcucugugcgaagcccuuacacuggccaccgggccuauuagcacccucugggagggaaaccccggcagauucuggaauacaacgaucgcggugucuauggcuaacauuuuucggggguccuaccuggccggagcuggccuccuguucagcaucaugaaaaacaccacaaauacccgcagaggcacagggaacauuggagaaacccuuggcgagaaguggaagucucggcugaaugcccuggggaaauccgaguuucagaucuauaagaaaagcggaauccaggaagucgauagaacgcucgccaaggagggcauuaaacgcggggaaacagaccaucacgcugugucucggggaagcgccaagcugagaugguucguugagcgcaacauggugaccccggagggcaaagucguggaucuuggcugugggcggggaggcugguccuacuauugcgggggacugaagaaugugagagaaguuaagggccucaccaaagggggaccuggccacgaggaacccauccccaugucuacauacggcuggaaccugguccgccugcaaagcgggguggacguguucuuuaccccucccgagaagugugauacacuccuuugcgacauuggagaauccagcccuaauccgacggucgaggcgggccggacccugagaguucugaaccucguggagaauuggcugaacaauaacacacaguucuguaucaaagugcuuaaucccuauaugccuuccgucauugaaaagauggaggcccugcagcgcaaauacgggggagcucucgugcggaacccccugucuagaaauagcacccaugaaauguacuggguuuccaacgccucuggcaacaucgugagcuccgucaauaugaucucucgcaugcugauuaaccgguuuacaaugagacacaagaaggcuaccuaugagccugauguggaccucgggagcggaacgcgcaauaucggcauugaauccgagguucccaaccuugauaucauuggcaaaagaaucgagaagauuaaacaggaacaugagaccagcuggcacuacgaccaagaccacccguauaagacaugggccuaccaugggucuuaugaaaccaaacagacaggauccgcgagcucuauggugaauggcgucgugcggcugcugaccaagccuugggaugugauccccauggucacacagauggccaugaccgacacgacaccuuucgggcagcaacgcguuuuuaaggagaaaguggauaccagaacccaggaacccaaggagggaaccaaaaagcucaugaaaaucacggcugaguggcuguggaaggaacuuggcaagaaaaagaccccucggaugugcacaagagaggaguucacccggaaagugcgcuccaacgccgcucugggggccauuuuuacagacgagaauaaguggaaaagcgcuagagaggccgucgaagauucucgguucugggagcucguggacaaggaacgcaaccugcaccuggagggaaaaugugaaaccugcguuuacaauaugaugggcaagagagagaagaaacucggcgaguuugggaaggcgaaaggaucccgggccaucugguauauguggcugggcgcucgcuuccuugaauuugaggcccugggguuccucaacgaagaucauugguuuagcagagaaaauucccugagcggaguggaaggcgaggggcuucacaagcugggcuacauucuccgggacgucucuaaaaaggagggaggcgcuauguacgccgaugacacagccgggugggauacccgcaucacgcuggaagaccugaagaacgaggaaauggugaccaaucauauggagggagaacacaaaaagcucgcggaggcuauuuucaaacugacauaucagaacaagguugugagaguccagcggcccaccccgcgcggcacagugauggacaucaucagcagacgggaucaacgcggguccggacagguuggcaccuacgggcuuaauacguucacaaacauggaggcccagcugauuagacaaauggaaggcgagggaguguuuaaaucuauccagcaccucaccgccacagaagagauugcuguccagaacuggcuggcccgggugggcagagagcgccuuagccggauggcuaucuccggggacgauugugucgugaagccucuggacgauagauucgccucugcgcucaccgcccugaaugacaugggaaagguucgcaaagauauucagcaaugggaacccagccggggcuggaacgacuggacacaggugcccuuuugcucccaucacuuccaugagcugaucaugaaggaugggagaguccucguggugccuugccgcaaucaggacgaacugaucggacgggcuagaauuucucagggcgccggguggagccuucgcgagaccgcuugucugggcaaauccuaugcccaaauguggagccucauguacuuucaccggagagaucugcgccuugcggccaacgcuaucugcucugccguuccgucccacugggugcccacaagccggaccacauggucuauucaugcuaagcacgaauggaugaccacagaggacaugcugaccgucuggaauagaguguggauccaggagaacccuuggauggaagauaaaacgcccguugaguccugggaagagauuccuuaucucggaaagcgggaagaccagugguguggcagccugaucgggcugacauccagagccaccugggcuaagaauauucagaccgccaucaaccaagugcgcucucucaucggaaaugaggaguacacagacuauaugcccagcaugaaacgguucagacgcgaagaggaagaggcgggcguccugugguga

SEQ ID NO: 19540 - RNA, 9876 nt, Artificial Sequence
  derived and/or modified CDS sequence (opt5) from DENV-2__KF744408__SS-prME
accgccggcaugaucauuaugcugauccccacggugauggcuuuccaccucacgacccggaacggggaaccucauaugauugucucccggcaggaaaagggaaaaucccugcuuuuuaagacagaagacggcguuaauaugugcacccugauggccauggaucucggggaacugugugaagacacaaucaccuacaaaugcccgcuucugagacaaaacgaacccgaggauauugacuguuggugcaauucuacaagcaccugggugacguauggaaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacaaacuuucagagagcucuuauuuucauccugcucacggccguugcgccuuccaugaccaugcggugcauuggaaucucuaaucgcgauuuuguggaaggcgucagcgggggauccuggguggacauuguucuggagcacggcagcugugugacaaccauggccaagaacaagcccacacuugauuucgaacugaucaaaaccgaggcuaagcacccugccacgcucagaaaauauugcaucgaagcuaagcugacaaauaccaccacagccucucgguguccgacccagggggagcccucccugaacgaggaacaagacaaacgcuuugucugcaagcauagcaugguggauagaggauggggcaauggcugugggcuuuucggaaagggcgggauugugacaugcgcgauguuuacgugcaaaaagaacauggagggaaaaaucguccagccugaaaaucuggaguacaccauuguuaucacaccccacucuggcgaagaacaugccguggggaacgacaccggaaagcacggcaaagagauuaagaucacaccucaguccagcaucaccgaagcugagcuuacgggcuaugggaccgugacaauggaauguucuccccggaccggacugggcuucaaugagaugguccuccugcagauggaagauaaagccuggcuugugcaccgccaaugguuucuggaccucccgcugccuuggcugcccggggcugauacacagggauccaacuggauucagaaggagacccucguuacguucaagaauccucaugccaaaaagcaggacguggucgugcugggcagccaagagggggccaugcacacagcucuuaccggcgcgacagaaauccagauguccucuggaaaccugcucuuuaccggccaucugaaaugcagacuucggauggacaagcugcagcucaaagggaugagcuacuccauguguaccggaaaguucaagguugugaaagagauugccgaaacacaacacggcacgaucgucgugagaguccaguaugagggggauggaagccccugcaagauucccuucgagaucauggaccuggaaaaacgccaugugcugggccggcucaucaccguuaacccuauugugacagagaaggauucuccggucaauaucgaagcugagcccccuuuuggggacuccuacgugauuaucggcguugaacccggacagcugaaacuuagcugguucaagaagggcucuagcauugggcagauguuugagaccacaaugagaggagccaaacgcauggccauccugggcgauaccgcuugggacuucgggucccucggaggcguguuuacgucuauugggaaggcccugcaccaagucuucggcgcgaucuacggagcugccuuuagcggcguguccuggacaaugaaaauccugauuggggugaucauuaccuggaucggaaugaacagccggucuaccucccuuagcguuucucucguccuggugggcguggucacacuguaucucggggugguugugcaggccgauuccggaugugucgugagcuggagaaauaaggagcugaaaugcggcuccgggauuuucaucaccgacaacguucacacauggacggaacaguacaaguuucagccugagucucccagcaaacuugcuuccgccauccaaaaagcucaucaggaaggcauuuguggaauccgcucugugacccggcuggagaaucucauguggaagcagauuacaccggaacugaaccacauccugagcgagaaugaggucaaacuuaccauuaugacaggcgauaucaaggggaucaugcaggccggaaaaagaucccuccgcccucaacccaccgaacugcgguauagcuggaagacguggggcaaagcgaagauucugucuaccgagucccauaaccagacauuccucaucgacgggccugaaaccgccgagugccccaauacaaacagagcuuggaauagccuggaaguggaggauuacggauuuggcguuuucaccacaaacauuuggcuucgccugcgggagaagcaggacgccuuuugugacucuaaacucauguccgcugccaucaaggauaauagagcggugcacgccgacaugggcuauuggauugaaagcgcucugaacgauaccuggaaaaucgagaaggccucuuucaucgaagucaaaagcugccacuggccuaagucccauacgcuguggagcaauggggugcuugagucugagaugauuauccccaagaacuucgcuggaccggugucccagcacaacuaccggccuggcuaucauacacaaaccgccgggcccuggcaccucggaaaacuggaaauggacuuugauuucuguaagggcaccacagucguugugaccgaggacugcgggaaucgcggacccagccugagaacgacaaccgccuccggcaaacucauuacagaauggugcugucggucuugcacccugccuccgcuuagauaccgcggcgaggauggguguugguacggaauggaaauccggccccugaaggagaaagaggaaaaccucgugaauagccuggucacagcuggccaugggcagauugacaacuuuucccugggagugcuuggcauggcccucuuccuggaggaaaugcugagaacccgcguugggacgaagcacgccauccuccugguggcugucucuuuugugacccuuauuacaggaaauaugagcuucagagaucugggccggguuauggugauggucggcgccaccaugacagacgauaucgggaugggagugaccuaucucgcccugcuggcugccuuuaagguucgcccuacguucgcggcuggccuucugcucagaaaacugacauccaaggagcucaugaugaccacaaucgggauugugcugcuuucucagagcaccauccccgaaaccauucuggagcucacagacgcccuggcccugggaaugaugguccuuaaaaucgugcggaacauggagaaguaccaacuggcugugacgauuauggccauccucugcgucccuaaugcgguuauccugcagaacgcuuggaaaguguccuguaccauucucgccguggucagcgugucuccccugcuucugacauccagccagcagaaggccgauuggaucccucucgcucugaccauuaagggccugaaucccacagccaucuuucuuaccacgcugucucgcacauccaaaaagagaagcuggccgcucaacgaagcuauuauggccguugggauggugucuauccuggcguccagccuccugaaaaaugacaucccuaugaccggaccccuugucgccggcggccugcugaccgugugcuauguucucacagggcgguccgcugaccuggagcuugaaaaggccgcugaugugcgcugggaggaccaagccgaaauuagcggaucuagcccuauccuguccauuaucauuucugaggauggcagcauguccaucaaaaacgaggaagaggaacagacccucacaauucugaucagaacggggcuccuggucaucucuggacuuuuccccgugagcauuccgaucaccgccgcugcgugguaccugugggaggucaagaaacagcgggccggcgugcugugggacguuccuucucccccucccguggggaaggcugagcucgaagauggagccuaucgcauuaagcagaaaggcauccugggcuacagccaaauuggggccggagucuauaaggagggcacauuucacaccauguggcaugugacaagaggggcuguucuuaugcacaaaggaaagcggaucgaacccagcugggccgacgugaaaaaggaucugaucuccuacggcgggggauggaagcucgagggcgaauggaaagagggcgaggaaguccaggugcuggcgcucgagccugggaagaauccgagagcugugcagaccaaacccggacuguucaagacgaacgccggcaccauuggggccguuagccuugacuuuucuccuggaacauccggcagccccaucauugauaaaaaggggaaggucgugggacuguacggcaauggcguggucacccgcaacgggucuuauguguccgcuaucgcccagacagaaaagagcauugaggacaacccugagaucgaggaugacaucuuccggaagaaaagacugaccauuauggaucuccaucccggagcgggcaagacaaaacgcuaccugccugcuaucguucgggaggccauuaagagagggcuucgcacgcugauccucgccccgacccggguggucgcugccgaaauggaggaagcucugagaggacuccccauucgcuaucaaacgccugcgauccgggcggagcacaccggcagagaaauuguggaccugaugugucaugccaccuucacaaugcggcuucugucccccauccgcguuccuaauuacaaccugaucauuauggacgaggcucacuuuacggaucccgccucuaucgcugccagaggguauauuagcacccggguggagaugggcgaagccgcuggaaucuucaugacagcgaccccgccuggcucccgcgaccccuuuccccagagcaaugccccuauuauggaugaggaaagagagauccccgagcggucuuggaacuccgggcacgaaugggucacagacuucaagggaaaaaccgugugguuuguuccuagcaucaaggcuggcaaugauauugccgccugccuccgcaagaacgggaagaaagugauccagcugucucgcaagacguucgacagcgaguacgucaagacacggaccaaugauugggacuuuguggugaccacagauauuuccgaaaugggagcuaacuucaaagccgagagagucaucgacccgcgccgguguaugaagcccguuauucuuaccgauggcgaagagagagugauccuggcggggccuaugcccgugacacauucuagcgcugcccaacgccggggcagaaucggacgcaauccuaaaaacgagaaugaccaguauauuuacaugggcgaaccccucgagaacgacgaagauugcgcccacuggaaggaggcuaaaaugcugcuggacaauaucaacaccccggaagggauuaucccuuccauguuugagcccgagagagaaaaggucgaugccauugacggagaguaccggcuccgcggcgaagcgagaaaaacguucguggaucuuaugcggcgcggggaccugccuguuuggcuggccuauaagguggcugccgagggaaucaauuacgcugauagacggugguguuuugacggcauuagaaacaaccagauccucgaagagaaugucgagguggaaaucuggacaaaggagggggaacgcaaaaagcugaaaccccgguggcuugaugccagaauuuauucugacccucuggcucucaaggaguucaaagaguucgccgcgggccgcaagagccugacccugaaccucaucacagaaaugggacggcuucccaccuuuaugacgcagaaggccagaaaugcucuggauaaccuggccguucuccauaccgcugaggccggcgggcgggccuacaaucacgcucuguccgaacuuccggagacacuggaaacccuccugcugcucacacuucuggcgaccgugacaggaggcauuuuccuguuucucaugagcgggaaaggaaucggcaagaugacccugggcaugugcugcauuaucacggccucuguccuucugugguaugcucaaauccagccucacuggauugccgccuccaucauucucgaguucuuucugaucgugcugcucauucccgagcccgaaaaacagcgcacaccucaggacaaccaacuuaccuacgucgugaucgcuauccugaccguuguggccgcgacaauggccaaugagaugggguuccuggaaaagaccaaaaaggaucucggacugggcagcauuacaacgcagcagccggaguccaacauccuugacauugaccugagacccgcuucugccuggacccucuaugcuguggccacaaccuuuaucacaccuaugcugcggcauagcauugaaaauuccucugucaacguuagccugaccgcgaucgccaaucaggcuacggugcucauggggcuuggaaagggcuggccccuguccaaaauggauauuggggugccucugcucgccaucggauguuacagccaagucaaccccaucacccugacagcugcccuucugcuccugguggcucacuacgccauuaucggcccuggccugcaggcgaaggccacccgcgaggcucagaaaagagccgcugccgggauuaugaagaauccgacaguugacggaaucaccgugauugaucucgaccccaucccuuaugaucccaaauucgagaagcagcuuggccaagucaugcugcuggugcucugcgucacacaggugcugaugaugcggacaaccugggcccuuugugaagcgcugacacucgcuaccgggccuaucucuacccugugggagggaaaccccggccgcuuuuggaauacaacgauugccguuuccauggcuaacaucuucagagggagcuaccuggccggagccggccuccucuuuucuauuaugaagaauaccacaaacacccggcgcggcacagggaacaucggagaaacccugggcgagaaauggaaguccagacugaaugcucucgggaaaagcgaguuccagauuuauaagaaaucuggaauccaagagguggaccggacgcuggccaaggagggcaucaaaagaggggaaacagaucaucacgcggucagccgcggauccgccaaacuucggugguuuguggagagaaacaugauuaccccggaaggcaagguuguggaccugggcugcgggcgcggaggcuggucuuacuauugugggggacucaaaaauguccgggaggugaagggccugaccaaagggggaccuggccaugaggaacccauccccaugagcacauacggcuggaaccuggugagacuccaguccgggguugaugucuucuucaccccucccgagaagugcgacacacuucugugugauauuggagaaagcuccccuaauccgacgguggaggcuggccgcacccugcgggugcucaaccuggucgaaaauuggcuuaacaauaacacacaguuuugcaucaaaguucugaaucccuauaugccuucugugauugagaagauggaggcccuccagagaaaguacgggggagcucuggugcgcaacccccugagcagaaauuccacccacgaaauguacugggucucuaacgccagcggcaauaucguguccucuguuaacaugaucagcagaaugcucauuaaccgcuucacaaugaaacacaagaaagcgaccuaugagccugacguggaucuuggguccggaacgcggaauaucggcauugaaagcgagguccccaaccuggacaucauuggcaagagaaucgagaagauuaagcaagagcaugagaccucuuggcacuacgaccaggaucauccguauaagacaugggccuaccacggguccuaugaaaccaaacagacaggaagcgcuucuuccauggugaauggcguugugcgccugcucaccaagccuugggacgucauccccauggugacacagauggccaugaccgauacgacaccuuuugggcaacagagaguguucaaagagaaggucgacacccggacccaggaacccaaagagggaacaaagaagcugaugaaaaucacggcugaauggcuuuggaaggagcugggcaaaaagaaaaccccucgcauguguacaagagaggaauuuacccggaagguuagaagcaacgccgcucucggggccauuuucacagaugagaauaaauggaagucugcgcgggaagccguggaggacucccgcuuuugggagcugguggauaaggaaagaaaccugcaccucgagggaaaaugcgaaaccugugucuacaauaugaugggcaagcgggagaaaaagcugggcgaguucgggaaagcuaagggaagccgcgccaucugguauauguggcuuggcgcuagauuucuggaguucgaggcccucggguuucugaacgaagaccauugguucucccgggagaauagccuuucuggaguggaaggcgaggggcugcacaagcucggcuacauucugcgcgauguuagcaaaaaggaaggaggcgccauguacgcggacgauacagcugggugggacaccagaaucacgcuggaggaccucaaaaacgaggaaauggugaccaaucauauggagggagaacacaagaaacuggccgaggccauuuuuaaacuuacauaucagaacaaggucgugcggguucaacgccccaccccgagaggcacagugauggauaucaucucccggcgcgaccagagagggucuggacaggucggcaccuacgggcugaauacguucacaaacauggaagcucaacucauucggcagauggagggcgagggaguguucaaaagcauccagcaucugaccgccacagaagagauugcuguucagaauuggcuugcccgcgugggcagagaacggcuguccagaauggcgaucucuggggaugacugcgucgugaagccucucgaugaccgcuuugccagcgcucugaccgcccugaacgauaugggaaaaguccggaaggacauucaacagugggagcccuccaaaggcuggaacgauuggacacaggugcccuucugcucucaccacuuucaugagcucaucaugaaggacgggagaguucugguggucccuugucgcaaucaggaugaacuuaucggacgggcuagaauuagccaaggcgccggguggucccugcgcgagaccgcgugccucggcaagagcuaugcccagauguggucucugauguacuuccaccggagagaccuucgccuggcugccaacgcuaucuguuccgccgugccgagccauugggugcccacaucucggaccacaugguccauucacgcuaaacacgaauggaugaccacagaggauaugcucaccguuuggaauagaguguggauccaggaaaacccuuggauggaggacaagacgcccgucgagagcugggaagagauuccuuaucugggaaaacgcgaagaccaguggugcggcucccugaucgggcucacaucucgggccaccugggcgaagaauauucaaaccgccaucaaccaggugagaagccugaucggaaaugaggaauacacagauuauaugcccuccaugaaacgguuuagacgcgaggaggaagaggcuggcguucuuugguga

SEQ ID NO: 19541 - RNA, 9876 nt, Artificial Sequence
  derived and/or modified CDS sequence (opt5) from DENV-2__JX669476__SS-prME
accgccggcgugaucgucaugcucauucccacagcuauggccuuccaccucacgaccagaaauggggaaccucauaugaucguuggacggcaggaaaagggcaagagccugcuuuuuaagacagaagacggggugaauaugugcacccugauggcgauugaucucggagaacugugugaagacacaaucaccuacaagugcccgcuucugcgccaaaaugaacccgaggauauugacuguuggugcaauuccacaucuaccugggugacguauggcaccuguacaaccacaggggagcacagacgggaaaagcgcagcguugcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagagcgagaaccucgaauacaccauugugaucacaccucacucuggggaggagcaugcggugggaaaugacaccggcaagcacggcaaagaaaucaagauuacaccccaguccagcaccacggaggccgaacugaccggguauggaacagucaccauggaguguucuccucggacaggccuugauuucaacgaaauggugcugcuccaaauggaggacaaggcuuggcugguucaccgccagugguuucuugaucugccccucccguggcugccuggggccgacacccagggauccaauuggauccagaaggagacgcuggugacauucaagaacccccaugcuaaaaagcaagacgucgugguucucggcagccaggaaggggccaugcacaccgcccugacaggcgcuaccgagauucagauguccucuggaaaucuucuguuuaccggccaucucaaaugcagacugcggauggauaaacuucaacugaaagggaugagcuacuccauguguacaggaaaguucaagaucgugaaagaaauugcggagacgcagcacggcaccaucgucaucagagugcaguaugagggggacggaagcccuugcaagauucccuucgaaaucacagaucucgagaaacgccauguccugggccggcugauuaccgugaaccccaucguuacagaaaaggacucuccugugaacauugaggccgaaccgcccuuuggggauuccuacaucauugucggcguggagccuggacagcucaaacugaauugguucaagaagggcagcucuaucgggcaaauguuugagaccacgaugagaggagcuaaacgcauggccauccuuggcgacacagccugggauuucgggagccugggaggcguuuuuaccuccauugggaaggcucuccaccagguguucggcgccaucuacggagcggcuuuuucuggcgucagcuggaccaugaaaauucugaucggggugauuaucacauggaucggaaugaacucccggagcaccucucuguccgugagccuuguucucgucggcguggugacacuguaucugggggccaugguccaggccgacucuggauguauuguguccuggaagaauaaagaacucaagugcggcagcgggaucuucauuacggauaacguucacaccuggacagagcaguacaaguuucaacccgaguucccuuccaaacuggcuucugccauccagaaggcucaugaggaaggcauuuguggaaucagaagcgugacccgccuugagaaucugauguggaaacagaucacacccgagcucaaccacauucuguccgaaaaugaggucaagcugaccaucaugacgggcgacauuaaagggaucaugcaggccggaaagcggucucuuagaccgcaaccuaccgaacucaaauauagcuggaagacauggggcaaggcgaaaaugcuguccaccgagagccauaaccagacauuucugauugaugggcccgaaaccgccgagugcccuaauacaaaccgcgcuuggaacucucucgagguggaagacuacggauucggcguuuuuaccacgaacaucuggcugaaacuucgggagaaacaggacguguucugugauuccaagcugaugagcgccgcuaucaaagacaauagagccguccacgcggauaugggcuauuggauugaaucugcccucaacgacacauggaagguggagaaggcuuccuucaucgagguuaaaagcugccacuggcccaagucucauacccuguggagcaauggggugcuggaauccgagaugauuaucccuaaaaacuuugccggacccgucagccagcacaacuaccgcccgggcuaucauacccaaacagcugggccuuggcaccuuggaaagcucgaaauggauuucgacuuuugugagggcaccacggugguggucacagaagauugcgggaaucggggacccucucugagaaccacaaccgccuccggcaaacugauuacagaguggugcugucggagcugcacccugcccccucugcgcuacagaggcgaggacggguguugguacggaauggaaauccggccgcuuaaggagaaggaagagaaccugguuaauucccucgugacggccggccaugggcagauugauaacuucucucugggagugcugggcauggcucuuuuucucgaagagaugcugagaacccgcgucgggacaaaacacgcgauccugcucguggcccugagcuucguuacccuuaucacaggaaauauguccuuucgggaccugggcagagugauggucauggugggcgcuaccaugacggaugacauugggaugggaguuacauaucucgcccugcuggccgcuuucaaggugcgccccaccuuugccgcgggccuucugcucagaaaacugacaucuaaggagcucaugauggcuaccaucgggauugcccugcuuagccaguccacccugccugaaacaauccucgagcugacggaugcccuggcucuuggaaugauggcccugaaaauuguccggaacauggaaaaguaccaacucgcggugaccaucauggcuaucucuugcguucccaaugccgugauucugcagaacgccuggaaggucagcuguacaauccucgcugccguguccgugagcccucugcuucugaccucuucccagcagaaaacagacuggauuccccucgcucugaccaucaagggccugaauccuacggccauuuuccuuacaacccugagccgcaccucuaaaaagagauccuggccccucaacgaggcgaucauggccgucgggaugguuagcauccuggcuucuucccuccugaaaaaugacauuccgaugacaggaccucuuguggccggcggccugcugaccgugugcuauguccucacagggcggagcgcugaucuggaacuugagcgcgccgccgacgugaagugggaggaucaagcugaaaucuccggaagcucucccauucugagcaucacgauuuccgaggacggcucuaugagcaucaaaaacgaagaggaggaacagacccucacaauucugaucagaaccgggcuccugguuaucuccggaguguuuccugucucuauucccaucacagcggccgcuugguaccuuugggaggugaagaagcagcgggccggcguucugugggaugugccgagcccucccccugucgaaaaagccgagcuggaagacggggcuuaucgcauuaagcagagaggaauccucggcuacucccaaauuggcgccgggguguauaaagagggaaccuuccacacgauguggcaugucacccggggcgcggugcugaugcaccgcgggaagagaaucgagcccucuugggcugauguuaaaaaggaccuuaucagcuacggaggcggguggaagcuggaaggagaguggaaagaaggcgaggaagugcagguccucgcccuggagcccggcaagaauccucgggccgugcagacaaaaccggggauuuuuaagaccaacacaggaaccaucggcgcuguuucccucgauuucagccccgggacaucuggauccccuauuguggacagaaaaggcaaggucguggggcuguacggaaauggcgugguuacgcgcagcggcgccuaugucucugcgaucgcucagaccgagaaguccauugaagauaaccccgagaucgaagacgauaucuuccggaaaaagagacuuacaauuauggaccugcauccuggggccggaaaaaccaagcgcuaccugcccgccaucgugcgggaggcuauuaaaagaggccuccgcacccugauccuugccccuacacggguggucgcugccgaaauggaggaggcgcugagagggcucccgauucgcuaucaaacgcccgccauccgggcugaacacaccggaagagagauuguggaccugaugugucaugccacauuuaccaugcggcuccugagcccuguucgcgugcccaacuacaaucuuaucaucauggaugaagcucacuucacagacccugccuccauugccgcuagaggcuauaucucuacccgggucgagaugggggaggcggccggcauuuuuaugacggcuacacccccgggaagccgcgauccuuucccccaguccaacgcccccaucauggacgaagagagagaaauuccugagcggagcuggaacucuggccacgaaugggugaccgauuuuaaggggaagaccguuugguucgugcccuccaucaaagccggaaacgacaucgcugccugccugagaaagaauggcaaaaaggucauucagcugagccgcaaaacauuugauucugaguacgugaagacccgggcgaacgacugggauuucguugugacaaccgacaucagcgagaugggggcuaauuuuaaggccgaaagagucauugauccucgccgguguaugaaaccggugauccucacggacggagaggaaagagugauucuggccggccccaugccugucacacauuccucugcugcccaacgccgggggagaaucggccgcaaccccaagaaugagaacgaccaguauaucuacaugggagaaccucuugagaaugaugaggacugcgcgcacuggaaagaagccaagaugcugcucgauaacauuaauacccccgagggcaucauuccgagcauguucgaaccugagagagaaaaaguugacgcuaucgauggggaguaccggcugcgcggagaggccagaaagacauuuguggaccugaugcggcgcggcgaucuccccguguggcuugcuuauaaagucgccgcugaagggauuaacuacgccgacagaaagugguguuucgauggaaucaagaauaaccagauucuggaggaaaacguggagguugagaucuggaccaaagaaggcgagcggaagaaacugaagccuagauggcucgacgcgcgcaucuauuccgauccccuggcccuuaaagaguucaaggaguuugcugccgggcggaagucucugacgcucaaucugauuaccgaaaugggcagacugccuacauucaugacccagaaagcucgcaacgcccucgacaaucuugccgugcugcauacagcugaggucggaggccgggcguacacccacgcccugagcgagcuccccgaaacacuggagacccuucugcuccugacgcugcucgcugccgugacagggggaaucuuucuuuuccugauguccggcaaggggauuggaaaaaugacccugggcaugugcugcaucauuaccgccagcauccuccugugguaugcucaaauccagccgcacuggauugccgcgucuaucauucuugaauuuuuccugaucguucuccugauuccugagcccgaaaagcagagaacaccccaggauaaccaacugaccuacguggucaucgccauccucacaguggucgcugccacgauggcuaaugagaugggcuuucuugagaaaaccaagaaggaccugggguucggauccauuacaacccaggaaagcgaguccaacauccuggacauugaucuccggccugccucugcguggacacuguaugccguggcuaccacguuuguuaccccgaugcuucgccauagcaucgaaaauuccucugugaacgugagccugacagccauugcuaaucaggccaccguccucaugggccuggggaaaggauggccccuguccaagauggacaucggcguuccucuccuugcuauuggguguuacagccaggugaaccccaucacacugaccgccgcgcugcuccugcuuguggcccacuacgcuaucauuggaccuggccugcaagccaaagcuacgagagaggcccagaagcgggccgcggcuggcaucaugaaaaaucccacagucgaugggauuaccgugaucgaccucgaaccuauuccguaugaucccaaguucgagaagcagcugggacagguuaugcugcucauccuuugcgugacacaaguccugaugaugcgcaccaccugggcccugugugaggcucucacacuggccacgggcccuaucucuacccuuugggaagggaaccccggaagauuuuggaauacaaccauugccguguccauggcuaacaucuuccggggcagcuaccuggccggggcgggacuccuguuuucuauuaugaaaaauacaaccaacacgcgcagaggcacaggcaaugucggggagacccugggagaaaaguggaaaucccggcucaacgcccuuggcaagagcgaguuccagaucuauaaaaagucugggauucaggagguggaccgcacccuggcuaaagaaggaaucaagagaggcgagacagaucaucacgccguuagccggggguccgcuaagcugagaugguucguggaacgcaacauggucaccccugagggaaaagugguugaccucggcugcggcagagggggauggucuuacuauuguggcgggcugaagaaugugcgggaagucaaaggacuuacaaagggcgggcccggacaugaggagccgaucccuaugagcacguacggcuggaaccuggugcgccuccaauccggcguggaugucuuuuucaccccucccgaaaaaugcgacacacugcugugugauauuggggagagcucccccaaucccaccaucgaagccggacggacacucagaguccuuaaccugguggagaauuggcugaacaauaacacccaguuuugcauuaaggugcucaauccuuauaugccgucugucaucgaaaagauggagacgcugcagcgcaaauacggcggggcgcuuguucggaacccccugagcagaaauuccacccacgagauguacugggugucuaacgccacaggaaauauugugagcuccgucaacaugaucucucgcaugcucaucaaucgguucaccaugaagcacaaaaaggcuacauaugaaccugacguggaucugggcagcgggaccagaaacauuggaaucgaguccgaaauucccaaccuggacaucauuggcaaacgcaucgagaagauuaagcaggaacaugagaucagcuggcacuacgaccaagaucauccuuauaaaacaugggccuaccacggcucuuaugagaccaagcagacgggguccgcuagcucuaugguuaauggagugguccggcuccuuacaaaacccugggacgugguuccgauggugacccagauggccaugaccgauacaacgccuuuuggccagcaaagagucuucaaggaaaaaguggacacccgcacacaggagcccaaggaagggaccaagaaacugaugaagaucacagcugaguggcuguggaaagagcucggaaaggagaagaccccuagaauguguacacgggaggaauuuacccgcaaggugagauccaacgccgcgcugggcgccgucuucacggaugagaauaaauggaaaagcgcucgggaagccguugaggacgauagauuuugggagcuuguggaccgggaacgcaaccugcaccucgaggggaagugcgaaaccuguguguacaauaugaugggaaaaagagagaagaaacugggcgaguucggcaaggcuaaagggucucgggccauuugguauauguggcugggagcccgcuuucucgaguucgaggcgcugggcuuucuuaacgaagaucauugguucuccagagggaauagccuguccggagucgagggcgaagggcuccaccggcugggcuacauccuucgcgaggugggaaagaaggaaggcggggcuauguacgccgacgauacagccggaugggacaccagaauuacacuggaggaccucaaaaacgaggaaaugguuaccaaucauaugaagggcgagcacaaaaagcuggcugaagccaucuucaaacugacguaucagaacaaggugguccgggugcagcgccccacaccuagagggaccguuauggauauuaucagccggaaggaccaacgcggaucuggccagguggggacauacggccucaauaccuuuacgaacauggaggcucagcugaucagacaaauggagggagaaggcauuuucaaaagcauccagcaucuuaccgccacagaggaaauugcgguccagaauuggcuggcccggguggggcgcgagagacucucccggauggcuaucucuggagaugacugcguugugaagcccauugaugacagauuugccagcgcucugaccgcccuuaacgauaugggcaaaguccgcaaggacauccagcaaugggaaccgucccggggguggaaugauuggacacaggugccuuucugcucucaccacuuucaugagcuggucaugaaagacggaagagugcucguugugcccugucgcaaccaggaugagcugaucggccgggcgagaauuagccagggggccggcuggucccugaaggaaaccgcuugccucggaaagucuuaugcccaaauguggacacugauguacuuccaccgccgggaccuuagacuggcugccaacgcuaucuguagcgccguccccucccauugggugccuaccagccgcacgacauggucuauucacgcgaaacacgaguggaugaccaccgaagauaugcucacaguguggaaucggguuuggauccaggagaacccguggauggaagacaagacccccguggaguccugggaggaagucccuuaucugggcaaaagagaggaccaguggugcgggagccuuauuggacugacaucucgcgccacgugggcuaagaauauccagaccgccauuaaccaagugcggucccucaucggcaaugaaggguacacagauuauaugcccagcaugaaaagauuucggagagaggaagaggaggccggaguucugugguga

SEQ ID NO: 19542 - RNA, 9876 nt, Artificial Sequence
  derived and/or modified CDS sequence (opt5) from DENV-2__JX475906__SS-prME
accgugggaaugaucauuaugcugauccccaccgccauggcuuuccaccucacgaccagaaauggggaaccucauaugauugucagccggcaggaaaagggaaaaucccugcuuuuuaagacagaagacggcguuaauaugugcacccugauggccauggaucucggggaacugugugaggacaccgugaccuacaacugcccccuucugcgccaaaaugaacccgaggauaucgacuguuggugcaacucuacaagcaccugggugacguauggaaccuguacagcgaccggcgagcacagacgggaaaaacgcuccgucgcucucgugccucauguugggaugggacuggagacaagaaccgaaacguggaugucuagcgagggcgccuggaagcacgcccagcggauugagacauggauccugcgccaucccggcuucaccaucauggcugccauucucgcuuacacaaucgggaccaccuauuuucagagagugcugauuuucauccuucugacagccgucgcgccuuccaugacgaugcggugcauuggaaucucuaaucgcgauuuuguggaaggcguuagcgggggauccuggguggacauuguccucgagcacggcagcugugugaccacaauggccaaaaacaagcccacccuggauuucgaacuuaucaagacagaggcuaaacagccugccacccugagaaaguacugcaucgaagcuaaacucacgaauacaaccaccgccucucgguguccgacacaaggggagcccucccugaacgaggaacaggacaagcgcuuugugugcaaacacagcauggucgauagaggauggggcaauggcugugggcuguucggaaagggcgggauuguuaccugcgcgauguuuacaugcaagaaaaacauggagggaaagaucgugcagccugaaaaucucgaguauacgauugugaucacaccccauucuggcgaagagaacgccgucgggaaugacacaggaaaacacggcaaggaggugaaaguuaccccucaguccagcauuacagaagcugagcugaccggcuacgggacggugaccauggaauguucuccccggacaggacuugauuucaacgagaugguccugcuccaaauggaaaauaaggccuggcuggugcaucgccagugguuucuugaccugccgcucccuuggcugcccggcgcugauacccagggguccaacuggauccagaaagagacacugguuaccuucaagaacccucacgccaagaaacaagacguggucgugcucggaagccaggagggcgccaugcacacggcucugacaggggcgaccgaaauccagauguccucuggcaaucuucuguuuacaggacaucucaagugcagacugcggauggacaaacuucaacugaagggcaugagcuauuccauguguaccgggaaauucaaggucgugaaggagauugccgaaacccagcacggaacaaucguuauuagagugcaguacgagggcgaugggagccccugcaaaauccccuucgagauuauggaccucgaaaagcgccauguccugggacggcugaucacggugaacccuaucguuaccgagaaagauucuccggugaauauugaagcugagcccccuuuuggcgacuccuacaucauuaucggggucgaacccggccagcucaagcugagcugguucaaaaagggaucuagcauuggccaaauguuugagacaaccaugagaggggccaagcgcauggccauccuuggagauacagcuugggacuucggcucccucgggggaguguuuaccucuauuggcaaagcccuccaccagguguucggggcgaucuauggcgcugccuuuagcggaguuuccuggacgaugaagauccugauuggcgucgugaucacauggauugggaugaacagccggucuaccucccugagcgugucucuuguccucgugggaguugugacccuguaccugggcgucauggugcaggccgauuccggguguguugugagcuggaaaaauaaggagcucaaaugcggauccggcaucuucauuacagacaacguccauaccuggacagaacaguauaaguuucaaccugagucucccagcaagcuggcuuccgccauccagaaagcucacgaagaggggaucuguggcauuagaucugugacgcgccuugaaaaucugauguggaagcagaucaccccggagcucaaccacauucugagcgagaaugaaguuaaacugacaaucaugaccggagauauuaagggcaucaugcaggccgggaaacggucccuuagaccucaacccacagagcucaaguacagcuggaaaaccuggggaaaggcgaagaugcugucuacggaaccucauaaccagaccuuccugaucgacggccccgagacagccgaaugcccuaauaccaaccgcgcuuggaacucccucgagguggaggauuauggguuuggagucuucacaaccaacauuuggcugaaacuuaaggaacggcaggacguguuuugugacagcaaacugaugucugccgcuaucaaggauaauagagccgugcacgcggacaugggcuacuggauugaguccgcccucaacgauacauggaaaaucgaaaaggcuagcuucauugaggucaagucuugccauuggcccaaaagccacacccugugguccaacggcguucuggagagcgaaaugaucaucccgaagaauuucgccgggccugugucucagcacaacuaucgccccggauaccauacgcaaacagcuggccccuggcaccuugggaaacucgagauggacuuugauuucugugaaggaaccaccguggucgugacagaggacugcggcaaucgggggccuucccugagaaccacgacagccagcggaaagcugauuaccgaauggugcugucgguccugcacacucccgccccugcgcuacagaggcgaggauggcuguugguaugggauggagauccggccucuuaaagaaaaggaggaaaaccugguuaauucucucgugaccgccggacauggccagauugacaacuuuagccuggggguccugggaauggcucuuuuccucgaggaaaugcugagaacacgcgugggcaccaagcacgcgcugcuccugguugccguguccuuuaugacgcuuaucaccgggaauaugucuuuccgggaucugggaagagucauggugaugguuggcgcugccaugacagacgauauuggcaugggggugaccuaccucgcccugcuggcugccuuuaaaguccgccccacauucgcggcuggacuucugcucagaaagcugaccagcaaagagcucaugaugacgacaaucggcauugugcugcuuucccagucuaccaucccugagacaauccuggaacucaccgacgcccuggcccuggggaugaugauucuuaagaucgugcggaacauggagaaauaucaacuggcugucaccauuauggccauccucugcguucccaaugcggugauucugcagaacgcuuggaaggugagcuguacaauccucgccgucguguccguuagcccucugcuucugacgucuucccgccagaaggccgauuggaucccccucgcucugaccauuaaaggacugaauccgacagccaucuuucuuaccacacugagcagaaccaacaagaaacggucuuggccucucaaugaagcuauuauggccgugggcauggucuccauccuggcgagcucucuccugaagaacgacauucccaugacggggccucuuguggccggaggccugcugacaguuugcuacgugcucaccggccgcuccgcugaccuggagcuugaaagagccgcugauguccggugggaggaccaggccgagaucagcggguccagccccauccugucuauuaccaucagcgaagauggauccaugucuauuaaaaaugaggaagaggagcaaacacucaccauccugauucgcacaggccuccuggugaucagcgggcuuuucccggucuccauuccuaucacggccgcugcgugguaucugugggaagugaagaaacagagagccggaguucugugggacgugcccucuccuccgcccgucggcaaggcugagcucgaagauggggccuaccggaucaagcagaaaggcauucugggcuauagccagaucggcgccgggguguacaaggagggaaccuuucauacaauguggcacguuacccgcggcgcugugcuuaugcacaaagggaagagaauugaaccuuccugggccgacguccggaaagaucugaucucuuacggaggcggguggaagcucgagggagaguggaaggaaggcgaggaagugcaagugcuggcgcucgagccgggcaaaaaccccagagcuguucagacaaagccugggcuguucaaaaccaacacgggaaccauuggcgccgucagccuugacuuuucccccgggacaagcggaucuccuaucguggauaagaaaggcaagguggucgggcuguauggaaauggcgugguuacccgcuccggcacauacgugagcgccaucgcucaggccgaaaagucuauugaggacaaccccgagaucgaagaugacauuuuccggaaaagacgccugaccaucauggaucuccauccuggggcgggaaagacaaaacgguaucugccggcuauugucagagaggccaucaagcgcggccuucggacgcugauccucgcccccaccagagugguugcugccgaaauggaggaagcucugcgcgggcucccuauucgguaccagacacccgccaucagagcggagcacaccggacgggagauuguggaccugaugugucaugccaccuucacaaugcgccuucuguccccugucagagugcccaauuauaaccugaucauuauggacgaagcucacuuuacggauccggccagcaucgcugcccggggcuacauuuccacccgcguugagaugggggaagccgcuggcaucuucaugacagcgaccccucccggaucuagagaccccuuuccucaaagcaaugcccccaucauggaugaggagcgggaaauuccugagagauccuggaacagcggccaugaaugggugacagacuucaaagggaagaccgucugguuugugccgucuaucaaggcuggaaaugauauugccgccugccuccgcaaaaacggcaagaaagugauccagcugucccggaagacguucgacagcgaguauauuaaaacaagaaccaaugauugggacuuugucguuaccacagauaucucugaaaugggggcuaacuucaaggccgagcgcgugaucgacccccggagauguaugaagccugugauucuuaccgauggagaggaacgcgucauccuggcgggccccaugccugugacacacagcuccgcugcccagcggagagggcgcauuggcagaaaucccaaaaacgagaaugaccaauacaucuacaugggagaaccgcucgagaacgacgaagauugcgcccacuggaaggaggcuaaaaugcugcuggacaauauuaacaccccugagggcaucauccccucuauguuugaaccugagcgggaaaagguugaugccauugacggggaguaucgccucagaggagaagcgcggaaaacguucguggaucuuaugcgcagaggcgaccugcccgucuggcuggccuaccggguggcugccgaggggaucaacuaugcugauagacgcugguguuuugacggaguuaagaauaaccagauucucgaggaaaauguggaggucgaaaucuggacaaaagagggcgagcggaagaagcugaaaccuagauggcuugaugcccgcauuuacagcgacccccuggcucucaaggaguucaaagaguucgccgcggggcggaagucccugacccugaaccucaucacagaaaugggcagacuuccgaccuuuaugacgcagaaagcccggaaugcucuggauaaccuggccgugcuccauaccgcugaggccggaggccgcgccuauaaucacgcucugucugaacuuccugagacacuggagacccuccugcugcucacacuucuggcgaccgucacagggggaauuuuccuguuucucaugagcggcaaggggaucggaaagaugacccugggcaugugcugcaucauuacggccuccauccuucugugguacgcucagauucaaccccauuggaucgccgccagcauuauccucgaguucuuucugaucgugcugcucauucccgagccugaaaaacagagaacaccgcaggacaaccagcuuaccuauguugugaucgcuauucugaccguggucgccgcgacaauggccaaugagaugggcuuccuggaaaagaccaaaaaggauuuugggcucggaucuaucgcuacacaacagcccgaguccaacauucuggacaucgaccuucggccugccagcgcuuggacgcuguacgccguugcgaccacauucaucacccccaugcuccgccacuccauugaaaauucuagcgugaacgugucccugacagccaucgcuaaucaggccaccguccugaugggccucgggaaaggauggccucuuucuaagauggauauuggcgugccccugcuggcuaucggguguuacagccagguuaacccuauuacgcucaccgccgcucugcuucugcucguggcccacuaugcgaucauuggaccgggccugcaagccaaggcuacaagagaagcccagaaacgggcugccgccggcaucaugaagaaucccaccgucgacgggaucacagugauugaucuggacccuauccccuacgauccuaaauuugagaagcagcucggacaggucaugcuucuggugcugugcguuacccaagugcucaugaugcgcacgacaugggcgcugugugaagcucuuacccuggccacaggccccauuuccacccucugggaggggaacccgggaagauucuggaauaccacaaucgcugucagcauggccaacauuuuucggggcucuuaucuggccggggcuggacugcuguucuccaucaugaaaaacacgaccaauacacgcagaggcaccggcaacacaggggaaacccuuggagagaaguggaagaaucggcugaacgcccugggcaaaagcgaguuucagaucuacaagaaaucugggauucaggaaguggacagaacgcucgcgaaggagggaaucaaacgcggcgaaacagaucaucacgccguuucccgggggagcgcuaagcugagaugguucguggagcgcaaucuugucaccccugagggaaaagugguggaccugggcugcggcagagggggauggucuuauuacuguggcgggcucaagaacguucgggaagucaagggacugaccaaaggcgggcccggacaugaggaacccauuccuaugagcacauauggcuggaaucuggugcgccuccaauccggcguggaugucuucuuuacacccccugagaagugcgacacacuucugugugauaucggggaaucuagcccgaaccccacgguugaggccggacggacccugagagugcucaaucugguggagaacuggcuuaauaacaauacacaguucugcauuaaaguccugaacccuuacaugcccuccgugaucgaaaagauggaggcucuccagcgcaaauacggcggggcccugguucggaauccucugagcagaaacuccacccacgaaauguauugggugucuaacgcgagcggaaauaucgucuccucugugaacaugauuagccgcaugcucaucaaucgguuuacaaugagacauaagaaggccaccuacgagcccgacguugaucuuggcuccgggacgcgcaacauuggaaucgaaucugagaccccgaaucuggacauuaucggcaaaagaaucgagaagauuaaacaggaacacgagacaagcuggcacuaugaccaagaucauccuuacaagaccugggcuuaucacggcuccuacgaaacaaaacagaccgggagcgccucuuccauggugaacggagucgugcggcugcucacaaagcccugggacgugaucccuauggucacccagauggcuaugacggauacaacccccuucggccagcaacgcguuuuuaaggagaaaguggacaccagaacacaggaaccuaaggaggggacgaaaaagcugaugaaaauuaccgccgaguggcuuuggaaggaacugggaaagaaaaagacaccccggauguguaccagagaggaguucacacggaaagugcgcagcaaugcugcccucggcgcgaucuuuaccgaugagaacaaguggaaaucugccagagaggcugucgaagacucccgguucugggagcugguggauaaggaacgcaaucugcaucucgaggggaaaugcgaaacauguguuuauaacaugaugggaaagagagagaagaaacugggcgaguuuggcaaggccaaagggagccgggcuauuugguacauguggcuuggagcccgcuuccuggaauuugaggcccucggcuuccugaaugaagaccacugguuuucuagagagaacucccuuagcgggguggaaggagagggccugcacaagcucggguacauccugcgggaugucuccaaaaaggagggcggagcgauguaugcugacgauaccgccggcugggacacgcgcauuacccuggaagaccucaagaaugaggaaauggugacaaaccauauggagggggaacacaaaaagcuggccgaggcuaucuucaaacuuaccuaccagaauaagguugugagaguccagcggccgacaccucgcggaaccgugauggauaucauuagcagacgggaccaacgcggcucugggcagguuggaacguauggccugaacacauucaccaacaugggggcccagcucaucagacaaauggagggcgaaggaguguuuaaaagcauucagcaucugacagcuaccgaggaaaucgccguccaggauuggcuugcgcgggugggcagagagcgccugucccggauggccauuucuggggacgauugcgucgugaagccccucgacgauagauucgcuagcgcccugacggcucugaaugacaugggaaagguucgcaaagauauccagcaaugggagcccucccggggcuggaacgacuggacccaggugccuuuuugcucucaccauuuccacgaacucaucaugaaggaugggagaguccugguggugccgugucgcaaucaggacgagcuuauuggacgggccagaaucagccagggcgcgggguggucccugcgcgaaacagccugccucggcaaaucuuacgcucaaauguggagccugauguauuuucaccggagagaucuucgccuggccgcuaacgccauuuguuccgcuguucccagccauugggugccuaccucucggacaaccugguccauccacgccaagcaugaguggaugacaaccgaagacaugcucacggucuggaauagaguguggauucaggagaaccccuggauggaggacaaaacaccuguugaaagcugggaggaaauccccuaccugggaaagcgggaggaucaguggugcggcucucugaucgggcucaccuccagagcgaccugggccaagaauauucagacagcuaucaaccaagugcgcagccugauuggaaaugaagaguauaccgacuacaugccuuccaugaaacgguucagacgcgaggaagaggaagccggcguccuuugguga

SEQ ID NO: 19543 - RNA, 9876 nt, Artificial Sequence
  derived and/or modified CDS sequence (opt5) from DENV-2__JX669477__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaauacaguuauucugcagaacgccuggaaggugagcuguaccauccucgccgcugucuccgugagcccccugcuucugacaucuucccagcagaaagccgacuggauuccucucgcucugaccaucaagggccugaaucccacggccauuuuucuuacaacccugagccgcaccucuaaaaagagauccuggccgcucaacgaggcgaucauggccguggggauggucagcauccuggcuucuucccuccugaaaaaugacauuccuaugacaggaccccuuguugccggcggccugcugaccgugugcuaugugcucacagggcggagcgcugaucuggaacuugagcgcgccgccgacgucaagugggaggaucaagcugaaaucuccggaagcucuccuauucugagcaucacgauuuccgaggacggcucuaugagcaucaaaaacgaagaggaggaacagacccucacaauucugaucagaaccgggcuccuggugaucuccggaguuuuccccgugucuauuccgaucacagcggccgcuugguaccuuugggaggucaagaagcagcgggccggcgugcugugggauguuccuucucccccucccguggggaaagccgaacuggaggacggagcuuaucgcauuaagcagagaggcauccucggcuacucccaaauuggggccggagucuauaaagaaggcaccuuucacacgauguggcaugugaccagaggggcgguccugaugcaccgcggaaagagaaucgagcccuccugggcugaugugaaaaaggaccuuaucagcuacggcgggggauggaagcuggagggcgaauggaaagagggcgaagagguucaggugcucgcccuggaaccugggaagaauccgcgggccguccagacaaaacccggaauuuucaagaccaacacaggcaccaucggggcugugucccucgauuuuagcccuggaacaucuggcucccccauuguugacagaaaagggaagguggucggacuguacggcaauggcguggugacgcgcagcggggccuauguuucugcgaucgcucagaccgagaaguccauugaggauaacccugaaaucgaggacgauaucuuccggaaaaagagacuuacaauuauggaccugcaucccggagccggcaaaaccaagcgcuaccugccugccaucguccgggaagcuauuaaaagagggcuccgcacccugauccuugccccgacacgggugguggcugccgagauggaagaggcgcugagaggacuccccauucgcuaucaaacgccugccauccgggcugagcacaccggcagagaaauugucgaccugaugugucaugccacauucaccaugcggcuccugagccccgugcgcguuccuaacuacaaucuuaucaucauggaugaggcucacuuuacagaccccgccuccauugccgcuagaggguauaucucuacccggguggaaaugggcgaggcggccggaauuuucaugacggcuacaccgccuggcagccgcgaucccuuuccccaguccaacgccccuaucauggacgaggaaagagagauucccgaacggagcuggaacucugggcacgagugggucaccgauuucaagggaaagaccgugugguuuguuccuuccaucaaagccggcaacgacaucgcugccugccugagaaagaaugggaaaaaggugauucagcugagccgcaaaacauucgauucugaauacgucaagacccgggcgaacgacugggauuuugugguuacaaccgacaucagcgagaugggagcuaauuucaaggccgagagagugauugauccgcgccgguguaugaaacccgucauccucacggacggcgaagagagagugauucuggccgggccuaugcccgugacacauuccucugcugcccaacgccggggcagaaucggacgcaacccuaagaaugaaaacgaccaguauaucuacaugggcgagccccuugaaaaugaugaggacugcgcgcacuggaaagaggccaagaugcugcucgauaacauuaauaccccggaagggaucauuccuagcauguuugagcccgaaagagagaaagucgacgcuaucgauggagaauaccggcugcgcggcgaggccagaaagacauucguugaccugaugcggcgcggggaucucccuguguggcuugcuuauaaaguggccgcugagggaauuaacuacgccgacagaaagugguguuuugauggcaucaagaauaaccagauucuggaagagaacgucgaaguggagaucuggaccaaagagggggaacggaagaaacugaagcccagauggcucgacgcgcgcaucuauuccgauccucuggcccuuaaagaguucaaggaguucgcugccggccggaagucucugacgcucaaucugauuaccgagaugggaagacugcccacauuuaugacccagaaagcucgcaacgcccucgacaaucuugccguucugcauacagcugaagugggcgggaaggcgcacacccacgcccugagcgagcucccggagacacuggaaacccuucugcuccugacgcugcucgcugccgucacaggaggcaucuuccuuuuucugauguccgggaaaggaauuggcaagaugacccugggcaugugcugcaucauuaccgccagcauccuccugugguacgcucaaauccagccucauuggauugccgcgucuaucauucuugaguucuuucugaucgugcuccugauucccgaacccgagaaacagcggacaccucaggauaaccaacugaccuauguugugaucgccauccucacagucguggcugccacgauggcuaaugaaaugggguuccuugagaagaccaagaaagaccugggauuuggcuccauuacaacccaggagagcgaauccaacauccuggacauugaucucagaccggccucugcguggacacuguacgccgucgcuaccacguucgugacccccaugcuucggcacagcaucgaaaauagcucuguuaacgugagccugacagccauugcuaaucaggccaccgugcucauggggcugggaaagggcuggccucuguccaaaauggacaucggggucccccuccuugcuauuggauguuauagccagguuaacccuaucacacugaccgccgcgcugcuccugcuuguggcccauuacgcuaucauuggccccggccugcaagccaaggcuacgcgcgaagcccagaaaagagccgcggcugggaucaugaagaauccuacaguggauggaauuaccgucaucgaccucgagccgauucccuacgauccuaaguuugaaaaacagcugggccaggugaugcugcucauccuuugcguuacacaagugcugaugaugcggaccaccugggcccugugugaggcucucacacuggccacggggcccaucucuacccuuugggagggaaacccuggccgcuucuggaauacaaccauugccgucuccauggcuaacaucuuuagagggagcuaucuggccggagcgggccuccuguucucuauuaugaagaauacaaccaacacgcggcgcggcacagggaaugugggagaaacccugggcgagaaauggaaguccagacucaacgcccuugggaaaagcgaauuucagaucuacaagaaaucuggcauucaggaggucgaccggacccuggcuaaggagggcaucaagcgcggggaaacagaucaccaugccgugagcagaggauccgcuaaacugcggugguucguugagagaaacauggugacccccgaaggcaaggucguggaccucggcugcgggcgcggaggcuggucuuauuacugugggggacugaaaaauguucgggaggugaagggccuuacaaaagggggaccgggccacgaggaaccuauccccaugagcacguauggcuggaaccuggucagacuccaauccgggguggauguguucuuuacacccccugagaagugcgacacccugcugugugauauuggagaaagcucccccaauccuaccaucgaggccggccgcacacuccggguucuuaaccuggucgaaaauuggcugaacaauaacacccaguucugcauuaaggugcucaauccguacaugcccucugugaucgagaaaauggaaacgcugcagagaaaguaugggggagcgcuuguccgcaacccucugagcagaaauuccacccacgagauguacuggguuucuaacgccacaggcaauauugugagcuccgugaacaugaucucuagaaugcucaucaaucgcuuuaccaugaaacauaagaaagcuacauacgagcccgacgucgaucuggggagcggaacccggaacauuggcaucgaauccgagauuccuaaccuggacaucauuggcaagagaaucgaaaagauuaaacaggagcacgaaacaagcuggcauuaugaccaagaucaccccuacaagaccugggccuaucacgggucuuacgagacgaaacagacaggauccgcuagcucuauggugaauggcguugugcgccuccuuaccaagccgugggacgucgugccuaugguuacccagauggccaugacagauacgacccccuucgggcagcaacggguguuuaaagagaaggucgacacaagaacccaggaaccuaaggagggaaccaagaagcugaugaaaaucaccgcugaauggcuguggaaggagcucggcaaagagaagacaccccgcauguguaccagagaagaguucacgcggaaagugcgcuccaacgccgcgcugggggccguguuuaccgaugaaaauaaguggaaaagcgcuagagaggccgucgaagacggacgguucugggagcuuguugauagagagcggaaccugcaucucgaaggcaaaugcgagacauguguguauaauaugaugggcaagcgcgagaagaagcugggggaguuuggaaaagcuaagggcucuagagccaucugguacauguggcugggggcccgguuccucgaauuugaggcgcugggauuccuuaacgaggaccacugguuuucccgcgaaaauagccuguccggcguggagggggaaggccuccauagacugggauauauucuucgggaugucagcaagaaagagggcggggcuauguacgccgacgauaccgccggaugggacacacgcaucacccuggaagaccucaagaacgaggagauggugacgaaucacaugaaaggcgaacauaagaaacuggcugaggccauuuucaagcugacauaccagaacaagguugugagaguccagcggccuacaccccgcgggacagugauggauaucauuucuagaaaagaccaacggggaagcggccagguugggaccuauggccucaauacguucaccaacauggaagcucagcugauccgccaaauggagggagagggcaucuuuagauccauucagcaccuuacagccaccgaagagaucgcggugcagaauuggcuggcccgggucgggcgcgaaagacucucucggauggcuauuagcggagaugacugcgugguuaagccgaucgaugacagauucgccuccgcucugacagcccuuaacgauaugggcaaagugcgcaaggacauucagcaaugggagccuucucggggguggaaugauuggacccagguccccuuuugcagccaccauuuccacgaacuggugaugaaagacggaagaguccucgugguucccugucgcaaccaggaugagcugaucggccgggcgagaaucucccagggggccggcuggucucugaaggagacagcuugccucggaaagagcuacgcccaaauguggacccugauguauuuucaucgccgggaccuuagacuggcugccaacgcuauuuguuccgccgugccuagccacugggucccgacgucucgcacaaccugguccauccacgcgaaacaugaauggaugaccacagaggauaugcucgccguguggaaucggguguggauucaggaaaaccccuggauggaggacaagaccccuguugaaagcugggaggaggugcccuaccugggcaaaagagaagaccaguggugcgggucucuuaucggacugacaucccgcgcuacgugggccaagaauauucagaccgccaucaaccaaguccggagccucauuggcaaugagggguauacagauuacaugccuuccaugaaaagauuccggagagaagaggaagaggcuggagugcugugguga

SEQ ID NO: 19544 - RNA, 9876 nt, Artificial Sequence
  derived and/or modified CDS sequence (opt5) from DENV-2__JX669478__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaagaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcaucuuuggcuacucccaaauuggggcgggagucuauaaagaaggcacauuccacaccauguggcaugugacgagaggggcuguccucaugcaccgcggaaagagaaucgagcccuccugggccgaugugaaaaaggaccugaucagcuacggcgggggauggaaacuugagggcgaauggaaagagggcgaagagguucaggugcuggcccucgaaccugggaagaauccgcgggcuguccagaccaaacccggaauuuuuaagacaaacaccggcacaaucggggccgugucccuggauuucagcccuggaaccucuggcucccccauuguugacagaaaagggaagguggucggacucuacggcaauggcguggugacacgcagcggggcguauguuucugcuaucgcccagacggagaaguccauugaggauaacccugaaaucgaggacgauaucuuccggaaaaagagacugaccauuauggaccuucaucccggagccggcaaaacaaagcgcuaccugccugcuaucguccgggaagccauuaaaagagggcugcgcacccucauccuggcuccgacccgggugguggccgcggagauggaagaggcccuuagaggacugcccauucgcuaucaaaccccugcuauccgggccgagcacacgggcagagaaauugucgaccucaugugucaugcuaccuuuacaaugcggcugcucagccccgugcgcguuccuaacuacaaucugaucaucauggaugaggcccacuucaccgaccccgccuccauugcugcgagaggguauaucucuacacggguggaaaugggcgaggccgcuggaauuuuuaugaccgccacgccgccuggcagccgcgaucccuucccccaguccaacgccccuaucauggacgaggaaagagagauucccgaacggagcuggaacucugggcacgagugggucacagauuuuaagggaaagaccgugugguucguuccuuccaucaaagcuggcaacgacaucgccgcgugccuuagaaagaaugggaaaaaggugauucagcugagccgcaaaaccuuugauucugaauacgucaagacacgggcuaacgacugggauuucgugguuaccacagacaucagcgagaugggagccaauuuuaaggccgagagagugauugauccgcgccgguguaugaaacccgucauccugaccgacggcgaagagagagugauucucgcugggccuaugcccgugacgcauuccucugccgcgcaacgccggggcagaaucggacgcaacccuaagaaugaaaacgaccaguauaucuacaugggcgagccccuggaaaaugaugaggacugcgcccacuggaaagaggcuaagaugcuucuggauaacauuaauacaccggaagggaucauuccuagcauguucgagcccgaaagagagaaagucgacgccaucgauggagaauaccggcuccgcggcgaggcuagaaagaccuuuguugaccugaugcggcgcggggaucugccuguguggcucgccuauaaaguggcugccgagggaauuaacuacgcggacagaaagugguguuucgauggcaucaagaauaaccagauucuugaagagaacgucgaaguggagaucuggacaaaagagggggaacggaagaaacugaagcccagauggcuggacgcccgcaucuauuccgauccucucgcucugaaagaguucaaggaauuugccgcuggccggaagucucuuacccugaaucucauuacggagaugggaagacugcccaccuucaugacacagaaagcccgcaacgcccuggacaaucucgcuguucuucauaccgcggaagugggcgggaaggccuacacacacgcucugagcgagcugccggagacccucgaaacacugcuucugcucacccugcuggccgccgucacgggaggcaucuuucucuuccuuauguccgggaaaggaauuggcaagaugacacugggcaugugcugcaucauuaccgcuagcauccugcucugguaugcccaaauccagccucacuggauugcggccucuaucauucuggaguuuuuccuuaucgugcugcucauucccgaacccgagaaacagcggaccccucaggauaaccaacugacauacguugugaucgcuauccugaccgucguggccgcuacaauggccaaugaaaugggguuucucgagaagacgaagaaagaccuuggauucggcuccauuaccacacaggagagcgaauccaacauccuggacauugaucugagaccggcgucugccuggacccucuaugcugucgccacaaccuuugugacgcccaugcugcggcauagcaucgaaaauagcucuguuaacgugagccuuaccgcuauugccaaucaggcuacagugcugauggggcucggaaagggcuggccucuguccaaaauggacaucggggucccccugcucgccauuggauguuacagccagguuaacccuaucacccuuacagcggcccugcugcuccugguggcucacuacgccaucauuggccccggccuucaagcuaaggccacccgcgaagcccagaaaagagcggcugccgggaucaugaagaauccuacgguggauggaauuacagucaucgaccuggagccgauucccuaugauccuaaguucgaaaaacagcucggccaggugaugcugcugauccucugcguuacccaagugcuuaugaugcggacaaccugggcucugugugaggcccugacccucgccacagggcccaucucuacgcugugggagggaaacccuggccgcuuuuggaauaccacaauugcugucuccauggccaacaucuucagagggagcuaccuugcgggagccggccugcucuuuucuauuaugaagaauaccacaaacacccggcgcggcacggggaaugugggagaaacacugggcgagaaauggaaguccagacugaacgcucucgggaaaagcgaguuccagaucuauaagaaaucuggcauucaggaggucgaccggacccuugccaaggagggcaucaagcgcggggaaaccgaucaucacgcugugagcagaggauccgccaaacugcggugguucguugagagaaacauggugacacccgaaggcaaggucguggaccugggcugcgggcgcggaggcuggucuuacuauugugggggacucaaaaauguucgggaggugaagggccugaccaaagggggaccgggccaugaagaaccuauccccaugagcacauacggcuggaaccuugucagacugcaauccgggguggauguguuuuucacgcccccugagaagugcgacacccuccugugugauauuggagaaagcucccccaauccuacaaucgaggcgggccgcacccugcggguucucaaccuugucgaaaauuggcugaacaauaacacacaguuuugcauuaaggugcugaauccguauaugcccucugugaucgagaaaauggaaacccuccagagaaaguacgggggagcccugguccgcaacccucuuagcagaaauuccacgcacgagauguacuggguuucuaacgcuaccggcaauauugugagcuccgugaacaugaucucuagaaugcugaucaaucgcuucacaaugaaacacaagaaagccaccuaugagcccgacgucgaucucgggagcggaacacggaacauuggcaucgaauccgagauuccuaaccuggacaucauuggcaagagaaucgaaaagauuaaacaggagcaugaaaccagcuggcacuacgaccaagaucaucccuauaagacaugggcuuaccacgggucuuaugagaccaaacagacgggauccgccagcucuauggugaauggcguugugcgccugcucacaaagccgugggacgucaucccuauggugacccagauggcuaugaccgauacaacgcccuuugggcagcaacggguuuucaaagagaagguggacaccagaacacaggaaccuaaggagggaaccaagaaacuuaugaaaaucacagccgaauggcuguggaaagagcugggcaaagagaagacaccccgcauguguacaagagaagaguuuacccggaaaguccgcuccaacgcggcccucggggcuguguucacggaugaaaauaaguggaaaagcgccagagaggcuguggaagacggacgguuuugggagcuggucgauagagagcggaaccuucaccuggaaggcaaaugcgagaccuguguuuacaauaugaugggcaagcgcgagaagaagcucggggaguucggaaaagccaagggcucuagagccauuugguauauguggcugggggcgcgguuucuggaguucgaggcucucggauuucugaacgaggaccauugguucucccgcggcaauagccuuuccgggguggaaggcgagggacugcacagacucggcuacauccugcgggaaguggggaagaaagagggaggcgccauguacgccgaugacacagcugggugggauacccgcauuacacuugaagaccugaagaacgaggagauggucaccaaucauaugaaaggagaacacaagaaacucgccgaggcuaucuucaagcugacguaucagaacaaggugguuagagugcagcggccuacaccccgcggcaccgucauggacauuaucagcagaaaagaucaacgggggucuggccaggugggaacauacggccugaauaccuuuacgaacauggaagcccagcucauccgccaaauggagggggagggaauuuucaagagcauccagcaucugaccgcgacagaagagauugccguucagaauuggcuugcuagagugggccgggaacgccuguccagaauggccaucucuggggacgauugcgucgugaaaccgauugacgaucgguuugcuagcgcccucaccgcgcugaacgacaugggaaagguuagaaaagauauccagcaaugggagccuucccgcggcuggaaugacuggacacaggugcccuucugcucucaccacuuucaugaacuugucaugaaggaugggcgggugcuggucgugcccuguagaaaccaggacgagcucaucggccgcgcccggauuagccagggagcuggcuggucccugaaggagaccgccugccuggggaaaucuuaugcucaaauguggacacucauguacuuccacagacgcgaucugcggcuugccgcuaacgccaucuguagcgcgguuccuucccauugggugccgaccagcagaacgacauggucuauucacgccaagcacgaauggaugaccaccgaggacaugcuggcugucuggaaucgcguguggauccaggaaaaccccuggauggaggauaaaacaccuguggaauccugggaggagguucccuaucucggaaagcgggaagaccaguggugcggcagccugauugggcuuaccucuagagccacaugggccaaaaauauccagacggcuauuaaccaagugcgcucccugaucggaaaugagggcuacaucgacuauaugccuagcaugaagcgguuuagacgggaagaggaagaggccgggguccucugguga

SEQ ID NO: 19545 - RNA, 9876 nt, Artificial Sequence
  derived and/or modified CDS sequence (opt5) from DENV-2__JX669480__SS-prME
accgcgggagugaucauuaugcugauccccaccgcuauggccuuccaccucacgacccggaauggggagccucauaugauugugggacggcaggaaaagggcaagagccugcuuuuuaagaccgaggacgggguuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcgaagagaucaaaauuaccccucagucuuccaucacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauucagaaagagacacucgugaccuucaagaacccucaugccaagaaacaggacgucgugguucugggcucccaagaaggggccaugcacacggcucuuacaggcgcgaccgagauccagaugagcuccggaaaucugcucuuuacaggccaucugaagugcagacuucggauggacaaacugcagcucaaggggaugucuuacagcauguguaccggaaaauucaagauugugaaggagaucgccgaaacccaacacggcacaaucgucauuagagugcaguaugagggggauggaucccccugcaaaauccccuucgaaauuauggaccuggagaagcgccauguccugggccggcucaucacggugaacccuauuguuaccgaaaaagauagcccggugaacaucgaggcugagcccccuuuuggggacucuuacauuaucaucggcgucgaacccggacagcugaaacuuaauugguucaaaaagggcuccagcauugggcagauguuugagacaaccaugagaggagccaagcgcauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgguccaccagccuuucugugucccucgugcugguuggcgucgugacccuguaucucggggccauggugcaggcugauagcggaugugucgugucuuggaaaaauaaggaacugaaaugcggcuccgggauuuucaucacagacaacguucacaccuggacagagcaguacaaguuucagccugaaagccccuccaaacuugccucugcuauucaaaaagcccaugaggagggcaucuguggaaucagaagcgugacgcgccuggaaaaucucauguggaagcagauuaccccggagcugaaccacauccuguccgaaaaugaggucaaacuuacaauuaugaccggcgauaucaaggggauuaugcaggcgggaaaacggucucucagaccucagcccacagaacugaaguauagcuggaaaaccuggggcaaggccaagaugcuguccacggagagccauaaccaaaccuuccucaucgacgggccugagacagcugaaugccccaauaccaaccgcgccuggaacucucuggagguggaagauuacggauuuggcguuuucacaaccaacaucuggcuuaaacugcgggagaagcaggacguguuuugugacuccaaacucaugagcgcugccauuaaggauaauagagcgguccacgccgacaugggcuauuggaucgagucugcucugaacgauacauggaaaauggaaaaggccuccuucauugaggucaagagcugccacuggccuaaaucucauacccuguggagcaaugggguucuugaauccgagaugaucauucccaagaacuucgcuggaccggugagccagcacaacuaccgcccuggcuaucauacgcagacagccgggcccuggcaccucggaaaacuggaaauggacuuugauuucugugagggcaccaccgucguggugacagaggacugcgggaaucggggacccucucugagaaccacgacagccuccggcaagcucaucaccgaauggugcugucggagcugcacacugccuccgcuucgcuacagaggcgaggauggguguugguacggaauggaaauucggccccugaaagagaaggaagagaaccucgucaauucccugguuaccgcuggccaugggcaaaucgacaacuuuucucugggagugcuuggcauggcccucuuccuggaggaaaugcugagaacacgcguggggaccaagcacgccauccuccuggucgcugugagcuuuguuacgcuuauuaccggaaauauguccuuccgggaucugggcagagugauggucauggugggcguuacaaugaccgacgauaucgggaugggagugacauaucucgcccugcuggccgcuuuuaaaguccgcccuaccuucgccgcgggccuucugcucagaaagcugacgucuaaagagcucaugauggcuacaauugggaucacccugcuuagccaguccacaauucccgaaaccauccuggagcucaccgacgcccuggcccugggaaugauggugcuuaagaucguucggaacauggaaaaauaccagcuggcugugacaauuauggccaucucuugcgucccuaaugcggugauucuccugaacgcuuggaaggugagcuguacgauccucgccgccgucuccguuagcccccugcuucugaccucuucccaacagaagacagauuggauuccucucgcucugaccaucaaaggccugaaucccacagccaucuuucuuaccacgcugagccgcacaucuaagaaaagauccuggccgcucaacgaggcugugauggccguggggauggucagcauucuggcgucuucccuccugaagaaugacaucccuaugaccggaccccuuguggccggcggccugcugaccguuugcuaugugcucacagggcggagcgcugaccuggagcuugaacgcgccgcugaugucaaaugggaggaccaggccgaaauuuccggaagcucuccuauccugagcauuaccaucuccgaggauggcucuaugagcauuaagaacgaggaagaggaacagacacucacgauccugaucagaaccgggcuccuggugauuuccggaguuuuccccgugucuaucccgauuacagccgcugcgugguaccuuugggaggucaaaaagcaacgggccggcgugcugugggacgucccuucucccccucccguggggaaggcugaacuggaggauggagccuaucgcaucaaacagagaggcauucucggcuacucccagaucggggccggaguuuauaaggagggcaccuuucacacaauguggcaugugaccagaggggcuguccugaugcaccgcggaaaaagaaucgaacccuccugggccgacgugaagaaagaucuuauuagcuacggcgggggauggaagcuggagggcgaauggaaggagggcgaagagguucaggugcucgcgcuggagccugggaaaaauccgcgggcuguccaaacgaagcccggacucuucaaaaccaacacaggcaccaucggggccgugucccuggacuuuagcccuggaacaucuggcucccccauuguggauagaaaggggaaaguugucggacuuuacggcaauggcguggugacccgcagcggggccuaugucucugcuaucgcccagacagaaaaguccauugaggacaacccugaaaucgaggaugacaucuuccggaagaaaagacugacgauuauggaucugcaucccggagcgggcaagaccaaacgcuaccucccugcuaucgugcgggaagccauuaagagagggcugcgcacacuuauccuggccccgacccggguuguggcugccgagauggaggaagcucucagaggacugcccauucgcuaucagaccccugccauccgggcggagcacacaggcagagaaauugucgaccucaugugucaugccacguucaccaugcggcugcuuagccccgugcgcguuccuaacuacaaucugaucaucauggacgaggcucacuuuacagaucccgccuccauugcugccagaggguauaucucuacccggguggagaugggcgaagccgcuggaauuuucaugacagcgaccccgccuggcagccgcgaccccuuuccccaguccaacgccccuaucauggaugaggaaagagagauucccgaacggagcuggaacucugggcacgagugggucacggacuucaaaggaaagacagugugguuuguuccuuccaucaaggcuggcaacgauaucgccgccugccugcgcaagaaugggaagaaagugauucaacucagccgcaagaccuucgacucugaguacgucaaaacccgggcuaacgauugggacuuuguggugacaaccgauaucagcgaaaugggagccaauuucagagcggagcgcgucauugacccgcggagauguaugaagcccguuauccugacagauggcgaagaaagagugauucuugcugggccuaugcccgugacccauuccucugccgcccagcggagaggccgcgucggaagaaacccuaagaaugaaaacgaccaguauaucuacaugggcgagccccuggagaaugacgaagauugcgcucacuggaaagaggccaagaugcuccuggacaacaucaauacgccggaagggauuaucccuagcauguuugagcccgaacgggagaaaguggaugcgauugacggagaguaccgccugagaggcgaagcccggaagacauucguugaucucaugcgcagaggggaccuuccuguguggcuggcuuaucgggucgccgcugagggaaucaacuacgccgauagacgcugguguuuugacggcauuaaaaauaaccaaauccuggaagagaacguggagguugaaauuuggaccaaggagggggaacggaaaaagcucaagcccagauggcuggaugcucgcaucuauuccgacccucuugcccugaaagaguucaaggaguucgcggccggccggaaaucucucacacugaaucugaucaccgagaugggaagacuccccacguuuaugacccagaagacacgggaugcucuugacaaccuggccgugcugcauaccgcugaggccggcgggcgcgccuacaaucacgcucucagcgaacugccggagacacuugaaacccugcuccugcugacacuccuugcgaccgucacgggaggcauuuuccuguuucugauguccgggaaaggaaucggcaagaugacacucggcaugugcugcauuaucaccgccagcauucugcuuugguaugcucagauccagccucacuggaucgccgccucuauuauccuggaguucuuucucauugugcugcugauccccgaacccgagaagcaaagaaccccucaggauaaccagcucacauacgucgugauugcuauccuuaccguuguggccgcgacaauggccaaugagaugggguuccuggagaaaacgaagaaagaccugggacucggcuccaucaccacacaggaaagcgaauccaacauucuggacaucgaucuucggccggcuucugccuggacccuguaugcuguggccacaaccuuugucacgcccaugcuccgccauagcauugagaauagcucuguuaacgugagccugaccgcgaucgccaaucaagcuacagugcugauggggcucggaaagggcuggccucuuuccaaaauggacauuggggucccccugcuggccaucggauguuacagccaggugaacccuauuacccucacagcugcccugcuucugcucguugcucacuacaccaucaucggccccggccugcaggccaaggcgacgagagaagcccagaagcgggcugccgcugggauuaugaaaaauccuacaguggauggaaucaccgucauugaccuggagccgauccccuaugauccuaaguucgagaaacaacucggccaggugaugcuucugauucugugcgucacacaggugcucaugaugcgcaccaccugggcccugugugaagcccuuacacuggcgacggggcccaucucuacccucugggagggaaacccuggcagauuuuggaauacaaccaucgcuguuuccauggccaacauuuuccgggggagcuaccuggcuggagccggccugcucuuuucuaucaugaagaauacaaccaacacgcgcagaggcacagggaauauuggagaaacccuuggcgagaaauggaagucccggcugaacgcccugggaaagagcgaguuccagaucuauaaaaagucuggcauucaagaaguggacagaacccucgcuaaagagggcaucaagcgcggggaaacagaucaucacgccgucagccggggauccgcgaaacugagaugguuuguggagcgcaacaugguuacccccgaaggcaagguggucgaccuuggcugcgggcggggaggcuggucuuacuauugugggggacugaaaaaugugagagaggugaagggccucacaaaagggggaccgggccaugaggaaccuauccccaugagcacguacggcuggaaccugguucgccugcaguccggggucgauguguucuucacacccccugagaaaugcgacacacuccuuugugauauuggagaaagcucccccaauccuaccaucgaggccggccggacacugagagugcugaaccucgucgaaaauuggcugaacaauaacacccaguuuugcauuaagguucuuaauccguauaugcccucugugaucgagaaaauggagacgcugcaacgcaaguacgggggagcucucgugcggaacccucugagcagaaauuccacccacgaaauguacugggucucuaacgccacaggcaauauugugagcuccguuaacaugaucucucgcaugcugaucaaucgguucaccaugaaacacaagaaggcuacauaugagcccgacguggaucucgggagcggaaccagaaacauuggcaucgaauccgagauuccuaaccuugacaucauuggcaaacgcaucgaaaagauuaaacaggagcaugagacaagcuggcacuacgaccaggaucaucccuauaagaccugggccuaccacgggucuuaugaaacgaaacagacaggauccgcgagcucuauggucaauggcgugguuagacugcugaccaagccgugggacguggucccuauggugacccaaauggccaugacagauacgacccccuuugggcagcagcggguguucaaggagaaagucgacacacgcacccaggaaccuaaggagggaaccaagaagcucaugagaaucaccgcugaguggcuguggaaagaacuuggcaagaagaaaacaccccggauguguaccagagaggaauuuacgcggaagguucgcuccaacgccgcucugggggccaucuucaccgaugagaauaaauggaaaagcgcuagagaagccguggaggacucucgguuuugggagcucguggaucgcgaaagaaaccugcaccuggagggaaaaugcgaaacaugugucuacaauaugaugggcaagcgggagaaaaagcucggcgaguucgggaaggcgaaaggaucccgcgccauuugguauauguggcugggcgcuagauuucuugaguucgaggcccugggguuucucaacgaagaccauugguucagccggggaaauucccugagcggcguggagggggaaggccuucaccgccugggauacauccucagagauguuucuaagaaagagggcggggcuauguacgccgacgauaccgccggaugggacacacggauuacccuggaagaccugaagaacgaggagauggugacgaaucauaugaaaggcgaacacaagaagcucgcggaggcuaucuuuaaacugacauaucaaaacaaggucgugcgcguucagagaccuacaccccgggggacagugauggauauuaucagccgcagagaccagcggggauccggccaggucgggaccuacggccuuaauacguucaccaacauggaagcccaacugaucagacagauggagggagagggcauuuucaaaucuauccagcaucucacagugaccgaagagauugccguucaaaauuggcuggcucgcguggggcgggaaagacuuagccgcauggccaucuccggagaugacugcgucgugaagccgcuggaugaccgguuugcuucugcccucacagcgcugaacgauaugggcaaagucagaaaggacauucagcagugggagccuagccgcggguggaaugauuggacccaggugcccuucugcucccaccacuuucaugaacugguuaugaaggacggacgggugcucgucgugcccuguagaaaccaagaugagcugaucggccgcgcccggaucucucagggggcuggcuggagccuuaaagagacagccugccugggaaaguccuaugcucagauguggacccucauguacuuccacagacgcgaccugcggcuugccgcgaacgccauuuguagcgcugugccuucucauuggguuccgacguccagaacaaccuggagcauccacgccaaacacgaauggaugaccacagaggauaugcuggcuguguggaaucgggucuggauucaggaaaaccccuggauggaggacaagaccccuguggaaucuugggaggagguucccuaucucggcaaaagagaagaccaauggugcgggucccugaucggacugacaagccgcgccacgugggcuaagaauauucagaccgccaucaaccaggugcggucccucauuggcaaugaggaauacacagauuauaugccuucuaugaagagauuucgcagagaggaagaggaggcggggguccugugguga

SEQ ID NO: 19546 - RNA, 9876 nt, Artificial Sequence
  derived and/or modified CDS sequence (opt5) from DENV-2__JX669483__SS-prME
accgcgggagugaucauuaugcugauccccaccgcuauggccuuccaccucacgacccggaauggggaaccucauaugauugucggacggcaggaaaagggcaagagccugcuuuuuaagacagaggacgggguuaauaugugcacccugauggcgaucgaucucggagaacugugugaggacaccauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaagggggaaucgugaccugcgcgauguuuacaugcaaaaagaauauggaaggcaaagucguucucccugagaaccuggaauacacgauugugaucacaccccacagcggggaggagcaugccgugggaaaugacacaggcaagcacggcgaagagaucaaaauuaccccucagucuuccaucacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauucagaaagagacacucgugaccuucaagaacccucaugccaagaaacaggacgucgugguucugggcucccaagaaggggccaugcacacggcucuuacaggcgcgaccgagauccagaugagcuccggaaaucugcucuuuacaggccaucugaagugcagacuucggauggacaaacugcagcucaaggggaugucuuacagcauguguaccggaaaauucaagauugugaaggagaucgccgaaacccaacacggcacaaucgucauuaaagugcaguaugagggggauggaucccccugcaagauccccuucgaaauuauggaccuggagaaaagacauguccugggccgccucaucacggugaacccuauuguuaccgaaaaggauagcccggugaacaucgaggcugagcccccuuuuggggacucuuacauuaucaucggcgucgaacccggacagcugaaacuuaauugguucaagaagggcuccagcauugggcagauguuugagacaaccaugcggggagccaaaagaauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgcuccaccagccuuucugugucccucgugcugguuggcgucgugacccuguaucucggggccauggugcaggcugauagcggaugugucgugucuuggaagaauaaagaacugaagugcggcuccgggauuuucaucacagacaacguucacaccuggacagagcaguacaaguuucagccugaaagccccuccaaacuugccucugcuauucaaaaggcccaugaggagggcaucuguggaauccggagcgugacgagacuggaaaaucucauguggaaacagauuaccccggagcugaaccacauccuguccgaaaaugaggucaaacuuacaauuaugaccggcgauaucaaagggauuaugcaggcgggaaagcgcucucuccggccucagcccacagaacugaaauauagcuggaagaccuggggcaaggccaaaaugcuguccacggagagccauaaccaaaccuuccucaucgacgggccugagacagcugaaugccccaauaccaacagagccuggaacucucuggagguggaagauuacggauuuggcguuuucacaaccaacaucuggcuuaagcugcgcgagaaacaggacguguuuugugacuccaagcucaugagcgcugccauuaaagauaaucgggcgguccacgccgacaugggcuauuggaucgagucugcucugaacgauacauggaagauggaaaaggccuccuucauugaggugaaaagcugccacuggccuaagucucauacccuguggagcaaugggguucuugaauccgagaugaucauucccaaaaacuucgcuggaccggugagccagcacaacuacagaccuggcuaucauacgcagacagccgggcccuggcaccucggaaagcuggaaauggacuuugauuucugugagggcaccaccgucguggugacagaggacugcgggaaucgcggacccucucugcggaccacgacagccuccggcaaacucaucaccgaauggugcuguagaagcugcacacugccuccgcuucgguaccgcggcgaggauggguguugguacggaauggaaauuagaccccugaaggagaaggaagagaaccucgucaauucccugguuaccgcuggccaugggcaaaucgacaacuuuucucugggagugcuuggcauggcccucuuccuggaggaaaugcugcggacaagaguggggaccaaacacgccauccuccuggucgcugugagcuuuguuacgcuuauuaccggaaauauguccuuccgcgaucugggccgggugauggucauggugggcguuacaaugaccgacgauaucgggaugggagugacauaucucgcccugcuggccgcuuuuaaggucagaccuaccuucgccgcgggccuucugcuccgcaaacugacgucuaaggagcucaugauggcuacaauugggaucacccugcuuagccaguccacaauucccgaaaccauccuggagcucaccgacgcccuggcccugggaaugauggugcuuaaaaucguuagaaacauggaaaaguaccagcuggcugugacaauuauggccaucucuugcgucccuaaugcggugauucuccugaacgcuuggaaggugagcuguacgauccucgccgccgucuccguuagcccccugcuucugaccucuucccaacagaaaacagauuggauuccucucgcucugaccaucaagggccugaaucccacagccaucuuucuuaccacgcugagccggacaucuaaaaagcgcuccuggccgcucaacgaggcugugauggccguggggauggucagcauucuggcgucuucccuccugaaaaaugacaucccuaugaccggaccccuuguggccggcggccugcugaccguuugcuaugugcucacagggagaagcgcugaccuggagcuugaacgggccgcugaugucaagugggaggaccaggccgaaauuuccggaagcucuccuauccugagcauuaccaucuccgaggauggcucuaugagcauuaaaaacgaggaagaggaacagacacucacgauccugauccgcaccgggcuccuggugauuuccggaguuuuccccgugucuaucccgauuacagccgcugcgugguaccuuugggaggucaagaagcaaagagccggcgugcugugggacgucccuucucccccucccguggggaaagcugaacuggaggauggagccuaucggaucaagcagcgcggcauucucggcuacucccagaucggggccggaguuuauaaagagggcaccuuucacacaauguggcaugugaccagaggggcuguccugaugcaccggggaaagcgcaucgaacccuccugggccgacgugaaaaaggaucuuauuagcuacggcgggggauggaagcuggagggcgaauggaaagagggcgaagagguucaggugcucgcgcuggagccugggaagaauccgagagcuguccaaacgaaacccggacucuucaagaccaacacaggcaccaucggggccgugucccuggacuuuagcccuggaacaucuggcucccccauuguggaucggaaagggaagguugucggacuuuacggcaauggcguggugaccagaagcggggccuaugucucugcuaucgcccagacagaaaaguccauugaggacaacccugaaaucgaggaugacaucuuccgcaaaaagcggcugacgauuauggaucugcaucccggagcgggcaaaaccaagagauaccucccugcuaucgugcgcgaagccauuaaacgggggcugagaacacuuauccuggccccgacccgcguuguggcugccgagauggaggaagcucuccggggacugcccauuagauaucagaccccugccauccgcgcggagcacacaggccgggaaauugucgaccucaugugucaugccacguucaccaugagacugcuuagccccgugcggguuccuaacuacaaucugaucaucauggacgaggcucacuuuacagaucccgccuccauugcugcccgcggguauaucucuaccagaguggagaugggcgaagccgcuggaauuuucaugacagcgaccccgccuggcagccgggaccccuuuccccaguccaacgccccuaucauggaugaggaacgcgagauucccgaaagaagcuggaacucugggcacgagugggucacggacuucaagggaaagacagugugguuuguuccuuccaucaaagcuggcaacgauaucgccgccugccugcggaagaaugggaaaaaggugauucaacucagcagaaaaaccuucgacucugaguacgucaagacccgcgcuaacgauugggacuuuguggugacaaccgauaucagcgaaaugggagccaauuuccgggcggagagagucauugacccgcgccgguguaugaagcccguuauccugacagauggcgaagagagagugauucuugcugggccuaugcccgugacccauuccucugccgcccagcgccggggcagagucggacgcaacccuaaaaaugaaaacgaccaguauaucuacaugggcgagccccuggagaaugacgaagauugcgcucacuggaaggaggccaaaaugcuccuggacaacaucaauacgccggaagggauuaucccuagcauguuugagcccgaaagagagaagguggaugcgauugacggagaguaccggcugcgcggcgaagccagaaaaacauucguugaucucaugcggcgcggggaccuuccuguguggcuggcuuauagagucgccgcugagggaaucaacuacgccgaucggagaugguguuuugacggcauuaagaauaaccaaauccuggaagagaacguggagguugaaauuuggaccaaagagggggaacgcaagaagcucaaaccccgguggcuggaugcuagaaucuauuccgacccucuugcccugaaggaguucaaagaguucgcggccggccgcaagucucucacacugaaucugaucaccgagaugggacggcuccccacguuuaugacccagaaaacaagagaugcucuugacaaccuggccgugcugcauaccgcugaggccggcgggcgggccuacaaucacgcucucagcgaacugccggagacacuugaaacccugcuccugcugacacuccuugcgaccgucacgggaggcauuuuccuguuucugauguccgggaagggaaucggcaagaugacacucggcaugugcugcauuaucaccgccagcauucugcuuugguaugcucagauccagccucacuggaucgccgccucuauuauccuggaguucuuucucauugugcugcugauccccgaacccgagaaacaacgcaccccucaggauaaccagcucacauacgucgugauugcuauccuuaccguuguggccgcgacaauggccaaugagaugggguuccuggaaaagacgaaaaaggaccugggacucggcuccaucaccacacaggagagcgaauccaacauucuggacaucgaucuuagaccggcuucugccuggacccuguaugcuguggccacaaccuuugucacgcccaugcuccggcauagcauugaaaauagcucuguuaacgugagccugaccgcgaucgccaaucaagcuacagugcugauggggcucggaaaaggcuggccucuuuccaagauggacauuggggucccccugcuggccaucggauguuacagccaggugaacccuauuacccucacagcugcccugcuucugcucguugcucacuacaccaucaucggccccggccugcaggccaaggcgacgcgcgaagcccagaaaagagcugccgcugggauuaugaagaauccuacaguggauggaaucaccgucauugaccuggagccgauccccuaugauccuaaauucgagaagcaacucggccaggugaugcuucugauucugugcgucacacaggugcucaugaugcggaccaccugggcccugugugaagcccuuacacuggcgacggggcccaucucuacccucugggagggaaacccuggccgcuuuuggaauacaaccaucgcuguuuccauggccaacauuuucagagggagcuaccuggcuggagccggccugcucuuuucuaucaugaaaaauacaaccaacacgcggcgcggcacagggaauauuggagaaacccuuggcgagaaguggaaguccagacugaacgcccuggggaaaagcgaguuccagaucuauaagaaaucuggcauucaagaaguggaccggacccucgcuaaggagggcaucaaaagaggggaaacagaucaucacgccgucagccgcggauccgcgaagcugcggugguuuguggagagaaacaugguuacccccgaaggcaaaguggucgaccuuggcugcgggcgcggaggcuggucuuacuauugugggggacugaagaaugugcgggaggugaagggccucacaaaagggggaccgggccaugaggaaccuauccccaugagcacguacggcuggaaccugguuagacugcaguccggggucgauguguucuucacacccccugagaagugcgacacacuccuuugugauauuggagaaagcucccccaauccuaccaucgaggccggccgcacacugcgggugcugaaccucgucgaaaauuggcugaacaauaacacccaguuuugcauuaaaguucuuaauccguauaugcccucugugaucgagaagauggagacgcugcaaagaaaauacgggggagcucucgugcgcaacccucugagcagaaauuccacccacgaaauguacugggucucuaacgccacaggcaauauugugagcuccguuaacaugaucucuagaaugcugaucaaucgcuucaccaugaagcacaagaaagcuacauaugagcccgacguggaucucgggagcggaacccggaacauuggcaucgaauccgagauuccuaaccuugacaucauuggcaagagaaucgagaagauuaagcaggagcaugagacaagcuggcacuacgaccaggaucaucccuauaaaaccugggccuaccacgggucuuaugaaacgaagcagacaggauccgcgagcucuauggucaauggcgugguucgccugcugaccaagccgugggacguggucccuauggugacccaaauggccaugacagauacgacccccuuugggcagcagagaguguucaaagagaaggucgacacacggacccaggaaccuaaagagggaacaaagaaacucaugcgcaucaccgcugaguggcuguggaaggaacuuggcaagaaaaagacacccagaauguguacccgggaggaauuuacgagaaaaguucgguccaacgccgcucugggggccaucuucaccgaugagaauaaguggaaaagcgcucgcgaagccguggaggacucuagauuuugggagcucguggaucgggaacgcaaccugcaccuggagggaaagugcgaaacaugugucuacaauaugaugggcaaaagagagaagaagcucggcgaguucgggaaagcgaagggaucccgggccauuugguauauguggcugggcgcucgcuaccuugaguuugaggcccugggguuccucaacgaagaccauugguuuagcagaggaaauucccugagcggcguggagggggaaggccuucaccggcugggauacauccuccgcgauguuucuaaaaaggagggcggggcuauguaugccgacgauaccgccggaugggacacaagaauuacccuggaagaccugaaaaacgaggagauggugacgaaucauaugaagggcgaacacaagaaacucgcggaggcuaucuucaagcugacauaccaaaacaaagucgugcggguucagcgcccuacccccagagggacagugauggauauuaucagccggcgcgaccagagaggauccggccaggucgggaccuauggccuuaauacguuuaccaacauggaagcccaacugauccggcagauggagggagagggcauuuucaagucuauccagcaucucacagugaccgaagagauugccguucaaaauuggcuggcuagaguggggcgcgaacggcuuagcagaauggccaucuccggagaugacugcgucgugaaaccgcuggaugaccgcuucgcuucugcccucacagcgcugaacgauaugggcaagguccggaaggacauucagcagugggagccuagcagaggguggaaugauuggacccaggugcccuuuugcucccaccacuuccaugaacugguuaugaaagacggacgcgugcucgucgugcccugucggaaccaagaugagcugaucggcagagcccgcaucucucagggggcuggcuggagccuuaaggagacagccugccugggaaaauccuacgcucagauguggacccucauguauuuucaccggagagaccugcgccuugccgcgaacgccauuuguagcgcugugccuucucauuggguuccgacgucccggacaaccuggagcauccacgccaagcacgaauggaugaccacagaggauaugcuggcuguguggaauagagucuggauucaggaaaaccccuggauggaggacaaaaccccuguggaaucuugggaggagguucccuaccucggcaagcgggaagaccaauggugcgggucccugaucggacugacaagcagagccacgugggcuaagaauauucagaccgccaucaaccaggugcgcucccucauuggcaaugaggaauauacagauuacaugccuucuaugaaacgguucagacgcgaggaagaggaggcggggguccugugguga

SEQ ID NO: 19547 - RNA, 9876 nt, Artificial Sequence
  derived and/or modified CDS sequence (opt5) from DENV-2__JX669484__SS-prME
accgcgggagugaucauuaugcugauccccacagcuauggccuuccaccucacgaccagaaauggggaaccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccugggccggcucaucacggugaacccuauuguuaccgagaaggauagcccggugaacaucgaagcugagcccccuuuuggggacucuuacauuaucaucggcgucgagcccggacagcugaaacuuaauugguucaagaagggcuccagcauugggcagauguuugaaacaaccaugagaggagccaaacgcauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggccauggugcaggcugauagcggaugugucgugucuuggaagaauaaagagcugaagugcggcuccgggauuuucaucacagacaacguucacaccuggacagaacaguacaaguuucagccugagagccccuccaaacuugccucugcuauucaaaaggcccaugaagagggcaucuguggaaucagaagcgugacgcgccuggagaaucucauguggaaacagauuaccccggaacugaaccacauccuguccgagaaugaagucaaacuuacaauuaugaccggcgauaucaaagggauuaugcaggcgggaaagcggucucucagaccucagcccacagagcugaaauauagcuggaagaccuggggcaaggccaaaaugcuguccacggaaagccauaaccaaaccuuccucaucgacgggccugagacagcugagugccccaauaccaaccgcgccuggaacucucuggaaguggaggauuacggauuuggcguuuucacaaccaacaucuggcuuaagcugcgggaaaaacaggacguguuuugugacuccaagcucaugagcgcugccauuaaagauaauagagcgguccacgccgacaugggcuauuggaucgagucugcucugaacgggacauggaagauggagaaggccuccuucauugaagugaaaagcugccacuggccuaagucucauacccuguggagcaauggaguucuugaguccgaaaugaucauucccaaaaacuucgcuggcccggugagccagcacaacuaccgcccuggguaucauacgcagacagccggacccuggcaccucggcaagcuggagauggauuuugacuucugugaagggaccaccgucguggugacagaggauugcggaaaucggggccccucucugagaaccacgacagccuccggcaaacucaucaccgaguggugcugucggagcugcacacugccuccgcuucgcuacagaggggaagacggauguugguacggcauggagauucggccccugaaggaaaaggaggaaaaccucgucaauucccugguuaccgcugggcauggacaaaucgauaacuuuucucugggcgugcuugggauggcccucuuccuggaggagaugcugagaacacgcgugggaaccaaacacgccauccuccuggucgcugugagcuuuguuacgcuuauuaccggcaauauguccuucaaggaccugggccgggugauggucaugguggggguugccaugacagaugacaucggaaugggcgugaccuaucucgcccugcuggcugccuuuaaagucagaccuacauucgcggcugggcuucugcuccgcaagcugaccucuaaagaacucaugauggccacgauuggaaucacacugcuuagccaguccaccauucccgagacaauccuggaacucaccgaugcccuggcucugggcaugauggugcuuaagaucguuagaaacauggagaaguaccagcuggccgugaccauuaugacaaucucuugcgucccuaaugcggugauucuccugaacgcuuggaaagugagcuguacgauccucgccgccgucuccguuagcccccugcuucugaccucuucccaacagaagacagacuggauuccucucgcucugaccaucaaagggcugaaucccacagccaucuuucuuaccacgcugagccggacaucuaagaaacgcuccuggccgcucaacgaagcugugauggccgugggaauggucagcauucuggcgucuucccuccugaagaaugauaucccuaugaccggcccccuuguggccggcgggcugcugaccguuugcuaugugcucacaggaagaagcgcugaccuggagcuugagcgggccgcugacgucaaaugggaagaucaggccgagauuuccggcagcucuccuauccugagcauuaccaucuccgaagacgggucuaugagcauuaagaacgaggaggaagaacagacacucacgauccugauccgcaccggacuccuggugauuuccggcguuuuccccgugucuaucccgauuacagccgcugcgugguaccuuugggaagucaagaaacaaagagccggggugcugugggaugucccuucucccccucccgugggaaaggcugagcuggaagacggcgccuaucggaucaaacagcgcggcauucucggguacucccagaucggagccggcguuuauaaggaggggaccuuucacacaauguggcaugugaccagaggagcuguccugaugcaccggggcaaacgcaucgagcccuccugggccgaugugaagaaggaccuuauuagcuacgggggaggcuggaaacuggaaggcgaguggaaggaaggggaggaaguucaggugcucgcgcuggagccuggcaagaauccgagagcuguccaaacgaagcccggccucuucaaaaccaacacagggaccaucggagccgugucccuggauuuuagcccuggcacaucugggucccccauuguggaccggaagggaaagguugucggccuuuacggcaaugggguggugaccagaagcggagccuaugucucugcuaucgcccagacagagaaauccauugaagauaacccugagaucgaagacgauaucuuccgcaagaaacggcugacgauuauggaccugcaucccggcgcggggaagaccaaaagauaccucccugcuaucgugcgcgaggccauuaagcggggacugagaacacuuauccuggccccgacccgcguuguggcugccgaaauggaggaggcucuccggggccugcccauuagauaucagaccccugccauccgcgcggaacacacagggcgggagauugucgaucucaugugucaugccacguucaccaugagacugcuuagccccgugcggguuccuaacuacaaucugaucaucauggacgaagcucacuuuacagaccccgccuccauugcugcccgcggcuauaucucuaccagaguggagaugggagaggccgcuggcauuuucaugacagcgaccccgccugggagccgggaucccuuuccccaguccaacgccccuaucauggacgaagaacgcgaaauucccgagagaagcuggaacucuggacacgaaugggucacggauuucaagggcaaaacagugugguuuguuccuuccaucaaggcugggaacgacaucgccgccugccugcggaaaaauggaaagaaagugauucaacucagcagaaagaccuucgauucugaguacgucaagacccgcgcuaacgacugggauuuuguggugacaaccgacaucagcgagaugggcgccaauuuccgggcggaaagagucauugauccgcgccgguguaugaaacccguuauccugacagacggggaggaaagagugauucuugcuggcccuaugcccgugacccauuccucugccgcccagcgccggggaagagucggccgcaacccuaagaaugagaacgaucaguauaucuacaugggggaaccccuggagaaugacgaggacugcgcucacuggaaagaagccaagaugcuccuggauaacaucaauacgccggagggaauuaucccuagcauguuugaacccgagagagaaaaaguggacgcgauugauggcgaguaccggcugcgcggggaggccagaaagacauucguugaccucaugcggcgcggagaucuuccuguguggcuggcuuauagagucgccgcugaaggcaucaacuacgccgaccggagaugguguuuugaugggauuaaaaauaaccaaauccuggaggaaaacguggagguugagauuuggaccaaggaaggcgagcgcaagaaacucaagccccgguggcuggacgcuagaaucuauuccgauccucuugcccugaaagaguucaaggaguucgcggccggacgcaaaucucucacacugaaucugaucaccgaaaugggccggcuccccacguuuaugacccagaaggcuagagacgcccuugauaaccuggcugugcugcauacagccgaggccgggggacgggcuuacaaucacgcgcucagcgagcugccggaaacccuugagacacugcuccugcugacccuccuugccacagucaccggcgggauuuuccuguuucugauguccggaaagggcgugggcaaaaugacgcucgggaugugcugcaucauuacagcuagcauccugcuuugguaugcccagauucagccucacuggaucgccgcuucuaucauucuggaguucuuucucaucguccugcugauucccgagcccgaaaagcaacgcaccccucaggacaaccagcucaccuacgugguuaucgccauucuuacagugguggcggccaccauggcuaaugagaugggauuccuggagaaaacaaagaaagaucugggccucggguccaucacgacccaggaaagcgaguccaacauccuggacauugaccuuagaccggccucugcuuggacacuguaugccgucgcgaccacauuuguuacccccaugcuccggcauagcaucgaaaauuccucugugaacgugagccugacggccauugcuaaucaagccaccguccugaugggacucggcaagggguggccucuuuccaagauggauaucggagugccccugcuggcuauuggcuguuacagccagguuaacccuaucacacucaccgccgcucugcuucugcucguggcccacuacgcgauuaucggccccgggcugcaggccaaagcuacacgcgaggcccagaagagagcugccgccggaaucaugaaaaauccuaccgucgacggcauuacggugaucgaucuggaaccgauucccuaugacccuaaguucgagaaacaacucgggcaggucaugcuucugauccugugcgugacacagguucucaugaugcggaccacaugggcgcugugugaggcucuuacccuggccaccggacccauuucuacacucugggaaggcaacccugggcgcuuuuggaauacgaccaucgcuguguccauggccaacaucuucagaggaagcuaccuggccggcgcuggccugcucuuuucuauuaugaagaauacaaccaacacacggcgcgggaccggaaauaucggcgagacgcuuggggaaaaguggaaauccagacugaacgcccugggaaagagcgaguuccagauuuauaaaaagucuggcauccaagaggucgaucggacacucgcgaaagaagggauuaagagaggagagaccgaccaucacgccgugagccgcggcuccgcuaaacugcggugguuuguugaaagaaacauggugacccccgagggcaaggucguggaucuugggugcggacgcggcggguggucuuacuauuguggaggccugaagaaugugcgggaaguuaaagggcucacaaagggaggcccgggccaugaggagccuauccccaugagcaccuacggguggaaccuggucagacugcaguccggaguggacguguucuucacacccccugaaaaaugcgauacgcuccuuugugacaucggcgagagcucccccaauccuaccauugaagccgggcgcacacugcggguccugaaccucguugagaauuggcugaacaauaacacccaguuuugcaucaaggugcuuaauccguauaugcccucugugauugagaagauggagacacugcaaagaaaguacggaggcgcucucguccgcaacccucugagccggaauagcacccacgagauguacugggugucuaacgccacggggaauaucguuagcuccgugaacaugauuucuagaaugcugaucaaucgcuucaccaugaagcacaaaaaggcgacauaugaacccgaugucgaccucggaagcggcacccggaacaucggcauugaguccgaaaucccuaaccuugauauuaucgggaaaagaauugagaagaucaaacaggaacaugagacaagcuggcacuacgaccaggaccaucccuauaagaccugggccuaccacggaucuuaugagacaaagcagaccggcuccgcuagcucuauggugaaugggguugugcgccugcugacgaaaccgugggaugucgugccuauggugacacaaauggccaugaccgacaccacacccuuuggacagcagagagucuucaaggaaaaaguugauacgcggacccaggagccuaaggaaggcaccaagaagcucaugcgcauuaccgcugaguggcuguggaaggagcuugggaaaaagaaaacacccagaauguguacccgggaagaguuuacaagaaaggugcgguccaacgccgcucugggagccaucuucaccgacgaaaauaaauggaaaagcgcgcgcgaggccguggaagauucuagauuuugggagcucgucgaccgggagcgcaaccugcaccuggaaggcaaaugcgagacguguguguacaauaugaugggcaagagagaaaagaaacucggggaguucggaaaggcuaaaggcucccgggccaucugguauauguggcugggggcucgcuuucuugaguucgaggcccugggauuucucaacgaggaucauugguucagcagaggcaauucccugagcgggguugaaggcgagggacuucaccggcugggcuacauucuccgcgacgugucuaagaaagaagggggagccauguacgcggaugacaccgcuggcugggauacaagaaucacccuggaggaccugaagaacgaagagauggucauuaaucauaugaagggggagcacaaaaagcucgccgaagccaucuuuaaacugacauaucaaaacaaggugguucgggugcagcgcccuacccccagaggaacggucauggacauuaucagccggcgcgaucagagaggcuccggacaggugggcacauacggacuuaauaccuucacaaacauggaggcucaacugauccggcagauggaaggcgaggggauuuucaaaucuauccagcaucucaccguuacggaggaaauugccgugcaaaauuggcuggcuagagucggacgcgagcggcuuagcagaauggccaucuccggcgacgauugcguggucaagccgcuggacgaucgcuuugcgucugcccucaccgcucugaacgacauggggaaggugcggaaagauauucagcagugggaaccuagcagaggauggaaugacuggacacagguucccuucugcucccaccacuuucaugagcuggugaugaaggauggccgcguccucguggugcccugucggaaccaagacgaacugaucgggagagcccgcaucucucagggcgcuggauggagccuuaaagagaccgccugccugggcaaguccuaugcgcagauguggacacucauguacuuccaccggagagaucugcgccuugccgcuaacgccauuuguagcgcuguuccuucucauugggugccgaccucccggacaaccuggagcauccacgccaaacacgaguggaugacgacagaagacaugcuggcugucuggaauagaguguggauucaggagaaccccuggauggaagauaagaccccuguugagucuugggaagaggugcccuaucucgggaagcgggaggaccaauggugcggaucccugaucggccugaccagcagagccacaugggcgaaaaauauucagaccgccaucaaccagguccgcucccucauugggaaugaagaguacacagacuauaugccuucuaugaagcgguuuagacgcgaagaggaagaggcuggagugcugugguga

SEQ ID NO: 19548 - RNA, 9876 nt, Artificial Sequence
  derived and/or modified CDS sequence (opt5) from DENV-2__JX669485__SS-prME
accgcgggcgugaucauuaugcugauccccaccgcuauggccuuccaccucacgacccggaauggggagccucauaugauugugggaaagcaggaaaaaggcaagagccugcuuuuuaaaacagaggacgggguuaauaugugcacccugauggcgaucgaucucggagaacugugugaggacacaauuaccuacaagugcccgcuucugcggcaaaaugaacccgaggauaucgacuguuggugcaauuccacaucuaccugggugacguauggcaccuguacaaccacaggggagcacagacgggaaaaacggagcguggcucucgucccucaugugggaaugggccuggagacccgcacggaaacauggauguccucugagggcgccuggaagcacguucagagaaucgagaccuggauucugcggcaucccggguucgccaucauggcugccauucucgcuuacacaaucggaaccacccacuuucagcgcgcccugauuuucauccuucugacagcgguggccccuagcaugacgaugagaugcauuggcaucuccaaccgggauuuugucgaaggggugucuggaggcagcuggguugacaucgugcucgagcacggguccugugucaccacaauggcuaagaauaaacccacccuggauuucgaacuuauuaagacagaggccaaacagccugcuacccugcgcaaguauugcaucgaagccaaacucacgaacacaaccaccgagagcagauguccgacacaaggagagcccucucugaaugaagaacaggacaagcgguuuauuugcaagcauuccaugguggaucgcggcuggggcaacggguguggacuguucggcaaagggggaaucgugaccugcgcgauguuuacaugcaagaaaaauauggaaggcaaggucguucucccugagaaccuggaauacacgauugugaucacaccccacagcggggaggagcaugccgugggaaaugacacaggcaaacacggcaaggaaaucaaaauuaccccucagucuuccaucacagaggcugaacuuaccggguauggaacggucaccauggaguguagccccagaacaggccuggauuucaacgaaauggugcuccugcagauggaggagaaggccuggcuuguucaccggcaaugguuucuggaccucccgcugccuuggcugcccggggcugauacccagggaucuaauuggauucagaaggaaacacucgugaccuucaaaaacccucaugccaagaaacaggacgucgugguucugggcucccaagagggggccaugcacacggcucuuacaggcgcgaccgaaauccagaugagcuccggaaaucugcucuuuacaggccaucugaagugccgccuuagaauggacaaacugcagcucaaggggaugucuuacagcauguguaccggaaaguucaaaauugugaaggagaucgccgagacccaacacggcacaaucgucauucgggugcaguaugaaggggauggaucccccugcaaaauccccuucgagauuauggaccuggaaaagagacauguccugggccgccucaucacggugaacccuauuguuaccgagaaagauagcccggugaacaucgaagcugagcccccuuuuggggacucuuacauuaucaucggcgucgagcccggacagcugaaacuuaauugguucaagaaaggcuccagcauugggcagauguuugaaacaaccaugcggggagccaagagaauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgcuccaccagccuuucugugucccucgugcugguuggcgucgugacccuguaucucggggccauggugcaggcugauagcggaugugucgugucuuggaaaaauaaggagcugaagugcggcuccgggauuuucaucacagacaacguucacaccuggacagaacaguacaaauuucagccugagagccccuccaaacuugccucugcuauucaaaaagcccaugaagagggcaucuguggaauccggagcgugacgagacuggagaaucucauguggaagcagauuaccccggaacugaaccacauccuguccgagaaugaagucaaacuuacaauuaugaccggcgauaucaaggggauuaugcaggcgggaaaacgcucucuccggccucagcccacagagcugaaguauagcuggaagaccuggggcaaagccaagaugcuguccacggaaagccauaaccaaaccuuccucaucgacgggccugagacagcugagugccccaauaccaacagagccuggaacucucuggaaguggaggauuacggauuuggcguuuucacaaccaacaucuggcuuaaacugcgcgaaaagcaggacguguuuugugacuccaaacucaugagcgcugccauuaaggauaaucgggcgguccacgccgacaugggcuauuggaucgagucugcucugaacgggacauggaagauggagaaagccuccuucauugaagucaagagcugccacuggccuaaaucucauacccuguggagcaauggaguucuugaguccgaaaugaucauucccaagaacuucgcuggcccggugagccagcacaacuacagaccuggguaucauacgcagacagccggacccuggcaccucggcaaacuggagauggauuuugacuucugugaagggaccaccgucguggugacagaggauugcggaaaucgcggccccucucugcggaccacgacagccuccggcaagcucaucaccgaguggugcuguagaagcugcacacugccuccgcuucgguaccgcggggaagacggauguugguacggcauggagauuagaccccugaaggaaaaagaggaaaaccucgucaauucccugguuaccgcugggcauggacaaaucgauaacuuuucucugggcgugcuugggauggcccucuuccuggaggagaugcugcggacaagagugggaaccaagcacgccauccuccuggucgcugugagcuuuguuacgcuuauuaccggcaauauguccuuccgcgaccugggccgggugaucgucaugguggggguuacaaugaccgaugacauuggaaugggcgugacauaucucgcccugcuggccgcuuuuaaagucagaccuaccuucgccgcggggcuucugcuccgcaagcugacgucuaaagaacucaugauggcuacaaucggaauuacccugcuuagccaguccacaauccccgagaccauccuggaacucaccgaugcccuggcccugggcaugauggugcuuaagauuguuagaaacauggagaaguaccagcuggcugugacaaucauggccauuucuugcgucccuaaugcggugauccuccugaacgcuuggaaagugagcuguacgauucucgccgucguuuccgugagcccccugcuucugaccucuucccaacagaagacagacuggaucccucucgcccugaccaucaaagggcugaaucccacagcuauuuuucuuaccacgcugagccggacaucuaagaaacgcuccuggccgcucaacgaagccgugauggcugucggaauggugagcauccuggccucuucccuccugaagaaugauauuccuaugaccggcccccuuguugcgggcgggcugcugaccgugugcuauguccucacaggaagaagcgccgaccuggagcuugagcgggcugccgacgugaaaugggaagaucaggcugagaucuccggcagcucuccuauucugagcaucaccauuuccgaagacgggucuaugagcaucaagaacgaggaggaagaacagacacucacgauccugauucgcaccggacuccugguuaucuccggcguguuccccgucucuauuccgaucacagccgccgcuugguaccuuugggaagugaagaaacaaagagcggggguccugugggaugugccuucucccccucccguugagaaggccgaacuggaggacggagcuuaucggauuaaacagcgcggcauccucggcuacucccagaucggggccggaguguauaaggagggcaccuuucacacaauguggcaugucaccagaggggccgugcugaugcaccggggaaaacgcauugaacccuccugggcugauguuaagaaggaccuuaucagcuacggcgggggauggaaacuggagggcgaauggaaggagggcgaagaggugcagguccucgcccuggagccugggaaaaauccgagagcggugcaaacgaagcccggacucuucaaaaccaacacaggcaccauuggggcugugucccuggauuuuagcccuggaacaucuggcucccccaucguugaccggaaggggaaggucgugggacuuuacggcaauggcguggucaccagaagcggggccuaugugucugccauugcucagacagaaaaauccaucgaggauaacccugaaaucgaggacgauauuuuccgcaagaaacggcugacgaucauggaccugcaucccggagccggcaagaccaaaagauaccucccugcgauuguucgcgaagcuaucaagcgggggcugagaacacuuauucuggccccgacccgcguggucgccgcugagauggaggaagcccuccggggacugcccaucagauaucagaccccugcuauucgcgccgagcacacaggccgggaaaucguggaucucaugugucaugcgacguucaccaugagacugcuuagccccguucgggugccuaacuacaaucugaucauuauggacgaggcccacuuuacagaccccgcuuccaucgccgcucgcggguauauuucuaccagagucgagaugggcgaagccgccggaaucuucaugacagcuaccccgccuggcagccgggaucccuuuccccaguccaacgcgccuauuauggacgaggaacgcgagauccccgaaagaagcuggaacucugggcacgagugggugacggauuucaagggaaaaacaguuugguuugugccuuccaucaaggccggcaacgacauugcugccugccugcggaaaaaugggaagaaagucauccaacucagcagaaagaccuucgauucugaguacgugaagacccgcgccaacgacugggauuuuguggucacaaccgacauuagcgaaaugggagcuaauuucaaagccgagcggguuaucgauccgagacgcuguaugaagcccgugauucugacagacggcgaagaacgggugauccuugcggggccuaugcccgucacccauuccucugcugcccagagacgcggccgggugggaagaaacccuaaaaaugaaaacgaucaguauaucuacaugggcgagccccuggagaaugacgaagacugcgcccacuggaaggaggcuaaaaugcuccuggauaacauuaauacgccggaagggaucauuccuagcauguuugagcccgaacgcgagaagguugacgccaucgauggagaguacagacugcggggcgaagcgcgcaaaacauucguggaccucaugagaagaggggaucuuccugucuggcuggccuaucgcguggcugccgagggaauuaacuacgcugacagacggugguguuuugauggcaucaagaauaaccaaauucuggaagagaacguugagguggaaaucuggaccaaggagggggaacgcaagaagcucaaaccccgcuggcuggacgcccggaucuauuccgauccucuugcucugaaggaguucaaagaguucgccgcgggcagaaagucucucacacugaaucugauuaccgagaugggacgccuccccacguuuaugacccagaaggcccgggacgcucuugauaaccuggccguccugcauacagcugaggccggcgggagagccuacaaucacgcucucagcgaacugccggagacccuugaaacacugcuccugcugacccuccuugcgacagugaccggaggcaucuuccuguuucugauguccgggaaaggaauuggcaagaugacgcucggcaugugcugcaucauuacagccagcauccugcuuugguaugcucagauccagccucacuggauugccgccucuaucauucuggaguucuuucucaucguccugcugauucccgaacccgagaaacaacggaccccucaggacaaccagcucaccuacgugguuaucgcuauccuuacagugguggccgcgaccauggccaaugagaugggguuccuggaaaagacaaagaaggaucugggacucggcuccauuacgacccaggagagcgaauccaacauccuggacauugaccuucgcccggcuucugccuggacacuguaugcugucgccaccacauuuguuacccccaugcucagacauagcaucgagaauagcucugugaacgugagccugacggcgauugccaaucaagcuaccguccugauggggcucggaaagggcuggccucuuuccaaaauggauaucggggugccccugcuggccauuggauguuacagccagguuaacccuaucacacucaccgcugcccugcuucugcucguggcucacuacgccaucauuggccccggccugcaggcgaaggccacacgggaagcucagaaacgcgccgcugccgggaucaugaagaauccuaccgucgacggaauuacggugaucgaucuggagccgauucccuaugacccuaaauucgagaagcaacucggccaggucaugcuucugauccugugcgugacacagguucucaugaugagaaccacaugggcccugugugaagcgcuuacccuggcuaccgggcccaucucuacacucugggagggaaacccuggccgguuuuggaauacgaccauugccguguccauggcuaacaucuuccgcgggagcuaccuggccggagccggccugcucuuuucuauuaugaagaauacaaccaacacaagacggggcaccgggaauaucggagaaacgcuuggcgagaaauggaagucccgccugaacgcucuggggaaaagcgaguuccagauuuauaagaaaucuggaauccaagaagucgauagaacacucgccaaggagggcaucaaaagaggggaaaccgaccaucacgcggugagcagaggauccgccaagcugcgcugguuuguugagcggaacauggugacccccgaaggcaaggucguggaucuuggcugcgggagaggaggcuggucuuacuauugugggggacugaaaaaugugcgcgagguuaagggccucacaaaagggggaccgggccaugaggaaccuauucccaugagcaccuacggcuggaaccugguccggcugcaguccgggguggacguguucuucacacccccugagaagugcgauacgcuccuuugugacaucggagaaagcucccccaauccuaccauugaggcuggcagaacacugcgcguccugaaccucguugaaaauuggcugaacaauaacacccaguuuugcaucaaagugcuuaauccguauaugcccucugugauugagaagauggagacacugcaacggaaguacgggggagcccucgucagaaacccucugagccgcaauuccacccacgaaauguacugggugucuaacgcuacgggcaauaucguuagcuccgugaacaugaucucucggaugcugauuaauagauucaccaugaaacacaagaaagccacauaugagcucgaugucgaccuugggagcggaacccgcaacaucggcauugaauccgagacacccaaccuggauaucauuggcaagcggaucgagaagauuaagcaggagcaugagaccagcuggcacuacgaccaggaccauccuuauaagacaugggcguaccacgggucuuaugaaaccaaacagacgggauccgccagcucuauggugaauggcguugugagacugcucacaaagcccugggaugucgugccgauggugacccaaauggcuaugaccgacacaacgccuuuugggcagcagcgcgucuucaaagagaagguugauaccagaacacaggaacccaaagagggaaccaagaagcugaugcggaucacagccgaguggcuuuggaaagaacugggcaagaaaaagaccccucgcauguguacaagagaggaauuuacccggaaagugagauccaacgcugcccucggggcuaucuucacggacgagaauaaguggaaaagcgcccgggaagcgguggaggauucucgcuuuugggagcuggucgacagagaacggaaccugcaccucgagggaaagugcgaaaccuguguguacaauaugaugggcaagcgcgagaaaaagcugggcgaguucgggaaagccaagggauccagagcuauuugguauauguggcuuggcgcccgguuucuggaguucgaggcucucggguuucugaacgaagaucauugguucagccgcggaaauucccuuagcggcguugagggggaaggccugcacagacucggauacauccugcgggacgugucuaaaaaggagggcggggccauguacgccgaugacacagcgggaugggauacccgcauuacacuggaagaccucaagaacgaggagauggucaccaaucauaugaaaggcgaacacaagaaacuggcugaggccaucuuuaaacuuacguaucaaaacaaagugguuagagugcagcggcccacaccucgcgggaccgucauggacauuaucagcagacgggaucagcgcggauccggccagguggggacauacggccugaauaccuucacgaacauggaagcccaacucaucagacagauggagggagagggcauuuucaagucuauccagcaucugaccguuacagaagagauugcugugcaaaauuggcuugcccgggucgggagagaacgccugagccggauggcuaucuccggagacgauugcguggucaagccccucgacgauagauuugccucugcgcugaccgcccugaacgacaugggcaaagugcgcaaggauauucagcagugggagccgagccggggguggaaugacuggacacagguuccuuucugcucccaccacuuucaugaacucgugaugaaagauggaagaguccugguggugcccugucgcaaccaagacgagcuuaucggccgggcuagaaucucucagggggccggcuggagccugaaggagaccgcuugccucggaaaauccuaugcccagauguggacacugauguacuuccaccgccgggaucuuagacuggcggccaacgcuauuuguagcgccguucccucucauugggugccuaccucccgcacgacauggagcauccacgcuaagcacgaauggaugaccaccgaggacaugcucgccgucuggaaucggguguggauucaggaaaacccguggauggaggauaagacacccguugaaucuugggaggaggugccuuaucugggcaaaagagaagaccaauggugcgggucccugaucggacucaccagccgggcuacaugggccaagaauauucagacggcgaucaaccaggucagaucccugauuggcaaugaggaauacaccgacuauaugcccucuaugaaacgcuuucggagagaggaagaggaggccggggugcuuugguga

SEQ ID NO: 19549 - RNA, 9876 nt, Artificial Sequence
  derived and/or modified CDS sequence (opt5) from DENV-2__JX669486__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagagcaggacaaacgcuuuauuugcaagcauuccaugguggauagaggcuggggcaacggguguggacuguucggcaaggggggaaucgugaccugcgcgauguuuacaugcaaaaagaauauggaaggcaaagucguucucccugagaaccuggaauacacgauugugaucaccccccacagcggggaggagcaugccgugggaaaugacacaggcaagcacggcgaagagaucaaaauuaccccucagucuuccaucacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauucagaaagagacacucgugaccuucaagaacccucaugccaagaaacaggacgucgugguucugggcucccaagaaggggccaugcacacggcucuuacaggcgcgaccgagauccagaugagcuccggaaaucugcucuuuacaggccaucugaagugcagacuucggauggacaaacugcagcucaaggggaugucuuacagcauguguaccggaaaauucaagauugugaaggagaucgccgaaacccaacacggcacaaucgucauuagagugcaguaugagggggauggaucccccugcaaaauccccuucgaaauuauggaccuggagaagcgccauguccugggccggcucaucacggugaacccuauuguuaccgaaaaagauagcccggugaacaucgaggcugagcccccuuuuggggacucuuacauuaucaucggcgucgaacccggacagcugaagcuuaauugguucaaaaagggcuccagcauugggcagauguuugagacaaccaugagaggagccaagcgcauggccauccugggcgauacagcuugggacuucgggucucucggaggcguguuuaccagcauugggaaagcccugcaccaaguuuucggcgcgaucuacggagcugccuuuuccggcgugucuuggacgaugaagauucugaucggggucaucauuacauggaucggaaugaacagccgguccaccagccuuucugugucccucgugcugguuggcgucgugacccuguaucucggggccauggugcaggcugauagcggaugugucgugucuuggaaaaauaaggaacugaaaugcggcuccgggauuuucaucacagacaacguucacaccuggacagagcaguacaaguuucagccugaaagccccuccaagcuugccucugcuauucaaaaagcccaugaggagggcaucuguggaaucagaagcgugacgcgccuggaaaaucucauguggaagcagauuaccccggagcugaaccacauccuguccgaaaaugaggucaaacuuacaauuaugaccggcgauaucaaggggauuaugcaggcgggaaaacggucucucagaccucagcccacagaacugaaguauagcuggaaaaccuggggcaaggccaagaugcuguccacggagagccauaaccaaaccuuccucaucgacgggccugagacagcugaaugccccaauaccaaccgcgccuggaauucucuggagguggaagauuacggauuuggcguuuucacaaccaacaucuggcuuaaacugcgggagaagcaggacguguuuugugacuccaaacucaugagcgcugccauuaaggauaauagagcgguccacgccgacaugggcuauuggaucgagucugcucugaacgauacauggaaaauggaaaaggccuccuucauugaggugaagagcugccacuggccuaaaucucauacccuguggagcaaugggguucuugaauccgagaugaucauucccaagaacuucgcuggaccggugagccagcacaacuaccgcccuggcuaucauacgcagacagccgggcccuggcaccucggaaaacuggaaauggacuuugauuucugugagggcaccaccgucguggugacagaggacugcgggaaucggggacccucucugagaaccacgacagccuccggcaagcucaucaccgaauggugcugucggagcugcacacugccuccgcuucgcuacagaggcgaggauggguguugguacggaauggaaauucggccccugaaagagaaggaagagaaccucgucaauucccugguuaccgcuggccaugggcaaaucgacaacuuuucucugggagugcuuggcauggcgcucuuccuggaggaaaugcugagaacacgcguggggaccaagcacgccauccuccuggucgcugugagcuuuguuacgcuuauuaccggaaauauguccuuccgggaucugggcagagugauggucauggugggcguuacaaugaccgacgauaucgggaugggagugacauaucucgcccugcuggccgcuuuuaaaguccgcccuaccuucgccgcgggccuucugcucagaaagcugacgucuaaagagcucaugauggcuacaauugggaucacccugcuuagccaguccacaacccccgaaaccauucuggagcucacagacgcccuggcccugggaaugauggugcuuaagaucguucggaacauggaaaaauaccagcuggcugugacgaucaugaccauucucugcgucccuaaugccgugauccugcucaacgcguggaaggugucuuguacaauucuggcugucguuagcguguccccccuucugcucaccagcucucaacagaagacagauuggaucccucuggcccugaccauuaaaggccuuaaucccacggccaucuuucugacaacccucucccgcaccagcaagaaaagaucuuggccgcugaacgaggcugugauggccgucgggaugguguccauccucgcuagcucucugcuuaagaaugacauuccuaugacaggaccccugguugccggcggccugcucaccgugugcuauguccugacagggcgguccgcggaccuugagcuggaacgcgccgcugaugugaaaugggaggaccaggccgaaaucagcggauccagcccuauucucucuaucacgauuagcgaggauggcuccaugucuaucaagaacgaggaagaggaacagacccugacaauucucaucagaaccgggcugcuuguuaucagcggaguguuccccgucuccauuccgaucacagcugccgccugguaccugugggaggugaaaaagcaacgggcuggcguccugugggacgugccuucucccccucccguugaaaaggcggagcucgaggauggggccuaucgcauuaaacagagaggaauccugggcuacagccagauuggcgcugggguguauaaggaaggaaccuuucacacgauguggcaugucacccggggcgccgugcuuaugcaccgcgggaaaagaaucgagcccuccugggccgacguuaagaaagaucugaucucuuacggaggcggguggaagcucgaaggagaguggaaggaaggcgaggaggugcagguccuggcucucgaaccuggcaaaaauccgcgggccgugcaaacaaagcccgggcuguucaaaaccaacacaggaaccauuggcgcggugagccuugacuuuuccccugggacaagcggaucucccaucguugauagaaagggcaaagucguggggcuguacggaaauggcguggucacgcgcuccggcgcuuaugugagcgccauugcccagaccgagaagucuaucgaagacaacccugagauugaagaugacaucuuccggaagaaaagacugacaaucauggaucuccaucccggggcuggaaagaccaaacgcuaccugccugccauuguucgggaggcgaucaagagaggccuucgcacccugauucucgcuccgacacggguggucgccgccgagauggaagaggcucugagagggcuccccauccgcuaucagacgccugccauucgggcugaacacaccggaagagagaucguggaccugaugugucaugccacauucaccaugcggcuucugucccccguucgcgugccuaacuacaaucugauuaucauggacgaggcgcacuuuacagaucccgccagcaucgcugccagaggcuauauuuccacccgggucgaaaugggggaggcugccggcaucuucaugacggccacaccgccuggaucucgcgaccccuuuccccagagcaacgcuccuauuauggaugaagagagagaaauccccgagcgguccuggaauagcggccacgagugggugaccgacuucaaagggaagaccguuugguuugugccuucuauuaaggcgggaaacgauaucgccgcuugccucagaaaaaauggcaagaaagucauccaacugucccgcaagacauucgacagcgaauacgugaaaacccgggccaacgauugggacuuuguggucacaaccgauauuucugagaugggggccaauuucagagcugaacgcguuaucgacccgcggagauguaugaagcccgugauucuuacggauggagaggaacgcgugauccuggccggcccuaugcccgucacacauagcuccgcggcucagcggagagggcgcgugggcagaaacccuaagaaugagaacgaccaguauauuuacaugggagagccccucgaaaaugacgaggauugcgcccacuggaaagaagccaagaugcugcuggacaacaucaauaccccggagggcaucauuccuucuauguuugaacccgagcgggagaaaguugaugcuaucgacggggaauaccgccucagaggagaggcccggaagacauucguggaucuuaugcgcagaggcgaccugccugucuggcuggcguaucggguggccgcugaagggauuaacuacgccgauagacgcugguguuuugacggaaucaaaaauaaccaaauucucgaggagaacguugaaguggagaucuggaccaaggaaggcgagcggaaaaagcugaagcccagauggcuugaugcucgcauuuauagcgacccucuggcccucaaagaauucaaggaguucgcugccgggcggaaaucccugacgcugaaucucaucaccgagaugggcagacuucccacauuuaugacccagaaggcgcggaacgcccuggauaaucuggcuguccuccauacagccgaagcuggaggccgcgccuacaaccacgcccugucugagcuuccggaaacccuggagacacuccugcugcucacccuucuggcuacggugacagggggaaucuuccuguuucucaugagcggcaaagggauuggaaagaugacccugggcaugugcugcaucauuaccgcguccguccuucugugguaugcccagauccagccucacuggauugcugccagcaucauccucgaauucuuucugauugugcugcucauccccgagcccgagaagcaaagaacaccucaggacaaucagcuuaccuacguugugauugccauccugacaguggucgcugccacgauggcgaacgaaaugggcuuccuggagaaaaccaagaaagaucucgggcugggaucuauuacaacccaggaauccgagagcaauauccuugacaucgaccugcggccggccuccgcuuggacacucuaugccguugcuaccacguuugugacccccaugcugcgccauucuauugaaaacagcuccgugaaugucucucugacagccaucgcgaaccaagccaccgugcucaugggccuugggaagggauggccucugagcaaaauggauauuggcguuccccugcucgcuaucggguguuacucccaggugaauccuauuacacugaccgccgcucuucugcuccuggucgcccacuacgcuaucauuggacccggccugcaggccaaggcgacgagagaggcccagaagcgggcugccgcuggcaucaugaaaaacccuacaguggacgggaucaccgucguggaucucgagccgauucccuaugacccuaaguucgaaaaacaacuuggacagguuaugcugcugauccucugcgugacacagguccugaugaugcgcaccaccugggcccuuugugaggcccugacacucgcgacgggccccauuagcacccugugggaagggaauccuggaagauuuuggaacacaaccaucgcugugucuauggccaauauuuuccggggcuccuaccuggcuggggccggacuccuuuuuagcaucaugaagaacacaaccaauacgcgcagaggcacaggcaacaucggggagacccugggagagaaauggaagucucggcugaacgcccucggcaaguccgaauuccagauuuauaaaagaagcgggauccaagagguugaucgcacccuggcuaaggaaggaauuaaacggggcgagacagaccaucacgccgugucuagagggagcgcgaagcuucgcugguuugucgaacggaauauggugacccccgagggaaaagugguugaucugggcugcggcagagggggaugguccuacuauuguggcgggcucaagaacguccgcgaggugaaaggacugacaaagggcgggccgggacaugaagagccuauccccaugucuacguacggcuggaaucuggugcggcuccagagcggcgucgacguuuucuucacccccccugaaaagugcgauacacuucugugugacauuggggaguccagccccaacccuaccaucgaagccggaagaacacugcgcgugcucaaucugguggagaacuggcuuaauaacaauacccaguuuugcaucaaaguccugaacccguauaugcccuccgugauugagaagauggaaacgcuccaacggaaauacggcggggcucugguuagaaauccucugucucgcaacagcacccacgagauguacuggguguccaaugccacaggaaacaucgucucuagcgugaauaugauuucccggaugcucaucaacagauucaccaugaagcacaaaaaggcuacauaugaacccgauguugaccuuggcucugggacccgcaacauuggaaucgagagcgaaaucccuaaucuggauauuaucggcaagagaauugagaaaaucaagcaggagcaugaaacauccuggcacuacgaccaggaccaucccuauaaaaccugggccuaccacggcagcuaugagacgaagcagacagggucugcguccagcauggugaacggagucgugcggcugcucaccaaaccgugggauguggucccuaugguuacccaaauggccaugacagacacgacccccuuuggccagcagcgcguguucaaggaaaagguggauacaagaacccaggagccuaaagaggggacaaagaaacugaugcggauuaccgcugaauggcuuuggaaggagcugggaaaaaagaagacacccagaauguguacccgggaagaguuuacgcgcaaagucagaucuaaugccgcucucggcgccaucuucaccgacgaaaacaaguggaaauccgcucgggaggccguggaggauagccgcuuuugggaacugguugacagagagcggaaucugcaccucgaagggaagugcgagacauguguguacaacaugaugggaaaacgcgaaaagaaacugggcgaguucggcaaggcgaaggggucuagagccauuugguauauguggcuuggagcucgguuucuggaguucgaagcccucggcuuucugaaugaggaucauugguucucccgcgggaacagccuuuccggagucgaaggcgaggggcugcacagacucggcuacauccugcgggacgugagcaaaaaggaaggaggcgcuauguacgccgaugacaccgccgggugggauacacgcaucacccuggaggaccucaaaaaugaggaaaugguuacgaaccauaugaagggagagcacaaaaagcuggcggaagcuguguuuaagcuuacauaucaaaauaaagucgugagaguucagcggccuaccccccgcggcacagugauggacauuaucucuagacgggaucagagagggagcggacaggucggcaccuacgggcugaacacguucaccaauauggaggcccaacucauucgccagauggagggcgaaggaaucuucaaguccauucagcaucugacagugaccgaggaaaucgccguccaaaacuggcuugcucgggugggcagagagcgccugucucggauggccaucagcggggacgauugcguugugaaaccgcucgacgauagauuugcuuccgcccugacagcgcugaaugacaugggaaagguccgcaaagauauucagcagugggaaccuucucggggcuggaacgacuggacccaggugcccuucugcagccaccacuuucaugagcucgugaugaaggaugggagaguucuggugguccccugucgcaaccaagacgagcuuaucggacgggccagaauuucccagggcgcuggguggucucugaaggaaacagccugccucggcaaaagcuaugcucagauguggacccugauguacuuccaccgccgggaucuuagacuggccgcgaaugccaucuguuccgcugugccuagccauuggguuccgacgucucggacaaccugguccauucacgccaagcacgaguggaugaccacagaagacaugcucgcuguguggaacagagucuggauccaggagaaucccuggauggaagauaaaaccccuguggagagcugggaggaaguccccuaucugggaaagcgcgaggaccaauggugcggcucucugaucgggcucacaucccgggccacgugggcuaaaaacauucagaccgccaucaaucaggugagaagccugauuggaaacgaagaguacacagacuauaugccuuccaugaagcgcuuuagacgggaagaggaggaagcgggcguucuuugguga

SEQ ID NO: 19550 - RNA, 9876 nt, Artificial Sequence
  derived and/or modified CDS sequence (opt5) from DENV-2__JX669487__SS-prME
accgcgggagugaucauuaugcugauccccaccgcuauggccuuccaccucacgaccagaaauggggagccucauaugauuguuggacggcaggaaaagggcaaaagccugcuuuuuaagacagaggacgggguuaauaugugcacccugauggcgaucgaucucggagaacugugugaggacaccauuaccuacaaaugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauuaugaucacaccccacagcggggaggagcaugccgugggaaaugacacaggcaagcacggcaaagaaaucaagauuaccccucagucuuccaucacagaggcugaacuuaccggguauggaacggugaccauggaguguagcccccggacaggccuggauuucaacgaaaugguccuccugcagauggaggagaaagccuggcuugugcaccgccaaugguuucuggaccucccgcugccuuggcugcccggggcugauacccagggaucuaauuggauucagaaggaaacacucguuaccuucaagaacccucaugccaaaaagcaggacguggucgugcugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauuguuaaagagaucgccgagacccaacacggcacaaucgugauuagaguccaguaugaaggggauggaucccccugcaagauccccuucgagauuauggaccuggaaaaacgccaugugcugggccggcucaucacggucaacccuauugugaccgagaaggauagcccgguuaacaucgaagcugagcccccuuuuggggacucuuacauuaucaucggcguggagcccggacagcugaaacuuaauugguucaagaagggcuccagcauugggcagauguuugaaacaaccaugagaggagccaaacgcauggccauccugggcgauacagcuugggacuucgggucucucggaggcgucuuuaccagcauugggaaggcccugcaccaaguguucggcgcgaucuacggagcugccuuuuccggcguuucuuggacgaugaaaauucugaucggggugaucauuacauggaucggaaugaacagccgguccaccagccuuucugucucccucgugcuggugggcguugucacccuguaucucggggccauggugcaggcugauagcggauguguggucucuuggaagaauaaagagcugaagugcggcuccgggauuuucaucacagacaacgugcacaccuggacagaacaguacaaguuucagccugagagccccuccaaacuugccucugcuauucaaaaggcccaugaagagggcaucuguggaaucagaagcguuacgcgccuggagaaucucauguggaaacagauuaccccggaacugaaccacauccuguccgagaaugaagugaaacuuacaauuaugaccggcgauaucaaagggauuaugcaggcgggaaagcggucucucagaccucagcccacagagcugaaauauagcuggaagaccuggggcaaggccaaaaugcuguccacggaaagccauaaccaaaccuuccucaucgacgggccugagacagcugagugccccaauaccaaccgcgccuggaacucucuggaagucgaggauuacggauuuggcguguucacaaccaacaucuggcuuaagcugcgggaaaaacaggacgucuuuugugacuccaagcucaugagcgcugccauuaaagauaauagagcggugcacgccgacaugggcuauuggaucgagucugcucugaacgauacauggaagauggagaaggccuccuucauugaagucaaaagcugccacuggccuaagucucauacccuguggagcaauggggugcuugaguccgaaaugaucauucccaaaaacuucgcuggaccgguuagccagcacaacuaccgcccuggcuaucauacgcagacagccgggcccuggcaccucggaaagcuggagauggacuuugauuucugugaaggcaccaccguggucgugacagaggacugcgggaaucggggacccucucugagaaccacgacagccuccggcaaacucaucaccgaguggugcugucggagcugcacacugccuccgcuucgcuacagaggcgaagauggguguugguacggaauggagauucggccccugaaggaaaaggaggaaaaccucgugaauagccuggucaccgcuggccaugggcaaaucgacaacuuuucucugggaguucuuggcauggcccucuuccuggaggagaugcugagaacacgcguggggaccaaacacgccauccuccugguggcugucagcuuugugacgcuuauuaccggaaauauguccuuccgggaucugggcagaguuauggugauggucggcgugacaaugaccgacgauaucgggaugggaguuacauaucucgcccugcuggccgcuuuuaaggugcgcccuaccuucgccgcgggccuucugcucagaaaacugacgucuaaggaacucaugauggcuacaauugggaucgcccugcuuagccaguccaccauucccgagacaauccuggaacucaccgacgcccuggcucugggaaugaugguccuucggaucgugcgcaacauggagaaauaccagcuggccguuaccauuauggcgaucucuugcgugccuaaugcugucauucuccugaacgccuggaaggugagcuguacaauccucgccgcuguguccgucagcccccugcuucugacgucuucccaacagaagaccgauuggauuccucucgcccugacaaucaaaggccugaaucccaccgcuaucuuucuuacaacccugagcagaacgucuaagaaacgguccuggccgcucaacgaagccguuauggcgguggggauggugagcauucuggccucuucccuccugaagaaugacaucccuaugacaggaccccuugucgcuggcggccugcugaccgugugcuauguucucaccgggcgcagcgccgaccuggagcuugagagagcugccgaugugaaaugggaagaccaggccgagauuuccggaagcucuccuauccugagcauuacaaucuccgaagauggcucuaugagcauuaagaacgaggaggaagaacagacccucacaauccugauccggacggggcuccuggucauuuccggaguguuccccguuucuaucccgauuaccgcugcggccugguaccuuugggaagugaaaaagcaacgcgcuggcguccugugggacgugccuucucccccucccgucgagaaggccgaacuggaggauggggccuauagaaucaaacagcggggcauucucggcuacucccagaucggcgcugggguguauaaggagggaacauuucacaccauguggcauguuacacgcggcgccgugcugaugcacagagggaaacggaucgaacccuccugggcggacgucaagaaagaucuuauuagcuacggaggcggguggaagcuggagggagaauggaaggagggcgaagaggugcagguucucgcucuggagccuggcaaaaauccgagagccgugcaaaccaagcccggacucuucaaaacgaacaccggaacaaucggcgccauuucccuggacuuuagcccugggaccucuggaucccccaucgucgaucgcaagggcaaagugguggggcuuuacggaaauggcguugucacacggagcggcgcuuaugugucugccauugcgcagaccgaaaaguccaucgaggacaacccugaaaucgaggaugacauuuucagaaagaaacgccugacaaucauggaucugcaucccggggcuggaaagacgaaacgguaccucccugccauugugagagaagccaucaagcgcggccugcggacccuuauucuggcuccgacaagagucguggccgcugagauggaggaagcccuccgcgggcugcccauccgguaucagaccccugcgauuagagccgagcacaccggacgggaaaucguugaccucaugugucaugcuacauucacgaugcgccugcuuagccccgugagagucccuaacuacaaucugaucauuauggacgaggcccacuuuaccgaucccgcuuccaucgccgcccggggcuauauuucuacacgcguggagaugggggaagcugcgggcaucuucaugaccgccacaccgccuggaagcagagaccccuuuccccaguccaacgcuccuauuauggaugaggaacgggagauccccgaaagaagcuggaacucuggccacgaguggguuaccgacuucaaagggaagacggugugguuugucccuuccaucaaggccggaaacgauauugccgcuugccugcgcaaaaauggcaagaaagugauccaacucagccggaagacauucgacucugaguacguuaaaaccagagccaacgauugggacuuuguggucaccacagauauuagcgaaaugggggcgaauuuccgcgcugagcgggugaucgacccgagacgcuguaugaagcccgugauucugaccgauggagaagaacgggucauccuugccggcccuaugcccguuacacauuccucugccgcucagagacgcgggagaaucggccggaacccuaagaaugaaaacgaccaguauauuuacaugggagagccccuggagaaugacgaagauugcgcccacuggaaagaggcgaagaugcuccuggacaacaucaauaccccggaaggcauuaucccuagcauguuugagcccgaacgcgagaaaguggaugccauugacggggaguacagacugcggggagaagcucgcaagacguucguggaucucaugagacggggcgaccuuccugucuggcuggccuauagaguggcugccgaggggaucaacuacgcugaucgccggugguguuuugacggaauuaaaaauaaccaaauccuggaagagaacguugagguggaaaucuggacaaaggagggcgaacgcaagaagcucaagccccgcuggcuggaugcccggauuuauuccgacccucuugcgcugaaagaguucaaggaguucgccgcugggagaaaaucucucacccugaaucugaucacagagaugggccggcuccccaccuuuaugacgcagaaggcccgcgaugcucuugacaaccuggccguccugcauaccgccgaggcuggaggcagagcguacaaacacgcccucagcgaacugccggagacacuugaaacccugcuccugcugacacuccuugcuaccgugacagggggaauuuuccuguuucugauguccggcaaggggaucggaaagaugacccucggcaugugcugcauuaucacggccagcauccugcuuugguaugcccagauucagccucacuggaucgcugccucuauuauccuggaguucuuucucauuguucugcugauccccgaacccgagaaacaacggacaccucaggauaaucagcucaccuacguggucaucgcgauucuuaccguggucgccgcuacaauggccaacgagaugggcuuccuggaaaagaccaaaaaggaccuggggcucggauccaucacaacgcaggagagcgaauccaauauucuggacaucgaucuucgcccggcuucugccuggacccuguaugcgguggccacaaccuuuguuacacccaugcucagacauagcauugagaacuccucugugaaugugagccugaccgcuaucgccaaccaagcuacgguccugaugggccucgggaaaggauggccucuuuccaagauggacauuggcguuccccugcuggccaucggguguuacagccaggugaauccuaucacccucacagcugcccugcuucugcucguggcgcacuacgccauuaucggacccggccugcaggcuaaggccacccgggaagcucagaaacgcgccgccgcgggcauuaugaagaacccuacagucgaugggaucaccgugauugaccuggagccgauccccuaugauccuaaauucgagaagcaacucggacagguuaugcuucugauccugugcgugacgcagguccucaugaugagaacaaccugggcucugugugaagcccuuacacuggcuaccggccccauuucuacccucugggaggggaauccuggacgguuuuggaacacaacgaucgccguguccauggccaauauuuuccgcggcagcuaccuggcuggggccggacugcucuuuucuaucaugaaaaacaccacaaauaccagacggggcacaggcaacauuggggaaacccuuggagagaaguggaaguccagacugaaugcgcugggcaaaagcgaguuccagaucuauaagaaaucugggauccaagaagucgaccgcacgcucgccaaggagggaauuaaacggggcgaaacagaucaucacgcugugagcagaggguccgccaagcugcgcugguuuguugagcggaacauggugacccccgaaggaaaagucguggaccuuggcugcggcagagggggauggucuuacuauuguggcgggcugaagaacguucgcgaggugaagggacucaccaaaggcgggccgggacaugaggaaccuauccccaugagcacauacggcuggaaucugguccggcugcaguccggcguggauguguucuucacacccccugagaagugcgacacacuccuuugugauauuggggaaagcucccccaacccuacgaucgaggcuggaagaacccugcgcguucugaaucucgccgaaaacuggcugaauaacaauacacaguuuugcauuaaaguccuuaacccguauaugcccucugugaucgagaagauggagacccugcaacggaaauacggcggggcgcucgugagaaauccucugagccgcaacuccacacacgaaauguacugggucucuaaugccaccggaaacaucguuagcuccgugaauaugauuucucggaugcugaucaacagauucacgaugaagcacaagaaagcuaccuaugagcccgacguggaucucggcagcgggacacgcaauauuggaaucgaauccgagauuccuaaccuugacaucauuggcaagagaaucgagaagaucaagcaggagcaugagaccagcuggcacuacgaccaggaucaucccuauaaaacaugggccuaccacggcucuuaugaaaccaagcagacaggguccgcuagcucuauggucaacggagugguucggcugcugaccaagccgugggacguggucccuauggugacgcaaauggccaugacagauaccacccccuuuggccagcagcgcguuuucaaagagaagguggacacaagaacgcaggaaccuaaagaggggaccaagaaacucaugcggauuacagcugaguggcuguggaaggaacuuggaaagaaaaagacccccagaauguguacacgggaggaauuuacccgcaaagucagauccaaugccgcgcugggcgccaucuucacagaugagaacaaguggaaaagcgcucgggaagccguggaggacucucgcuuuugggagcucguggauagagaacggaaucugcaccuggaggggaagugcgaaaccugugucuacaacaugaugggaaaacgcgagaagaagcucggcgaguucggcaaagcuaagggguccagagccauuugguauauguggcugggagcccgguuucuugaguucgaggcgcugggcuuucucaaugaagaccauugguucagccgcgggaacucccugagcggaguugagggcgaagggcuucacagacugggcuacauccuccgggaugugucuaaaaaggagggaggcgcuauguacgccgacgauacggccgggugggacacccgcauuacacuggaagaccugaaaaaugaggagauggugaccaaccauaugaagggagaacacaagaaacucgcugaggccaucuuuaagcugacauaucaaaauaaagucgugagaguucagcggccuacccccagaggcacggugauggauaucauuagcagaaaggaccagcggggguccggacaggucggcacauacgggcuuaacaccuucacaaauauggaagcucaacugaucagacagauggagggcgagggaauuuucaaaucuauccagcaucucaccgugacggaagagauugccguucaaaacuggcuggcgcgcgugggccgggaaagacuuagccgcauggccaucuccggggaugacugcgucgugaagccgcuggaugaccgguuugcuucugcccucaccgcucugaaugauaugggaaagguuagaaaagacauccagcagugggagccuagccgcggcuggaacgauuggacacaggugcccuucugcucccaccacuuucaugaacuggucaugaaggacgggcgggugcucgucgugcccuguagaaaucaagaugagcugauuggacgcgcccggaucucucagggcgcgggguggagccuuaaagagaccgccugccugggcaaguccuaugcucagauguggacacucauguacuuccacagacgcgaccugcggcuugccgcuaacgccauuuguagcgcuguuccuucucauugggugccgaccuccagaacaaccuggagcauccacgccaaacacgaauggaugacgacagaggauaugcuggcggucuggaaccggguguggauucaggaaaaucccuggauggaggacaagaccccuguggaaucuugggaggagguucccuaucucggaaagagagaagaccaauggugcggcucccugaucgggcugaccagccgcgccacaugggcuaaaaacauucagaccgccaucaaucaggugcggucccucaucggaaacgaggaauacacagauuauaugccuucuaugaagagauuucgcagagaggaagaggaggccggcguccugugguga

SEQ ID NO: 19551 - RNA, 9876 nt, Artificial Sequence
  derived and/or modified CDS sequence (opt5) from DENV-2__JX669488__SS-prME
accgcgggagugaucauuaugcugauccccaccgcuauggccuuccaccucacgaccagaaauggggagccucauaugauugucggacggcaggaaaagggaaagagccugcuuuuuaagacggaggacgggguuaauaugugcacccugauggcgaucgaucucggagaacugugugaggacacaauuaccuacaaaugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggagggaucgugaccugcgcgauguuuacaugcaaaaagaauauggaaggcaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccugggccggcucaucacggugaacccuauuguuaccgagaaggauagcccggugaacaucgaagcugagcccccuuuuggggacucuuacauuaucaucggcgucgagcccggacagcugaaacuuaauugguucaagaagggcuccagcauugggcagauguuugaaacaaccaugagaggagccaaacgcauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggccauggugcaggcugauagcggaugugucgugucuuggaagaauaaagagcugaagugcggcuccgggauuuucaucacagacaacguucacaccuggacagaacaguacaaguuucagccugagagccccuccaaacuugccucugcuauucaaaaggcccaugaagagggcaucuguggaaucagaagcgugacgcgccuggagaaucucauguggaaacagauuaccccggaacugaaccacauccuguccgagaaugaagucaaacuuacaauuaugaccggcgauaucaaagggauuaugcaggcgggaaagcggucucucagaccucagcccacagagcugaaauauagcuggaagaccuggggcaaggccaaaaugcuguccacggaaagccauaaccaaaccuuccucaucgacgggccugagacagcugagugccccaauaccaaccgcgccuggaacucucuggaaguggaggauuacggauuuggcguuuucacaaccaacaucuggcuuaagcugcgggaaaaacaggacguguuuugugacuccaagcucaugagcgcugccauuaaagauaauagagcgguccacgccgacaugggcuauuggaucgagucugcucugaacgauacauggaagauggagaaggccuccuucauugaagugaaaagcugccacuggccuaagucucauacccuguggagcaaugggguucuugaguccgaaaugaucauucccaaaaacuucgcuggaccggugagccagcacaacuaccgcccuggcuaucauacgcagacagccgggcccuggcaccucggaaagcuggagauggacuuugauuucugugaaggcaccaccgucguggugacagaggacugcgggaaucggggacccucucugagaaccacgacagccuccggcaaacucaucaccgaguggugcugucggagcugcacacugccuccgcuucgcuacagaggcgaagauggguguugguacggaauggagauucggccccugaaggaaaaggaggaaaaccucgucaauucccugguuaccgcuggccaugggcaaaucgacaacuuuucucugggagugcuuggcauggcccucuuccuggaggagaugcugagaacacgcguggggaccaaacacgccauccuccuggucgcugccagcuuugugacgcuuauuaccggaaauauguccuuccgggaucugggcagaguuauggugauggucggcgccacaaugaccgacgauaucgggaugggagugacauaucucgcucugcuggccgcguuuaagguucgcccuaccuucgcugccggccuucugcucagaaaacugacgucuaaggaacucaugauggccacaauugggaucgcucugcuuagccaguccaccauucccgagacaauccuggaacucaccgacgcccuggcgcugggaaugauggugcuucggaucguccgcaacauggagaaauaccagcuggcugugaccauuauggccaucucuugcguuccuaaugccgugauucuccugaacgcuuggaaggucagcuguacaauccucgccgcuguguccgugagcccccugcuucugacgucuucccaacagaagaccgauuggauuccucucgcccugacaaucaaaggccugaaucccaccgcgaucuuucuuacaacccugagcagaacgucuaagaaacgguccuggccgcucaacgaagccgucauggcuguugggauggugagcauucuggccucuucccuccugaagaaugacaucccuaugacaggaccccuuguggcuggcggccugcugaccgucugcuaugugcucaccgggcgcagcgccgaccuggagcuugagagagccgcugauguuaaaugggaagaccaggcggagauuuccggaagcucuccuauccugagcauuacaaucuccgaagauggcucuaugagcauuaagaacgaggaggaagaacagacccucacaauccugauccggacggggcuccuggugauuuccggagucuuccccgugucuaucccgauuaccgccgcugccugguaccuuugggaaguuaaaaagcaacgcgccggcgugcugugggacgucccuucucccccucccguggagaaggcugaacuggaggauggggccuauagaaucaaacagcggggcauucucggcuacucccagaucggcgcgggggucuauaaggagggaacauuucacaccauguggcaugugacacgcggcgcuguucugaugcacagagggaaacggaucgaacccuccugggccgacgugaagaaagaucuuauuagcuacggaggcggguggaagcuggagggagaauggaaggagggcgaagagguccaggugcucgcccuggagccuggcaaaaauccgagagcuguucaaaccaagcccggacucuucaaaacgaacaccggaacaaucggcgccauuucccuggacuuuagcccugggaccucuggaucccccaucguggaucgcaagggcaaagucguggggcuuuacggaaauggcgugguuacacggagcggcgcguaugucucugcuauugcccagaccgaaaaguccaucgaggacaacccugaaaucgaggaugacauuuucagaaagaaacgccugacaaucauggaucugcaucccggggccggaaagacgaaacgguaccucccugcuauugugagagaagccaucaagcgcggccugcggacccuuauucuggcuccgacaagaguggucgccgcggagauggaggaagcccuccgcgggcugcccauccgguaucagaccccugcuauuagagccgagcacaccggacgggaaaucguggaccucaugugucaugcuacauucacgaugcgccugcuuagccccguuagagugccuaacuacaaucugaucauuauggacgaggcccacuuuaccgaucccgccuccaucgcugcgcggggcuauauuucuacacgcgucgagaugggggaagccgcuggcaucuucaugaccgccacaccgccuggaagcagagaccccuuuccccaguccaacgccccuauuauggaugaggaacgggagauccccgaaagaagcuggaacucuggccacgagugggugaccgacuucaaagggaagacgguuugguuugugccuuccaucaaggcuggaaacgauauugccgcgugccugcgcaaaaauggcaagaaagucauccaacucagccggaagacauucgacucugaguacgugaaaaccagagcuaacgauugggacuuuguugugaccacagauauuagcgaaaugggggccaauuuccgcgccgagcgggucaucgacccgagacgcuguaugaagcccgugauucugaccgauggagaagaacgggugauccuugcuggcccuaugcccgucacacauuccucugccgcgcagagacgcgggagaaucggccggaacccuaagaaugaaaacgaccaguauauuuacaugggagagccccuggagaaugacgaagauugcgcccacuggaaagaggcuaagaugcuccuggacaacaucaauaccccggaaggcauuaucccuagcauguuugagcccgaacgcgagaaaguugaugccauugacggggaguacagacugcggggagaagcucgcaagacguucguggaucucaugagacggggcgaccuuccuguguggcuggccuauaaagucgcugccgaggggaucaacuacgcggauagacgcugguguuuugacggaauuaagaauaaccaaauccuggaagagaacguggagguugaaaucuggacaaaagagggcgaacggaagaagcucaaacccagauggcuggaugcccgcauuuauuccgacccucuugcucugaaggaguucaaagaguucgccgcugggcggaagucucucacccugaaucugaucacagagaugggcagacuccccaccuuuaugacgcagaaagcccgggaugcccuugacaaccuggcugugcugcauaccgcggaggccggaggccgcgcuuacaagcacgcccucagcgaacugccggagacacuugaaacccugcuccugcugacacuccuugccaccgucacagggggaauuuuccuguuucugauguccggcaaggggaucggaaaaaugacccucggcaugugcugcauuaucacggcuagcauccugcuuugguaugcccagauucagccucacuggaucgcggccucuauuauccuggaguucuuucucauugugcugcugauccccgaacccgagaagcaaagaacaccucaggauaaucagcucaccuacguugugaucgcuauucuuaccgucguggccgcuacaauggccaacgagaugggcuuccuggagaagaccaagaaagaccuggggcucggauccaucacaacgcaggagagcgaauccaauauucuggacaucgaucuucggccggcgucugccuggacccuguaugcugucgccacaaccuuugugacacccaugcuccgccauagcauugagaacuccucuguuaaugugagccugaccgcuaucgccaaccaagcuacggugcugaugggccucgggaagggauggccucuuuccaagauggacauuggcgucccccugcuggccaucggguguuacagccagguuaauccuaucacccucacagcggcccugcuucugcucguggcucacuacgccauuaucggacccggccugcaggcuaaagccaccagagaagcccagaagcgggcggcugccggcauuaugaaaaacccuacaguggaugggaucaccgucauugaccuggagccgauccccuaugauccuaaguucgagaaacaacucggacaggugaugcuucugauccugugcguuacacaggugcucaugaugcgcacaaccugggcucugugugaagcccuuacacuggccaccggccccauuucuacccucugggaggggaauccuggaagauuuuggaacacaacgaucgcugucuccauggccaauauuuuccggggcagcuaccuggcgggggccggacugcucuuuucuaucaugaagaacaccgcuaauacacgcagaggcaccggcaacauuggggaaacacuuggagagaaguggaaaucccggcugaaugcccugggcaagagcgaguuccagaucuauaaaaagucugggauccaagaaguggacagaacccucgcuaaagagggaauuaagcgcggcgaaacggaucaucacgccgucagccggggguccgcgaaacugagaugguuuguggagcgcaacaugguuacacccgaaggaaagguggucgaccuuggcugcggcagagggggauggucuuacuauuguggcgggcugaagaacgugcgggagguuaaaggacucaccaagggcgggccgggacaugaggaaccuauccccaugagcaccuacggcuggaaucuggugcgccugcaguccggcgucgauguguucuucacacccccugagaaaugcgacacccuccuuugugauauuggggaaagcucccccaacccuacaaucgaggccggacggacgcugagagugcugaaucucgcugaaaacuggcugaauaacaauacccaguuuugcauuaagguucuuaacccguauaugcccucugucaucgagaaaauggagacacugcaacgcaaguacggcggggcccucgugcggaauccucugagcagaaacuccacccacgaaauguacugggugucuaaugcuacaggaaacaucgucagcuccguuaauaugauuucucgcaugcugaucaaccgguucaccaugaagcacaaaaaggccacguaugagcccgacguggaucucggcagcgggaccagaaauauuggaaucgaauccgagauuccuaaccuugacaucauuggcaaacgcaucgaaaagaucaaacaggagcaugagacaagcuggcacuacgaccaggaucaucccuauaagaccugggcuuaccacggcucuuaugaaacaaagcagaccggguccgccagcucuauggugaacggagucgugagacugcugacaaaaccgugggacguugugccuauggucacccaaauggcgaugacggauacaacccccuuuggccagcagcggguguucaaggagaaaguugacacccgcacacaggaaccuaaggaggggacgaaaaagcucaugagaauuaccgccgaguggcuguggaaggaacuuggcaagaagaaaacaccccggauguguaccagagaggaauuuacacggaaggugcgcuccaaugcugcccugggcgcuaucuucaccgaugagaacaaauggaaaagcgccagagaagccgucgaggacucucgguuuugggagcucguggaucgcgaaagaaaucugcaccuggaggggaaaugcgaaacauguguguacaacaugaugggaaagcgggagaagaaacucggcgaguucggcaaggcgaaagggucccgcgcuauuugguauauguggcugggagccagauuucuugaguucgaggcccugggcuuucucaaugaagaccauugguucagccgggggaacucccugagcggagucgagggcgaagggcuucaccgccugggcuacauccucagagauguuucuaagaaagagggaggcgcuauguacgccgacgauaccgcugggugggacacgcggauuacccuggaagaccugaagaaugaggagauggugacaaaccauauggaaggagagcacaagaaacucgccgaagcgaucuuuaagcugaccuaucaaaauaaagugguccgcgugcagagaccuacaccccggggcaccguuauggauaucauuagccgcaaggaccagagaggguccggacaggugggcacguacgggcuuaacacauucaccaauauggaggcccaacugauccggcagauggagggcgaaggaauuuucaaaucuauccagcaucucacagucaccgaggaaauugcugugcaaaacuggcuggccagaguuggccgcgagcggcuuagcagaauggcuaucuccggggaugacugcguggucaagccgcuggaugaccgcuuugccucugcgcucacggcccugaaugauaugggaaaggugcggaaagacauccagcagugggaaccuagcagaggcuggaacgauuggacccagguucccuucugcucccaccacuuucaugagcuggugaugaaggacgggcgcguccucgugguccccugucggaaucaagaugagcugauugggagagcucgcaucucucagggcgccggguggagccuuaaagaaacagcuugccugggcaaguccuaugcccagauguggacccucauguacuuccaccggagagaccugcgccuugcugccaacgcgauuuguagcgccgugccuucucauuggguuccgacaucccggaccacauggagcauccacgcuaaacacgaguggaugaccacggaagauaugcuggccguguggaacagagucuggauucaggagaaucccuggauggaagacaagacaccuguggagucuugggaggaagugcccuaucucggaaagcgggaggaccaauggugcggcucccugaucgggcugaccagcagagccaccugggcuaaaaacauucagacagccaucaaucagguucgcucccucaucggaaacgaagaguacaccgauuauaugccuucuaugaagcgguuuagacgcgaagaggaggaagcgggcgugcugugguga

SEQ ID NO: 19552 - RNA, 9876 nt, Artificial Sequence
  derived and/or modified CDS sequence (opt5) from DENV-2__JX669479__SS-prME
accgccggcgugaucgucaugcucauucccaccgcuauggccuuccaccucacgacccggaauggggaaccucauaugaucguuggacggcaggaaaagggcaagagccugcuuuuuaagacggaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagagcgagaaccucgaauacaccauugugaucacaccucacucuggggaggagcaugcggugggaaaugacaccggcaagcacggcaaagaaaucaagauuacaccccaguccagcaccacggaggccgaacugaccggguauggaacagucaccauggaguguucuccucggacaggccuugauuucaacgaaauggugcugcuccaaauggaggacaaggcuuggcugguucaccgccagugguuucuugaucugccccucccguggcugccuggggccgacacccagggauccaauuggauccagaaggagacgcuggugacauucaagaacccccaugcuaaaaagcaagacgucgugguucucggcagccaggaaggggccaugcacaccgcccugacaggcgcuaccgagauucagauguccucuggaaaucuucuguuuaccggccaucucaaaugcagacugcggauggauaaacuucaacugaaagggaugagcuacuccauguguacaggaaaguucaagaucgugaaagaaauugcggagacgcagcacggcaccaucgucaucagagugcaguaugagggggacggaagcccuugcaagauucccuucgaaaucacagaucucgagaaacgccauguccugggccggcugauuaccgugaaccccaucguuacagaaaaggacucuccugugaacauugaggccgaaccgcccuuuggggauuccuacaucauugucggcguggagccuggacagcucaaacugaauugguucaagaagggcagcucuaucgggcaaauguuugagaccacgaugagaggagcuaaacgcauggccauccuuggcgacacagccugggauuucgggagccugggaggcguuuuuaccuccauugggaaggcucuccaccagguguucggcgccaucuacggagcggcuuuuucuggcgucagcuggaccaugaaaauucugaucggggugauuaucacauggaucggaaugaacucccggagcaccucucuguccgugagccuuguucucgucggcguggugacacuguaucugggggccaugguccaggccgacucuggauguauuguguccuggaagaauaaagaacucaagugcggcagcgggaucuucauuacggauaacguucacaccuggacagagcaguacaaguuucaacccgaauccccuucuaaacuggcuagcgccauccagaaggcucaugaggaaggcauuuguggaaucagauccgugacccgccuugagaaucugauguggaaacagaucacacccgagcucaaccacauucugucugaaaaugaggucaagcugaccaucaugacgggcgacauuaaagggaucaugcaggccggaaagcggagccuuagaccgcaaccuaccgaacucaaauauuccuggaagacauggggcaaggcgaaaaugcugagcaccgagucucauaaccagacauuccugauugaugggcccgaaaccgccgagugcccuaauacaaaccgcgcuuggaacucccucgagguggaagacuacggauuuggcguuuucaccacgaacaucuggcugaaacuucgggagaaacaggacguguuuugugauagcaagcugaugucugccgcuaucaaagacaauagagccguccacgcggauaugggcuauuggauugaauccgcccucaacgacacauggaagauggagaaggcuagcuucaucgaggugaaaucuugccacuggcccaagagccauacccugugguccaaugggguucuggaaagcgagaugauuaucccuaaaaacuucgccggacccgugucucagcacaacuaccgcccgggcuaucauacccaaacagcugggccuuggcaccuuggaaagcucgaaauggauuuugacuucugugagggcaccacggucguggugacagaagauugcgggaaucggggacccucccugagaaccacaaccgccagcggcaaacugauuacagaguggugcugucgguccugcacccugcccccucugcgcuacagaggcgaggacggguguugguacggaauggaaauccggccgcuuaaggagaaggaagagaaccuggucaauucucucguuacggccggccaugggcagauugauaacuuuagccugggagugcugggcauggcucuuuuccucgaagagaugcugagaacccgcguggggacaaaacacgcgauccugcucgucgcccuguccuuugugacccuuaucacaggaaauaugucuuuccgggaccugggcagaguuauggugauggucggcgcuaccaugacggaugacauugggaugggagugacauaucucgcccugcuggccgcuuuuaagguucgccccaccuucgccgcgggccuucugcucagaaaacugacaagcaaggagcucaugauggcuaccaucgggauugcccugcuuucccagucuacccugccugaaacaauccucgagcugacggaugcccuggcucuuggaaugauggcccugaaaauugugcggaacauggaaaaguaccaacucgcggucaccaucauggcuaucagcugcgugcccaaugccguuauucugcagaacgccuggaagguguccuguacaauccucgcugccgucagcgugucuccucugcuucugaccuccagccagcagaaagcugacuggauuccccucgcccugacaaucaagggccugaauccuaccgcgauuuuucuuacgacacugucucgcaccuccaaaaagagaagcuggccccucaacgaggccaucauggcuguggggauggucucuauccuggccuccagccuccugaaaaaugacauuccgaugaccggaccucuuguugcuggcggccugcugacagugugcuaugugcucaccgggcgguccgccgaucuggaacuugagcgcgccgcugacgucaagugggaggaucaagcggaaaucagcggaucuagccccauucuguccaucacaauuucugaggacggcagcauguccaucaaaaacgaagaggaggaacagacgcucaccauucugaucagaacagggcuccuggugaucucuggaguuuucccugugagcauucccaucaccgccgcugccugguaccuuugggaggucaagaagcagcgggccggcgugcugugggauguuccguccccucccccuguggaaaaagcugagcuggaagacggggccuaucgcauuaagcagagaggaauccucggcuacucucaaauuggcgcgggggucuauaaagagggaacauuucacaccauguggcaugugacgcggggcgcuguccugaugcaccgcgggaagagaaucgagcccagcugggccgaugugaaaaaggaccuuaucuccuacggaggcggguggaagcuggaaggagaguggaaagaaggcgaggaaguucaggugcucgcccuggagcccggcaagaauccucgggcuguccagaccaaaccggggauuuucaagacaaacaccggaacaaucggcgccgugagccucgauuuuucucccgggaccuccggaagcccuauuguugacagaaaaggcaagguggucgggcuguacggaaauggcguggugacacgcucuggcgcguauguuuccgcuaucgcccagacggaaaagagcauugaagauaaccccgagaucgaagacgauaucuuccggaaaaagagacuuaccauuauggaccugcauccuggggccggaaaaacaaagcgcuaccugcccgcuaucguccgggaggccauuaaaagaggccuccgcacccugauccuugcuccuacccgggugguggccgcggaaauggaggaggcccugagagggcucccgauucgcuaucaaacacccgcuauccgggccgaacacacgggaagagagauugucgaccugaugugucaugcuaccuucacaaugcggcuccuguccccugugcgcguucccaacuacaaucuuaucaucauggaugaagcccacuuuaccgacccugccucuauugcugcgagaggcuauaucagcacacggguggagaugggggaggccgcuggcauuuucaugaccgccacgcccccgggaucccgcgauccuuuuccccagagcaacgcccccaucauggacgaagagagagaaauuccugagcggucuuggaacuccggccacgaaugggucacagauuucaaggggaagaccgugugguuuguucccagcaucaaagcuggaaacgacaucgccgcgugccugagaaagaauggcaaaaaggugauucagcugucucgcaaaaccuucgauagcgaguacgucaagacacgggcuaacgacugggauuuugugguuaccacagacaucuccgagaugggggccaauuucaaggccgaaagagugauugauccucgccgguguaugaaaccggucauccucaccgacggagaggaaagagugauucuggcuggccccaugccugugacgcauucuagcgccgcgcaacgccgggggagaaucggccgcaaccccaagaaugagaacgaccaguauaucuacaugggagaaccucuugagaaugaugaggacugcgcccacuggaaagaagcuaagaugcugcucgauaacauuaauacacccgagggcaucauuccguccauguuugaaccugagagagaaaaagucgacgccaucgauggggaguaccggcugcgcggagaggcuagaaagaccuucguugaccugaugcggcgcggcgaucuccccguguggcuugccuauaaaguggcugccgaagggauuaacuacgcggacagaaagugguguuuugauggaaucaagaauaaccagauucuggaggaaaacgucgagguggagaucuggacaaaagaaggcgagcggaagaaacugaagccuagauggcucgacgcccgcaucuauucugauccccuggcucuuaaagaguucaaggaguucgccgcugggagaaagagccugacccucaaucugauuacggaaaugggcagacugccuaccuuuaugacacagaaagcccgcaacgcccucgacaaucuugcuguucugcauaccgcggaggugggaggccgggccuacacacacgcucuguccgagcuccccgaaacccuggagacacuucugcuccugacccugcucgccgccgucacagggggaaucuuccuuuuucugaugagcggcaaggggauuggaaaaaugacacugggcaugugcugcaucauuaccgcuucuauccuccugugguaugcccaaauccagccgcacuggauugcggccuccaucauucuugaguucuuucugaucgugcuccugauuccugagcccgaaaagcagagaacaccccaggauaaccaacugacauacguugugaucgcuauccucaccgucguggccgcuacaauggccaaugagaugggcuuccuugagaaaacgaagaaggaccugggguuuggaagcauuaccacacaggaauccgagucuaacauccuggacauugaucuccggccugcgagcgccuggacccuguaugcugucgccacaaccuucgugacgccgaugcuucgccauuccaucgaaaauucuagcguuaacgugucccugaccgcuauugccaaucaggcuacagugcucaugggccuggggaaaggauggccccugagcaagauggacaucggcgucccucuccuugccauuggguguuacucucagguuaaccccaucacccugacagcggcccugcuccugcuuguggcucacuacgccaucauuggaccuggccugcaagcuaaagccaccagagaggcccagaagcgggcggcugccggcaucaugaaaaaucccacgguggaugggauuacagucaucgaccucgaaccuauuccguaugaucccaaguuugagaagcagcugggacaggugaugcugcucauccuuugcguuacccaagugcugaugaugcgcacaaccugggcucugugugaggcccucacccuggccacaggcccuaucuccacgcuuugggaagggaaccccggaagauucuggaauaccacaauugcugucagcauggccaacaucuuucggggcucuuaccuggcgggggccggacuccuguucuccauuaugaaaaauaccacaaacacccgcagaggcacgggcaaugugggggagacacugggagaaaaguggaaaagccggcucaaggcucuuggcaaaucugaguuucagaucuauaagaaaagcgggauucaggaggucgaccgcacccuggccaaggaaggaaucaagagaggcgagaccgaucaucacgcugugucccgggggucugccaaacugagaugguucguugaacgcaacauggugacaccugagggaaaggucguggaccucggcugcggcagagggggauggagcuacuauuguggcgggcugaaaaacguucgggaagugaagggacuuaccaaaggcgggcccggacaugaggagccgaucccuauguccacauacggcuggaaucugguccgccuccaaagcggcguggauguguucuuuacgccucccgaaaagugcgacacccugcugugugauauuggggaguccucucccaaccccacaaucgaagcgggacggacccucagaguucuuaaucuggucgagaacuggcugaauaacaauacacaguucugcauuaaggugcucaacccuuauaugccgagcgugaucgagaagauggagacccugcagcgcaaguacggcggggcccuuguccggaauccccuguccagaaacucuacgcacgagauguacuggguuagcaaugcuaccggaaacauuguguccucugugaauaugaucagccgcaugcucaucaaccgguuuacaaugaaacacaagaaagccaccuaugaaccugacgucgaucugggcuccgggacaagaaauauuggaaucgagagcgaaauucccaaccuggacaucauuggcaagcgcaucgagaagauuaaacaggaacaugagaccucuuggcacuacgaccaagaucauccuuauaagacaugggcuuaccacggcuccuaugagaccaaacagacggggagcgccucuuccauggugaacggaguugugcggcuccuuacaaagcccugggacgucgugccgaugguuacccagauggcuaugaccgauacaacgccuuucggccagcaaagaguguuuaaagaaaaggucgacacccgcacacaggagcccaaggaagggaccaaaaagcugaugaaaaucacagccgaguggcuguggaaggagcucggaaaagaaaagaccccuagaauguguacacgggaggaguucacccgcaaagugagaagcaaugcggcccugggcgcuguguuuacggaugagaacaaguggaagucugcccgggaagcugucgaggacgggagauucugggagcuuguugaucgggaacgcaaucugcaccucgagggaaaaugcgaaaccuguguguacaacaugaugggcaagagagagaaaaagcugggcgaauuugggaaagccaagggaucccgggccaucugguauauguggcugggcgcgcgcuuccucgaguuugaggcucugggguuccuuaaugaagaccauugguuuagcagaggaaacucccugagcggcguggagggggaaggccuccaccggcugggauacauucuucgcgaggucggcaagaaagaagggggagccauguacgccgaugacacagcuggcugggauaccagaaucacacuggaggaccucaagaaugaggaaauggugaccaaccauaugaaaggggagcacaagaaacuggccgaagcuauuuucaagcugacguaucagaauaagguugugcggguccagcgccccacaccuagaggaaccgugauggacaucauuucucggaaagaucaacgcggcagcgggcagguuggcacauacggacucaacaccuucacgaauauggaggcccagcugaucagacaaauggagggcgaagggaucuuuaaguccauucagcaucuuaccgcgacagaggaaaucgccgugcagaacuggcuggcucgggucggacgcgagagacucucucggauggccauuagcggcgacgauugcgugguuaaacccaucgacgauagauucgcuuccgcccugaccgcgcuuaaugacauggggaaggugcgcaaagauauucagcaaugggaaccgucucggggauggaacgacuggacacaggucccuuuuugcagccaccacuuccaugagcuggugaugaaggauggcagaguccucgugguucccugucgcaaucaggacgagcugaucgggcgggccagaaucucccagggcgcuggauggucucugaaggaaaccgccugccucggcaaaagcuaugcucaaauguggacacugauguacuuucaccgccgggaucuuagacuggccgcuaacgccauuuguuccgcggugcccagccauugggucccuaccucucgcacgacaugguccauccacgccaagcacgaguggaugaccaccgaagacaugcucgcuguguggaaccggguguggauucaggagaauccguggauggaagauaaaacacccguugagagcugggaggaagugccuuaucuggggaagagagaggaccaguggugcggaucucuuaucggccugaccucccgcgccacaugggccaaaaacauucagacggcuaucaaucaaguccggagccucauugggaacgaaggauacaccgacuauaugcccuccaugaagagauuccggagagaggaagaggaggccggcgugcugugguga

SEQ ID NO: 19553 - RNA, 9876 nt, Artificial Sequence
  derived and/or modified CDS sequence (opt5) from DENV-2__KF744403__SS-prME
acagcuggaaugaucauuaugcugauccccacagugauggcuuuccaccucacgaccagaaauggggagccucauaugauugucagccggcaggaaaaggggaaaucccugcuuuuuaagacagaggacggcguuaauaugugcacccugauggccauggaucucggggaacugugugaggacacaaucaccuacaaaugcccgcuucugcgccaaaacgaacccgaggauauugacuguuggugcaauucuacaagcaccugggugacguauggaaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacaaacuuucagagagcucuuauuuucauccugcucacggccguugcgccuuccaugaccaugcggugcauuggaaucucuaaucgcgauuuuguggaaggcgucagcgggggauccuggguggacauuguucuggagcacggcagcugugugacaaccauggccaagaacaagcccacacuugauuucgaacugaucaaaaccgaggcuaagcagccugccacgcucagaaaauauugcaucgaagcuaagcugacaaauaccaccacagagucucgguguccgacccaaggggagcccucccugaacgaagaacaggacaaacgcuuugucugcaagcacagcaugguggauagaggauggggcaauggcugugggcuuuucggaaagggcgggauugugacaugcgccauguuuacgugcaaaaagaacauggaaggaaaaaucguccagccugagaaucuggaauacaccauuguuaucacaccccauucuggcgaggagcacgcgguggggaacgacaccggaaagcauggcaaagaaauuaagaucacaccucaguccagcaucaccgaggccgaacuuacgggcuaugggaccgugacaauggaguguucuccccggaccggacuggauuucaaugaaaugguccuccugcaaauggagaacaaggcuuggcuugugcaccgccagugguuucuggaccucccgcugccuuggcugcccggcgccgauacacagggguccaauuggauucagaaggagacccucguuacguucaagaacccucacgcuaaaaagcaagacguggucgugcugggaagccaggaaggcgccaugcauacagcccuuaccggggcuacagagauccagauguccucuggcaaccugcucuuuaccggacaccugaaaugcagacuucggauggacaagcugcaacucaaaggcaugagcuacuccauguguaccgggaaguucaagguugugaaagaaauugcggagacacagcauggaacgaucgucgugagaguccaguaugagggcgaugggagccccugcaagauucccuucgaaaucauggaccuggagaaacgccacgugcugggacggcucaucaccguuaauccuauugugacagaaaaggauucuccggucaacaucgaggccgaacccccuuuuggcgacuccuacgugauuaucgggguugagcccggccagcugaaacuuaauugguucaagaagggaagcucuauuggccaaauguuugagaccacaaugagaggggcuaaacgcauggccauccugggagauaccgccugggacuucggcagccucgggggaguguuuacguccauuggcaaggcucugcaucaggucuucggggccaucuacggcgcggcuuuuucuggagugagcuggacaaugaaaauccugauuggcgugaucauuaccuggaucgggaugaacucccggagcaccucucuuuccguuagccucguccuggugggaguggucacacuguaucucggcgugguugugcaggccgauucugggugugucguguccuggagaaauaaggaacugaaaugcggaagcggcauuuucaucaccgacaacguucacacauggacggagcaguacaaguuucaaccugaaucccccucuaaacuugccagcgcuauccagaaagcccaccaggaggggauuuguggcauccgcuccgugacccggcuggaaaaucucauguggaagcagauuacaccggagcugaaccauauccugucugagaaugaagucaaacuuaccauuaugacaggagauaucaagggcaucaugcacgcugggaaaagaagccuccgcccucaacccaccgagcugcgguauuccuggaagacguggggaaaagccaagauucugagcaccgaaucucauaaccagacauuccucaucgacggcccugagaccgcggaaugccccaauacaaacagagccuggaacucccuggagguggaggauuacggguuuggaguuuucaccacaaacauuuggcuucgccugcgggaaaagcaggacgcuuuuugugacagcaaacucaugucugccgcuaucaaggauaauagagccgugcacgcggacaugggcuauuggauugaguccgcccugaacgauaccuggaaaaucgaaaaggcuagcuucaucgaggucaaaucuugccacuggccuaagagccauacgcugugguccaacggcgugcuugagagcgaaaugauuauccccaagaauuucgccgggccggugucucagcacaacuaccggccuggauaucauacacaaaccgcuggccccuggcaccucgggaaacuggagauggacuuugauuucuguaagggaaccacagucguugugaccgaagacugcggcaaucgcgggcccucccugagaacgacaaccgccagcggaaaacucauuacagaguggugcugucgguccugcacccugccuccgcuuagauaccgcggcgaagauggcuguugguacgggauggagauccggccccugaaggagaaagaagagaaccucgugucuagccuggucacagccggacauggccagauugacaauuuuucccugggggugcuuggaauggcucucuuccuggaagagaugcugagaacccgcguuggcacgaagcacgcgauccuccugguggccgucucuuuugugacccuuauuacagggaacaugagcuucagagaucugggacggguuauggugauggucggcgcuaccaugacagacgauaucggcaugggggugaccuaucucgcccugcuggccgcuuuuaagguucgcccuacguucgccgcgggacuucugcucagaaaacugacauccaaggaacucaugaugaccacaaucggcauugugcugcuuucucagagcaccauccccgagaccauucuggagcucacagacgcucuggcccuggggaugaugguccuuaaaaucgugcggaagauggaacgcuaccaacuggccgugacgauuauggcuauccucugcgucccuaaugccguuauccugcagaacgcguggaaaguguccuguaccauucucgcuguggucagcgugucuccccugcuucugacauccagccagcagaaggccgauuggaucccucucgcccugaccauuaagggacugaaucccacagcuaucuuucuuaccacgcugucuagaacauccaaaaagcggagcuggccgcucaacgaggccauuauggcuguuggcauggugucuauccuggccuccagccuccugaaaaaugacaucccuaugaccgggccccuugucgcgggaggccugcugaccgugugcuauguucucacaggccgcuccgccgaccuggaacuugagaaggcugccgaugugagaugggaagaccaagcugagauuagcgggucuagcccuauccuguccauuaucauuucugaggauggaagcauguccaucaaaaacgaagaggaggaacagacccucacaauucugauccggacgggccuccuggucaucucugggcuuuuccccgugagcauuccgaucaccgccgccgcuugguaccugugggaggucaagaaacagcgcgcgggagugcugugggacguuccuucucccccucccgugggcaaggccgaacucgaggauggggcuuauagaauuaagcagaaaggaauccugggcuacagccaaauuggcgccggggucuauaaggaaggaacauuucacaccauguggcaugugacacggggcgccguucuuaugcacaaagggaagagaaucgagcccagcugggcugacgugaaaaaggaucugaucuccuacggaggcggguggaagcucgaaggagaguggaaagagggcgaagagguccaggugcuggcccucgaaccuggcaagaauccgcgcgcggugcagaccaaacccgggcuguucaagacgaacgcuggaaccauuggcgccguuagccuugacuuuucuccugggacauccggaagccccaucauugauaaaaagggcaaggucguggggcuguacggaaauggcguggucacccggaacggcucuuauguguccgccaucgcucagacagagaaaagcauugaagacaacccugagaucgaggaugacaucuucagaaagaaacgccugaccauuauggaucuccaucccggggccggaaagacaaaacgguaccugccugcgaucguuagagaagcuauuaagcgcggccuucggacgcugauccucgccccgaccagaguggucgccgcugagauggaagaggcccugcgcgggcuccccauucgguaucaaaccccugcuaucagagccgaacacaccggacgggagauuguggaccugaugugucaugcgaccuucacaaugcgccuucugucccccaucagaguuccuaauuacaaccugaucauuauggacgaggcccacuuuacggaucccgcuucuaucgccgcucggggcuauauuagcacccgcguggaaaugggggaggccgccggcaucuucaugacagcuaccccgccuggauccagagaccccuuuccccagagcaaugcgccuauuauggaugaggaacgggagauccccgaaagaucuuggaacuccggccacgagugggucacagacuucaaggggaaaaccgugugguuuguuccuagcaucaaggccggaaaugauauugcugccugccuccgcaaaaacggcaagaaagugauccagcugucucggaagacguucgacagcgaauacgucaagacaagaaccaaugauugggacuuuguggugaccacagauauuuccgagaugggggccaacuucaaagcugaacgcgucaucgacccgcggagauguaugaagcccguuauucuuaccgauggagaggagcgcgugauccuggccggcccuaugcccgugacacauucuagcgcggcucaacggagagggcgcaucggcagaaauccuaaaaacgaaaaugaccaguauauuuacaugggagagccccucgaaaacgacgaggauugcgcccacuggaaggaagccaaaaugcugcuggacaauaucaacaccccggagggcauuaucccuuccauguuugagcccgaacgggagaaggucgaugcuauugacggggaauaccgccucagaggagaggcccggaaaacguucguggaucuuaugcgcagaggcgaccugccuguuuggcuggcguauaagguggccgcugaagggaucaauuacgccgaucggagaugguguuuugacggcauucgcaacaaccagauccucgaggagaaugucgaaguggagaucuggacaaaggaaggcgagcggaaaaagcugaaacccagauggcuugaugcucgcauuuauucugacccucuggcccucaaggaguucaaagaguucgcugccgggagaaagagccugacccugaaccucaucacagagaugggccggcuucccaccuuuaugacgcagaaggcgcgggaugcccuggacaaucuggcuguucuccauaccgccgaagcuggaggccgcgccuacaaccacgcccuguccgagcuuccggaaacacuggagauucuccugcugcucacccuucuggcuacagugaccgggggaaucuuccuguuucucaugagcggcagagggauuggaaaaaugacacugggcaugugcugcaucaucaccgcgucuauucuucugugguaugcccaaauccagccucacuggauugcugccuccaucauucucgaguucuuucugaucguccugcucauccccgaacccgagaagcagcggacgccucaggauaaucaacuuacauacguggucauugccauccugaccgugguugcugccaccauggcgaacgaaaugggcuuccuggagaaaacaaagaaagaccucgggcugggaagcauuaccacacagcagccggaauccaauauccuugacauugaucugcgccccgccucugcuuggacgcucuaugccguggcuaccacauuuaucaccccuaugcugagacauagcauugagaacuccucugugaaugucagccugacagccaucgcgaaccaggccaccguucucaugggccuugggaagggauggccccuguccaagauggacaucggcgugccucugcucgcuauuggguguuacagccaagugaaucccaucacgcugaccgccgcccuucugcuccuggucgcccacuacgcuauuaucggaccuggccugcaggccaaagcgacacgggaggcccagaagcgcgcugccgcuggcauuaugaaaaacccgaccguggaugggaucacaguuaucgaccucgaucccauuccuuaugaccccaaguucgaaaaacagcuuggacaagugaugcugcugguccucugcgugacccagguccugaugaugagaacgacaugggcccuuugugaggcccugacccucgcgacaggcccuaucucuacccugugggaagggaaucccggacgguuuuggaacaccacaauugcuguguccauggccaauaucuuccgcggcagcuaccuggcuggggccggacuccucuuuucuauuaugaagaacacgaccaauacaagacggggcaccggcaacaucggggagacacugggagaaaaguggaaauccagacugaacgcccucggcaagagcgaguuccagaucuauaaaaagucugggauucaagagguugaucgcacccuggcuaaagaaggaaucaagcggggcgagacggaccaucacgccgugagcagaggguccgcgaaacuucgcugguuugucgaacggaauaugauuacaccggagggaaaggugguugaucugggcugcggcagagggggauggucuuacuauuguggcgggcucaagaacgugcgcgaggucaaaggacugaccaagggcgggccuggacaugaggaacccauccccaugagcaccuacggcuggaaucuggugcggcuccaguccggcguggacguuuucuucacaccucccgaaaaaugcgauacccuucugugugacauuggggagagcuccccuaacccgacagucgaagccggaagaacgcugcgcgugcucaaucugguggagaacuggcuuaauaacaauacccaguuuugcaucaagguccugaaccccuauaugccuucuguuaucgagaaaauggaagcucuccagcggaaguacggcggggcccuggugagaaauccccugagccgcaacuccacacacgagauguacugggugucuaaugcuagcggaaacauugucuccucugugaauaugaucagccggaugcucauuaacagauucaccaugaagcacaaaaaggccacauaugaaccugauguugaccuuggcuccgggacccgcaacaucggaauugagagcgaagugcccaaucuggacaucauuggcaaaagaaucgagaagaucaaacaagagcaugaaacgucuuggcacuacgaucaggaccauccguauaagaccugggcguaccacggcuccuaugagacaaagcagaccgggagcgccucuuccauggucaacggagugguucggcugcucacaaaaccuugggaugugauucccauggucacccagauggcuaugacagacaccacgccuuuuggccaacagcgcguguucaaggaaaaaguggauacaagaacccaggagcccaaggaagggaccaaaaagcugaugaagaucacagccgaguggcuuuggaaagagcugggaaagaaaaagacgccucggauguguaccagagaagaguuuacacggaaaguccgcagcaaugcugcccucggcgcuauuuucaccgacgaaaacaaguggaaaucugccagagaggcgguugaggauucccgguuuugggaacugguggacaaggagcgcaaucugcaccucgaagggaagugcgagacauguguguacaacaugaugggaaaaagagaaaagaaacugggcgaguucggcaaggccaaagggagccgggcuaucugguauauguggcuuggagcccgcuuucuggaguucgaagcucucggcuuucugaaugaggaucauugguucuccagagaaaacagccuuucuggggucgagggagaaggccugcacaagcucggguacauucugcgggacgugagcaagaaagagggcggagccauguacgccgaugacaccgcgggcugggacacacgcaucacccuggaggaucucaagaaugaagagaugguuacgaaccauauggaaggggagcacaaaaagcuggcugaagccaucuuuaaacuuaccuaucagaauaagguggucagagugcaacggcccacaccgcgcggaaccguuauggacauuaucuccagacgggaucagcgcggcucuggacaggugggaacauacggccugaacaccuucacgaauauggaggcccaacucauuagacagauggagggggaaggcgucuucaagagcauccagcaucugacagcuaccgaggaaauugccgugcagaacuggcuugcucggguuggaagagagcgccugucccggauggccaucucuggcgacgauugcguggucaaaccucucgacgauagauuugcgagcgcccugacagcucugaaugacauggggaaggugcgcaaagauauccaacagugggagcccuccaagggauggaacgacuggacccagguccccuucugcucucaccacuuucaugaacucauuaugaaagauggccgggugcugguugugccuuguagaaaccaggacgagcuuaucgggcgcgcccggauuagccaaggagcuggcuggucccugagagaaacggccugccucgggaaguccuaugcgcagauguggucucugauguacuuccaccgccgggaucuuagacuggccgcuaaugccaucuguuccgcugucccgagccauugggugcccaccucucgcacaaccugguccauucacgccaagcacgaguggaugacaaccgaagacaugcucacaguguggaaccggguuuggauccaggagaauccuuggauggaggacaaaacccccguggaaagcugggaggaaauuccuuaucugggcaagagagaggaucaguggugcggaucccugaucggccucacgucucgggcuacaugggccaaaaacauccaaaccgcgauuaaucaggucagaagccugaucgggaacgaagaguacaccgacuauaugcccuccaugaagcgcuuucggagagaggaagaggaagccggagugcuuugguga

SEQ ID NO: 19554 - RNA, 9876 nt, Artificial Sequence
  derived and/or modified CDS sequence (opt5) from DENV-2__KF744406__SS-prME
acagccggaaugaucauuaugcugauccccacagugauggcuuuccaccucacgaccagaaauggggagccucauaugauugucucccggcaggaaaaggggaaaucccugcuuuuuaagacagaggacggcguuaauaugugcacccugauggccauggaucucggggaacugugugaggacacaaucaccuacaaaugcccgcuucugcgccaaaacgaacccgaggauauugacuguuggugcaauucuacaagcaccugggugacguaugggaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacaaacuuucagagagcucuuauuuucauccugcucacggccguugcgccuuccaugaccaugcggugcauuggaaucucuaaucgcgauuuuguggaaggcgucagcgggggauccuggguggacauuguucuggagcacggcagcugugugacaaccauggccaagaacaagcccacacuugauuucgaacugaucaaaaccgaggcuaagcagccugccacgcucagaaaauauugcaucgaagcuaagcugacaaauaccaccacagagucucgguguccgacccaaggggagcccucccugaacgaagaacaggacaaacgcuuugucugcaagcacagcaugguggauagaggauggggcaauggcuguggacucuucggaaagggcgggauugugacaugcgccauguuuacgugcaaaaagaacauggaaggaaaaaucguccagccugagaaucuggaauacaccauuguuaucacaccccauucuggcgaggagcacgcgguggggaacgacaccggaaagcauggcaaagaaauuaagaucacaccucaguccagcaucaccgaggccgaacuuacgggcuaugggaccgugacaauggaguguucuccccggaccggacuggauuucaaugaaaugguccuccugcaaauggagaacaaggcuuggcuugugcaccgccagugguuucuggaccucccgcugccuuggcugcccggcgccgauacacagggguccaauuggauucagaaggagacccucguuacguucaagaacccucacgcuaaaaagcaagacguggucgugcugggaagccaggaaggcgccaugcauacagcccuuaccggggcuacagagauccagauguccucuggcaaccugcucuuuaccggacaccugaaaugcagacuucggauggacaagcugcaacucaaaggcaugagcuacuccauguguaccgggaaguucaagguugugaaagaaauugcggagacacagcauggaacgaucgucgugagaguccaguaugagggcgaugggagccccugcaagauucccuucgaaaucauggaccuggagaaacgccacgugcugggacggcucaucaccguuaauccuauugugacagaaaaggauucuccggucaacaucgaggccgaacccccuuuuggcgacuccuacgugauuaucgggguugagcccggccagcugaaacuuaauugguucaagaagggaagcucuauuggccaaauguuugagaccacaaugagaggggcuaaacgcauggccauccugggagauaccgccugggacuucggcagccucgggggaguguuuacguccauuggcaaggcucugcaucaggucuucggggccaucuacggcgcggcuuuuucuggagugagcuggacaaugaaaauccugauuggcgugaucauuaccuggaucgggaugaacucccggagcaccucucuuuccguuagccucguccuggugggaguggucacacuguaucucggcgugguugugcaggccgauucugggugugucguguccuggagaaauaaggaacugaaaugcggaagcggcauuuucaucaccgacaacguucacacauggacggagcaguacaaguuucaaccugaaucccccucuaaacuugccagcgcuauccagaaagcccaccaggaggggauuuguggcauccgcuccgugacccggcuggaaaaucucauguggaagcagauuacaccggagcugaaccauauccugucugagaaugaagucaaacuuaccauuaugacaggagauaucaagggcaucaugcacgcugggaaaagaagccuccgcccucaacccaccgagcugcgguauuccuggaagacguggggaaaagccaagauucugagcaccgaaucucauaaccagacauuccucaucgacggcccugagaccgcggaaugccccaauacaaacagagccuggaacucccuggagguggaggauuacggguuuggaguuuucaccacaaacauuuggcuucgccugcgggaaaagcaggacgcuuuuugugacagcaaacucaugucugccgcuaucaaggauaauagagccgugcacgcggacaugggcuauuggauugaguccgcccugaacgauaccuggaaaaucgaaaaggcuagcuucaucgaggucaaaucuugccacuggccuaagagccauacgcugugguccaacggcgugcuugagagcgaaaugauuauccccaagaauuucgccgggccggugucucagcacaacuaccggccuggauaucauacacaaaccgcuggccccuggcaccucgggaaacuggagauggacuuugauuucuguaagggaaccacagucguugugaccgaagacugcggcaaucgcgggcccucccugagaacgacaaccgccagcggaaaacucauuacagaguggugcugucgguccugcacccugccuccgcuuagauaccgcggcgaagauggcuguugguacgggauggagauccggccccugaaggagaaagaagagaaccucgugucuagccuggucacagccggacauggccagauugacaauuuuucccugggggugcuuggaauggcucucuuccuggaagagaugcugagaacccgcguuggcacgaagcacgcgauccuccugguggccgucucuuuugugacccuuauuacagggaacaugagcuucagagaucugggacggguuauggugauggucggcgcuaccaugacagacgauaucggcaugggggugaccuaucucgcccugcuggccgcuuuuaagguucgcccuacguucgccgcgggacuucugcucagaaaacugacauccaaggaacucaugaugaccacaaucggcauugugcugcuuucucagagcaccauccccgagaccauucuggagcucacagacgcucuggcccuggggaugaugguccuuaaaaucgugcggaagauggaacgcuaccaacuggccgugacgauuauggcuauccucugcgucccuaaugccguuauccugcagaacgcguggaaaguguccuguaccauucucgcuguggucagcgugucuccccugcuucugacauccagccagcagaaggccgauuggaucccucucgcccugaccauuaagggacugaaucccacagcuaucuuucuuaccacgcugucuagaacauccaaaaagcggagcuggccgcucaacgaggccauuauggcuguuggcauggugucuauccuggccuccagccuccugaaaaaugacaucccuaugaccgggccccuugucgcgggaggccugcugaccgugugcuauguucucacaggccgcuccgccgaccuggaacuugagaaggcugccgaugugagaugggaagaccaagcugagauuagcgggucuagcccuauccuguccauuaucauuucugaggauggaagcauguccaucaaaaacgaagaggaggaacagacccucacaauucugauccggacgggccuccuggucaucucugggcuuuuccccgugagcauuccgaucaccgccgccgcuugguaccugugggaggucaagaaacagcgcgcgggagugcugugggacguuccuucucccccucccgugggcaaggccgaacucgaggauggggcuuauagaauuaagcagaaaggaauccugggcuacagccaaauuggcgccggggucuauaaggaaggaacauuucacaccauguggcaugugacacggggcgccguucuuaugcacaaagggaagagaaucgagcccagcugggcugacgugaaaaaggaucugaucuccuacggaggcggguggaagcucgaaggagaguggaaagagggcgaagagguccaggugcuggcccucgaaccuggcaagaauccgcgcgcggugcagaccaaacccgggcuguucaagacgaacgcuggaaccauuggcgccguuagccuugacuuuucuccugggacauccggaagccccaucauugauaaaaagggcaaggucguggggcuguacggaaauggcguggucacccggaacggcucuuauguguccgccaucgcucagacagagaaaagcauugaagacaacccugagaucgaggaugacaucuucagaaagaaacgccugaccauuauggaucuccaucccggggccggaaagacaaaacgguaccugccugcgaucguuagagaagcuauuaagcgcggccuucggacgcugauccucgccccgaccagaguggucgccgcugagauggaagaggcccugcgcgggcuccccauucgguaucaaaccccugcuaucagagccgaacacaccggacgggagauuguggaccugaugugucaugcgaccuucacaaugcgccuucugucccccaucagaguuccuaauuacaaccugaucauuauggacgaggcccacuuuacggaucccgcuucuaucgccgcucggggcuauauuagcacccgcguggaaaugggggaggccgccggcaucuucaugacagcuaccccgccuggauccagagaccccuuuccccagagcaaugcgccuauuauggaugaggaacgggagauccccgaaagaucuuggaacuccggccacgagugggucacagacuucaaggggaaaaccgugugguuuguuccuagcaucaaggccggaaaugauauugcugccugccuccgcaaaaacggcaagaaagugauccagcugucucggaagacguucgacagcgaauacgucaagacaagaaccaaugauugggacuuuguggugaccacagauauuuccgagaugggggccaacuucaaagcugaacgcgucaucgacccgcggagauguaugaagcccguuauucuuaccgauggagaggagcgcgugauccuggccggcccuaugcccgugacacauucuagcgcggcucaacggagagggcgcaucggcagaaauccuaaaaacgaaaaugaccaguauauuuacaugggagagccccucgaaaacgacgaggauugcgcccacuggaaggaagccaaaaugcugcuggacaauaucaacaccccggagggcauuaucccuuccauguuugagcccgaacgggagaaggucgaugcuauugacggggaauaccgccucagaggagaggcccggaaaacguucguggaucuuaugcgcagaggcgaccugccuguuuggcuggcguauaagguggccgcugaagggaucaauuacgccgaucggagaugguguuuugacggcauucgcaacaaccagauccucgaggagaaugucgaaguggagaucuggacaaaggaaggcgagcggaaaaagcugaaacccagauggcuugaugcucgcauuuauucugacccucuggcccucaaggaguucaaagaguucgcugccgggagaaagagccugacccugaaccucaucacagagaugggccggcuucccaccuuuaugacgcagaaggcgcgggaugcccuggacaaucuggcuguucuccauaccgccgaagcuggaggccgcgccuacaaccacgcccuguccgagcuuccggaaacacuggagauuagccuccugcugacccuccuugcuacagugaccgggggaaucuuccuguuucugaugucuggcagagggauuggaaaaaugacacucggcaugugcugcaucaucaccgcguccauucugcuuugguaugcccaaauccagccucacuggauugcugccagcaucauucuggaguucuuucucaucguccugcugauccccgaacccgagaagcagcggacgccucaggauaaucaacucacauacguggucauugccauccuuaccgugguugcugccaccauggcgaacgaaaugggcuuccuggagaaaacaaagaaagaccuggggcucggauccauuaccacacagcagccggaaucuaauauccuggacauugaucuucgccccgccagcgcuuggacgcuguaugccguggcuaccacauuuaucaccccuaugcucagacauuccauugagaacucuagcgugaaugucucccugacagccaucgcgaaccaggccaccguucugaugggccucgggaagggauggccccuuagcaagauggacaucggcgugccucugcuggcuauuggguguuacucucaagugaaucccaucacgcucaccgccgcucugcuucugcucgucgcccacuacgcuauuaucggaccuggccugcaggccaaagcgacacgggaggcccagaagcgcgcugccgcuggcauuaugaaaaacccgaccguggaugggaucacaguuaucgaccuggaucccauuccuuaugaccccaaguucgaaaaacagcucggacaagugaugcuucugguccugugcgugacccagguccucaugaugagaacgacaugggcccugugugaggcccuuacccuggcgacaggcccuaucuccacccucugggaagggaaucccggacgguuuuggaacaccacaauugcugugagcauggccaauaucuuccgcggcucuuaccuggcuggggccggacugcucuuuuccauuaugaagaacacgaccaauacaagacggggcaccggcaacaucggggagacacuuggagaaaaguggaaaagcagacugaacgcccugggcaagucugaguuccagaucuauaaaaagagcgggauucaagagguugaucgcacccucgcuaaagaaggaaucaagcggggcgagacggaccaucacgccguguccagagggucugcgaaacugcgcugguuugucgaacggaauaugauuacaccggagggaaaggugguugaucuuggcugcggcagagggggauggagcuacuauuguggcgggcugaagaacgugcgcgaggucaaaggacucaccaagggcgggccuggacaugaggaacccauccccauguccaccuacggcuggaaucuggugcggcugcagagcggcguggacguuuucuucacaccucccgaaaaaugcgauacccuccuuugugacauuggggaguccucuccuaacccgacagucgaagccggaagaacgcugcgcgugcugaaucucguggagaacuggcugaauaacaauacccaguuuugcaucaagguccuuaaccccuauaugccuagcguuaucgagaaaauggaagcucugcagcggaaguacggcggggcccucgugagaaauccccugucccgcaacucuacacacgagauguacugggugagcaaugcuuccggaaacauugucucuagcgugaauaugaucucccggaugcugauuaacagauucaccaugaagcacaaaaaggccacauaugaaccugauguugaccucggcagcgggacccgcaacaucggaauugagucugaagugcccaaucuugacaucauuggcaaaagaaucgagaagaucaaacaagagcaugaaacguccuggcacuacgaucaggaccauccguauaagaccugggcguaccacggcagcuaugagacaaagcagaccgggucugccuccagcauggucaacggagugguucggcugcugacaaaaccuugggaugugauucccauggucacccagauggcuaugacagacaccacgccuuuuggccaacagcgcguguucaaggaaaaaguggauacaagaacccaggagcccaaggaagggaccaaaaagcucaugaagaucacagccgaguggcuguggaaagagcuuggaaagaaaaagacgccucggauguguaccagagaagaguuuacacggaaaguccgcucuaaugcugcccugggcgcuauuuucaccgacgaaaacaaguggaaauccgccagagaggcgguugaggauagccgguuuugggaacucguggacaaggagcgcaaucugcaccuggaagggaagugcgagacauguguguacaacaugaugggaaaaagagaaaagaaacucggcgaguucggcaaggccaaagggucccgggcuaucugguauauguggcugggagcccgcuuucuugaguucgaagcucugggcuuucucaaugaggaucauugguucagcagagaaaacucucugagcggggucgagggagaaggccuucacaagcugggguacauucuccgggacguguccaagaaagagggcggagccauguacgccgaugacaccgcgggcugggacacacgcaucacccuggaggaucugaagaaugaagagaugguuacgaaccauauggaaggggagcacaaaaagcucgcugaagccaucuuuaaacugaccuaucagaauaagguggucagagugcaacggcccacaccgcgcggaaccguuauggacauuaucucuagacgggaucagcgcggcagcggacaggugggaacauacggccuuaacaccuucacgaauauggaggcccaacugauuagacagauggagggggaaggcgucuucaaguccauccagcaucucacagcuaccgaggaaauugccgugcagaacuggcuggcucggguuggaagagagcgccuuucucggauggccaucagcggcgacgauugcguggucaaaccucuggacgauagauuugcguccgcccucacagcucugaaugacauggggaaggugcgcaaagauauccaacagugggagcccucuaagggauggaacgacuggacccagguccccuucugcagccaccacuuucaugaacugauuaugaaagauggccgggugcucguugugccuuguagaaaccaggacgagcugaucgggcgcgcccggauuucccaaggagcuggcuggagccuuagagaaacggccugccuggggaagucuuaugcgcagauguggucccucauguacuuccaccgccgggaucugagacuugccgcuaaugccaucuguagcgcugucccgucucauugggugcccaccucccgcacaaccuggagcauucacgccaagcacgaguggaugacaaccgaagacaugcugacaguguggaaccggguuuggauccaggagaauccuuggauggaggacaaaacccccguggaauccugggaggaaauuccuuaucucggcaagagagaggaucaguggugcggaucucugaucggccugacgagccgggcuacaugggccaaaaacauccaaaccgcgauuaaucaggucagaucccucaucgggaacgaagaguacaccgacuauaugcccagcaugaagcgcuuucggagagaggaagaggaagccggagugcugugguga

SEQ ID NO: 19555 - RNA, 9876 nt, Artificial Sequence
  derived and/or modified CDS sequence (opt5) from DENV-2__KF744404__SS-prME
acagccggaaugaucauuaugcugauccccacagugauggcuuuccaccucacgaccagaaauggggagccucauaugauugucucccggcaggaaaaggggaaaucccugcuuuuuaagacagaggacggcguuaauaugugcacccugauggccauggaucucggggaacugugugaggacacaaucaccuacaaaugcccgcuucugcgccaaaacgaacccgaggauauugacuguuggugcaauucuacaagcaccugggugacguauggaaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacaaacuuucagagagcucuuauuuucauccugcucacggccguugcgccuuccaugaccaugcggugcauuggaaucucuaaucgcgauuuuguggaaggcgucagcgggggauccuggguggacauuguucuggagcacggcagcugugugacaaccauggccaagaacaagcccacacuugauuucgaacugaucaaaaccgaggcuaagcagccugccacgcucagaaaauauugcaucgaagcuaagcugacaaauaccaccacagagucucgguguccgacccaaggggagcccucccugaacgaagaacaggacaaacgcuuugucugcaagcacagcaugguggauagaggauggggcaauggcuguggacucuucggaaagggcgggauugugacaugcgccauguuuacgugcaaaaagaacauggaaggaaaaaucguccagccugagaaucuggaauacaccauuguuaucacaccccauucuggcgaggagcacgcgguggggaacgacaccggaaagcauggcaaagaaauuaagaucacaccucaguccagcaucaccgaggccgaacuuacgggcuaugggaccgugacaauggaguguucuccccggaccggacuggauuucaaugaaaugguccuccugcaaauggagaacaaggcuuggcuugugcaccgccagugguuucuggaccucccgcugccuuggcugcccggcgccgauacacagggguccaauuggauucagaaggagacccucguuacguucaagaacccucacgcuaaaaagcaagacguggucgugcugggaagccaggaaggcgccaugcauacagcccuuaccggggcuacagagauccagauguccucuggcaaccugcucuuuaccggacaccugaaaugcagacuucggauggacaagcugcaacucaaaggcaugagcuacuccauguguaccgggaaguucaagguugugaaagaaauugcggagacacagcauggaacgaucgucgugagaguccaguaugagggcgaugggagccccugcaagauucccuucgaaaucauggaccuggagaaacgccacgugcugggacggcucaucaccguuaauccuauugugacagaaaaggauucuccggucaacaucgaggccgaacccccuuuuggcgacuccuacgugauuaucgggguugagcccggccagcugaaacuuaauugguucaagaagggaagcucuauuggccaaauguuugagaccacaaugagaggggcuaaacgcauggccauccugggagauaccgccugggacuucggcagccucgggggaguguuuacguccauuggcaaggcucugcaucaggucuucggggccaucuacggcgcggcuuuuucuggagugagcuggacaaugaaaauccugauuggcgugaucauuaccuggaucgggaugaacucccggagcaccucucuuuccguuagccucguccuggugggaguggucacacuguaucucggcgugguugugcaggccgauucugggugugucguguccuggagaaauaaggaacugaaaugcggaagcggcauuuucaucaccgacaacguucacacauggacggagcaguacaaguuucaaccugaaucccccucuaaacuugccagcgcuauccagaaagcccaccaggaggggauuuguggcauccgcuccgugacccggcuggaaaaucucauguggaagcagauuacaccggagcugaaccauauccugucugagaaugaagucaaacuuaccauuaugacaggagauaucaagggcaucaugcacgcugggaaaagaagccuccgcccucaacccaccgagcugcgguauuccuggaagacguggggaaaagccaagauucugagcaccgaaucucauaaccagacauuccucaucgacggcccugagaccgcggaaugccccaauacaaacagagccuggaacucccuggagguggaggauuacggguuuggaguuuucaccacaaacauuuggcuucgccugcgggaaaagcaggacgcuuuuugugacagcaaacucaugucugccgcuaucaaggauaauagagccgugcacgcggacaugggcuauuggauugaguccgcccugaacgauaccuggaaaaucgaaaaggcuagcuucaucgaggucaaaucuugccacuggccuaagagccauacgcugugguccaacggcgugcuugagagcgaaaugauuauccccaagaauuucgccgggccggugucucagcacaacuaccggccuggauaucauacacaaaccgcuggccccuggcaccucgggaaacuggagauggacuuugauuucuguaagggaaccacagucguugugaccgaagacugcggcaaucgcgggcccucccugagaacgacaaccgccagcggaaaacucauuacagaguggugcugucgguccugcacccugccuccgcuuagauaccgcggcgaagauggcuguugguacgggauggagauccggccccugaaggagaaagaagagaaccucgugucuagccuggucacagccggacauggccagauugacaauuuuucccugggggugcuuggaauggcucucuuccuggaagagaugcugagaacccgcguuggcacgaagcacgcgauccuccugguggccgucucuuuugugacccuuauuacagggaacaugagcuucagagaucugggacggguuauggugauggucggcgcuaccaugacagacgauaucggcaugggggugaccuaucucgcccugcuggccgcuuuuaagguucgcccuacguucgccgcgggacuucugcucagaaaacugacauccaaggaacucaugaugaccacaaucggcauugugcugcuuucucagagcaccauccccgagaccauucuggagcucacagacgcucuggcccuggggaugaugguccuuaaaaucgugcggaagauggaacgcuaccaacuggccgugacgauuauggcuauccucugcgucccuaaugccguuauccugcagaacgcguggaaaguguccuguaccauucucgcuguggucagcgugucuccccugcuucugacauccagccagcagaaggccgauuggaucccucucgcccugaccauuaagggacugaaucccacagcuaucuuucuuaccacgcugucuagaacauccaaaaagcggagcuggccgcucaacgaggccauuauggcuguuggcauggugucuauccuggccuccagccuccugaaaaaugacaucccuaugaccgggccccuugucgcgggaggccugcugaccgugugcuauguucucacaggccgcuccgccgaccuggaacuugagaaggcugccgaugugagaugggaagaccaagcugagauuagcgggucuagcccuauccuguccauuaucauuucugaggauggaagcauguccaucaaaaacgaagaggaagaacagacccucacaauucugauccggacgggccuccuggucaucucugggcuuuuccccgugagcauuccgaucaccgccgccgcuugguaccugugggaggucaagaaacagcgcgcgggagugcugugggacguuccuucucccccucccgugggcaaggccgaacucgaggauggggcuuauagaauuaagcagaaaggaauccugggcuacagccaaauuggcgccggggucuauaaggaaggaacauuucacaccauguggcaugugacacggggcgccguucuuaugcacaaagggaagagaaucgagcccagcugggcugacgugaaaaaggaucugaucuccuacggaggcggguggaagcucgaaggagaguggaaagagggcgaagagguccaggugcuggcccucgaaccuggcaagaauccgcgcgcggugcagaccaaacccgggcuguucaagacgaacgcuggaaccauuggcgccguuagccuugacuuuucuccugggacauccggaagccccaucauugauaaaaagggcaaggucguggggcuguacggaaauggcguggucacccggaacggcucuuauguguccgccaucgcucagacagagaaaagcauugaagacaacccugagaucgaggaugacaucuucagaaagaaacgccugaccauuauggaucuccaucccggggccggaaagacaaaacgguaccugccugcgaucguuagagaagcuauuaagcgcggccuucggacgcugauccucgccccgaccagaguggucgccgcugagauggaagaggcccugcgcgggcuccccauucgguaucaaaccccugcuaucagagccgaacacaccggacgggagauuguggaccugaugugucaugcgaccuucacaaugcgccuucugucccccaucagaguuccuaauuacaaccugaucauuauggacgaggcccacuuuacggaucccgcuucuaucgccgcucggggcuauauuagcacccgcguggaaaugggggaggccgccggcaucuucaugacagcuaccccgccuggauccagagaccccuuuccccagagcaaugcgccuauuauggaugaagaacgggagauccccgaaagaucuuggaacuccggccacgagugggucacagacuucaaggggaaaaccgugugguuuguuccuagcaucaaggccggaaaugauauugcugccugccuccgcaaaaacggcaagaaagugauccagcugucucggaagacguucgacagcgaauacgucaagacaagaaccaaugauugggacuuuguggugaccacagauauuuccgagaugggggccaacuucaaagcugaacgcgucaucgacccgcggagauguaugaagcccguuauucuuaccgauggagaggagcgcgugauccuggccggcccuaugcccgugacacauucuagcgcggcucaacggagagggcgcaucggcagaaauccuaaaaacgaaaaugaccaguauauuuacaugggagagccccucgaaaacgacgaggauugcgcccacuggaaggaagccaaaaugcugcuggacaauaucaacaccccggagggcauuaucccuuccauguuugagcccgaacgggagaaggucgaugcuauugacggggaauaccgccucagaggagaggcccggaaaacguucguggaucuuaugcgcagaggcgaccugccuguuuggcuggcguauaagguggccgcugaagggaucaauuacgccgaucggagaugguguuuugacggcauucgcaacaaccagauccucgaggagaaugucgaaguggagaucuggacaaaggaaggcgagcggaaaaagcugaaacccagauggcuugaugcucgcauuuauucugacccucuggcccucaaggaguucaaagaguucgcugccgggcggaaaagccugacccugaaccucaucacagagaugggcagacuucccaccuuuaugacgcagaaggcgcgggaugcccuggacaaucuggcuguucuccauaccgccgaagcuggaggccgcgccuacaaccacgcccuguccgagcuuccggaaacacugcaaauuagccuccugcugacccuccuugcuacagugaccgggggaaucuuccuguuucugaugucuggcagagggauuggaaaaaugacacucggcaugugcugcaucaucaccgcguccauucugcuuugguaugcccagauccagccucacuggauugcugccagcaucauucuggaguucuuucucaucguccugcugauccccgagcccgaaaagcagcggacgccucaagauaaucagcucacauacguggucauugccauccuuaccgugguugcugccaccauggcgaacgagaugggcuuccuggaaaagacaaagaaagaccuggggcucggauccauuaccacacagcagccggagucuaauauccuggacauugaucuucgccccgccagcgcuuggacgcuguaugccguggcuaccacauuuaucaccccuaugcucagacauuccauugaaaacucuagcgugaaugucucccugacagccaucgcgaaccaagccaccguucugaugggccucgggaagggauggccccuuagcaagauggacaucggcgugccucugcuggcuauuggguguuacucucaggugaaucccaucacgcucaccgccgcucugcuucugcucgucgcccacuacgcuauuaucggaccuggccugcaggccaaagcgacacgggaggcccagaagcgcgcugccgcuggcauuaugaaaaacccgaccguggaugggaucacaguuaucgaccuggaucccauuccuuaugaccccaaguucgagaaacaacucggacaggugaugcuucugguccugugcgugacccagguccucaugaugagaacgacaugggcccugugugaagcccuuacccuggcgacaggcccuaucuccacccucugggaggggaaucccggacgguuuuggaacaccacaauugcugugagcauggccaauaucuuccgcggcucuuaccuggcuggggccggacugcucuuuuccauuaugaagaacacgaccaauacaagacggggcaccggcaacaucggggaaacacuuggagagaaguggaaaagcagacugaacgcccugggcaagucugaguuccaaaucuauaaaaagagcgggauucaggagguugaucgcacccucgcuaaagagggaaucaagcggggcgaaacggaccaucacgccguguccagagggucugcgaaacugcgcugguuugucgagcggaauaugauuacaccggaaggaaaggugguugaucuuggcugcggcagagggggauggagcuacuauuguggcgggcugaagaacgugcgcgaggucaaaggacucaccaagggcgggccuggacaugaggaacccauccccauguccaccuacggcuggaaucuggugcggcugcagagcggcguggacguuuucuucacaccucccgagaaaugcgauacccuccuuugugacauuggggaauccucuccuaacccgacagucgaggccggaagaacgcugcgcgugcugaaucucguggaaaacuggcugaauaacaauacccaguuuugcaucaagguccuuaaccccuauaugccuagcguuaucgagaaaauggaggcucugcaacggaaguacggcggggcccucgugagaaauccccugucccgcaacucuacacacgaaauguacugggugagcaaugcuuccggaaacauugucucuagcgugaauaugaucucccggaugcugauuaacagauucaccaugaagcacaaaaaggccacauaugagccugauguugaccucggcagcgggacccgcaacaucggaauugaaucugaggugcccaaucuugacaucauuggcaaaagaaucgaaaagaucaaacaggagcaugagacguccuggcacuacgaucaggaccauccguauaagaccugggcguaccacggcagcuaugaaacaaagcagaccgggucugccuccagcauggucaacggagugguucggcugcugacaaaaccuugggaugugauucccauggucacccaaauggcuaugacagacaccacgccuuuuggccagcagcgcguguucaaggagaaaguggauacaagaacccaggaacccaaggaggggaccaaaaagcucaugaagaucacagccgaauggcuguggaaagagcuuggaaagaaaaagacgccucggauguguaccagagaggaauuuacacggaaaguccgcucuaaugcugcccugggcgcuauuuucaccgacgagaacaaguggaaauccgccagagaagcgguugaggauagccgguuuugggagcucguggacaaggaacgcaaucugcaccuggaggggaagugcgaaacauguguguacaacaugaugggaaaaagagagaagaaacucggcgaguucggcaaggccaaagggucccgggcuaucugguauauguggcugggagcccgcuuucuugaguucgaggcucugggcuuucucaaugaagaucauugguucagcagagagaacucucugagcggggucgaaggagagggccuucacaagcugggguacauucuccgggacguguccaagaaagaaggcggagccauguacgccgaugacaccgcgggcugggacacacgcaucacccuggaggaucugaagaaugaggaaaugguuacgaaccauauggagggggaacacaaaaagcucgcugaggccaucuuuaaacugaccuaucaaaauaagguggucagagugcagcggcccacaccgcgcggaaccguuauggacauuaucucuagacgggaucagcgcggcagcgggcaagugggaacauacggccuuaacaccuucacgaauauggaagcccagcugauuagacagauggagggggagggcgucuucaaguccauccagcaucucacagcuaccgaagagauugccgugcaaaacuggcuggcucggguuggaagagaacgccuuucucggauggccaucagcggcgacgauugcguggucaaaccucuggacgauagauuugcguccgcccucacagcucugaaugacauggggaaggugcgcaaagauauccagcagugggagcccucuaagggauggaacgacuggacccagguccccuucugcagccaccacuuucaugagcugauuaugaaagauggccgggugcucguugugccuuguagaaaccaagacgaacugaucgggcgcgcccggauuucccagggagcuggcuggagccuuagagagacggccugccuggggaagucuuaugcgcagauguggucccucauguacuuccaccgccgggaucugagacuugccgcuaaugccaucuguagcgcugucccgucucauugggugcccaccucccgcacaaccuggagcauucacgccaagcacgaauggaugacaaccgaggacaugcugacaguguggaaccggguuuggauccaggaaaauccuuggauggaggacaaaacccccguggaguccugggaagagauuccuuaucucggcaagagagaagaucaauggugcggaucucugaucggccugacgagccgggcuacaugggccaaaaacauccagaccgcgauuaaucaggucagaucccucaucgggaacgaggaauacaccgacuauaugcccagcaugaagcgcuuucggagagaggaggaagaggccggagugcugugguga

SEQ ID NO: 19556 - RNA, 9876 nt, Artificial Sequence
  derived and/or modified CDS sequence (opt5) from DENV-2__KF744407__SS-prME
acagccggaaugaucauuaugcugauccccacagugauggcuuuccaccucacgaccagaaauggggaaccucauaugauugucagccggcaggaaaaggggaaaucccugcuuuuuaagacagaggacggaguuaauaugugcacccugauggccauggaucucggggaacugugugaggacacaaucaccuacaaaugcccgcuucugagacaaaaugaacccgaggauauugacuguuggugcaauucuacaagcaccugggugacguaugggaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacaaacuuucagagagcucuuauuuucauccugcucacggccguugcgccuuccaugaccaugcggugcauuggaaucucuaaucgcgauuuuguggaaggcgucagcgggggauccuggguggacauuguucuggagcacggcagcugugugacaaccauggccaagaacaagcccacacuugauuucgaacugaucaaaaccgaggcuaagcacccugccacgcucagaaaauauugcaucgaagcuaagcugacaaauaccaccacagccucucgguguccgacccagggggagcccucccugaacgaggaacaagacaaacgcuuugucugcaagcauagcaugguggauagaggauggggcaauggcuguggacuguucggaaagggcgggauugugacaugcgcgauguuuacgugcaaaaagaacauggagggaaaagucguucagccugaaaaucuggaguacaccaucgugauuacaccccacucuggcgaagaacaugccguggggaacgacaccggaaagcacggcaaagagaucaagauuacaccucaguccagcaucaccgaagcugagcuuacgggcuaugggaccgucacaauggaauguucuccccggaccggacuggauuucaaugagauggugcuccugcagauggaaaacaaagccuggcuuguucaccgccaaugguuucuggaccucccgcugccuuggcugcccggcgcugauacacagggguccaauuggauccagaaggagacccucgugacguucaagaacccucaugccaaaaagcaggacgucgugguucugggaagccaagagggcgccaugcacacagcucuuaccggggcgacagaaauucagauguccucuggcaaccugcucuuuaccggacaucugaaaugcagacuucggauggacaagcugcagcucaaaggcaugagcuacuccauguguaccgggaaguucaagguggucaaagagaucgccgaaacacaacacggaacgauuguggucagagugcaguaugagggcgaugggagccccugcaagauccccuucgagauuauggaccuggaaaaacgccauguucugggacggcucaucaccgugaauccuaucgucacagagaaggauucuccggugaacauugaagcugagcccccuuuuggcgacuccuacguuaucauugggguggaacccggccagcugaaacuuaauugguucaagaagggaagcucuaucggccagauguuugagaccacaaugagaggggccaaacgcauggccauucugggagauaccgcuugggacuucggcagccucgggggagucuuuacguccaucggcaaggcccugcaccaaguguucggggcgauuuacggcgcugccuuuucuggagugagcuggacaaugaaaauccugaucggcguuauuaucaccuggauugggaugaacucccggagcaccucucuuuccgucagccucgugcuggugggagucgugacacuguaucucggcguuauggugcaggccgauucugggugugucgcuuccuggaagaauaaagagcugaagugcggaagcggcaucuucauuaccgacaacgugcacacauggacggaacaguacaaguuucagccugagucccccucuaaacuugccagcgcuauccaaaaggcccaucaggaagggaucuguggcauuagauccguuacccgccuggagaaucucauguggaaacagaucacaccggaacugaaccacauucugucugagaaugaggugaaacuuaccaucaugacaggagauauuaaaggcaucaugcaugcggggaagcggagccucagaccucagcccaccgaacugcgcuauuccuggaaaacguggggaaaggccaagauccugagcaccgagucucacaaccaaacauuccucauugacggcccugaaaccgcugagugccccaauacaaaccgggccuggaacucccuggaagucgaggauuacggguuuggaguguucaccacaaacaucuggcuuagacugcgcgagaaacaggacgcuuuuugugacagcaagcucaugucugccgcgauuaaagauaaucgggccguucacgcugacaugggcuauuggaucgaauccgcccugaacgauaccuggaagauugagaaagcuagcuucaucgaagugaagucuugccauuggccuaagagccacacgcugugguccaacggcguccuugagagcgagaugaucauucccaaaaauuucgccgggccggugucucagcauaacuacagaccuggauaucacacacagaccgccggccccuggcaucucgggaagcuggaaauggacuuugauuucugugagggaaccacaguggucguuaccgaagacugcggcaaucgggggcccucccugcgcacgacaaccgcuagcggaaaacucaucacagaguggugcuguagauccugcacccugccuccgcuucgguacagaggcgaagauggcuguugguacgggauggagauucgcccccugaaggagaaagaagagaaccucgugucuagccuggugacagcgggacacggccaaaucgacaauuuuucccuggggguccuuggaauggcccucuuccuggaagagaugcugcggaccagagugggcacgaagcacgcuauucuccugguugccgugucuuuugucacccuuaucacagggaacaugagcuuccgcgaucugggaagagugaugguuauggugggcgccaccaugacagacgauauuggcaugggggucaccuaucucgcucugcuggccgcguuuaaggugcggccuacguucgcugccggacuucugcuccgcaaacugacauccaaggaacucaugaugaccacaaucggcaucguucugcuuucucagagcaccauucccgagaccauccuggagcucacagacgcccuggcucuggggaugauggugcuuaaaauugucagaaauauggaaaaguaccagcuggccgugacgaucauggcgauucucugcgugccuaacgcugucauccugcaaaaugccuggaaaguuuccuguaccauccucgccguggugagcgucucuccccugcuucugacauccagccagcagaaggcugauuggauuccucucgcccugaccaucaagggacugaaccccacagcuauuuuucuuaccacgcugucucggacauccaaaaagcgcagcuggccgcucaaugaggccaucauggcggugggcaugguuucuauucuggccuccagccuccugaaaaacgacaucccuaugaccgggccccuuguggcuggaggccugcugaccgucugcuaugugcucacaggcagauccgccgaccuggaacuugagaaggcugccgauguucggugggaagaacaggccgagaucagcgggucuagcccuauucuguccaucauuaucucugaagacggaagcauguccauuaaaaaugaggaagaggagcaaacccucacaauccugauucgcacgggccuccuggugaucucugggcuuuuccccgucagcaucccgauuaccgcugcggccugguaccugugggaagugaagaaacagagagcuggaguccugugggaugugccuucucccccucccguuggcaaggccgagcucgaagacggggccuaucggaucaagcagaaaggcauucugggcuacagccagaucggcgcugggguguauaaggagggaacauuucauaccauguggcacgucacacgcggcgccgugcuuaugcauaaagggaagagaauugaacccagcugggcggauguuaaaaaggaccugaucuccuacggaggcggguggaagcucgagggagaguggaaagaaggcgaggaagugcaaguccuggcucucgagccuggcaagaacccgcgggccgugcagaccaaacccgggcuguucaagacgaaugccggaaccaucggcgcugugagccuugauuuuucuccugggacauccggaagccccauuaucgacaaaaagggcaagguugucgggcuguacggaaacggcguggugaccagaaacggcucuuaugucuccgccauugcgcagacagaaaagagcaucgaggauaauccugagauugaggacgauaucuuccgcaagaaacggcugaccaucauggaccuccaccccggggcuggaaagacaaaaagauaccugccugccauugugcgcgaggccaucaagcggggccuuagaacgcugauucucgcuccgacccgcguuguggccgcugaaauggaggaagcccugcgggggcuccccaucagauaucagaccccugcgauucgcgccgagcauaccggacgggagaucgucgaucugaugugucacgcuaccuucacaaugagacuucugucccccauucgggugccuaacuacaaucugaucaucauggacgaagcccacuuuacggaccccgcuucuauugccgcccgcggcuauaucagcaccagaguugagaugggggaagcugcgggcauuuucaugacagccaccccgccuggaucccgggaucccuuuccccaaagcaacgcuccuaucauggacgaggagcgcgaaauucccgagagaucuuggaacuccggccaugaaugggugacagauuucaaggggaaaaccgucugguuugugccuagcaucaaggccggaaacgacaucgccgcuugccuccggaaaaauggcaagaaaguuauucagcugucuagaaagacguucgauagcgaguacgugaagacacgcaccaacgacugggauuuugucgugaccacagacaucuccgaaaugggggccaauuucaaagcggagcgggugauugauccgagacgcuguaugaagcccgucauccuuaccgacggagaggaacggguuauucuggcuggcccuaugcccgugacacacucuagcgccgcccagagacgcgggcggaucggcagaaacccuaaaaaugagaacgaucaauauaucuacaugggagaaccccucgagaaugacgaagacugcgcucauuggaaggaggccaaaaugcugcuggauaacauuaauaccccggagggcaucauuccuuccauguuugaacccgagcgcgaaaagguggacgcgaucgauggggaguacagacuccggggagaagcccgcaaaacguucgucgaccuuaugagacggggcgaucugccuguguggcuggcuuauaagguugccgcugaggggauuaacuacgccgaccgcagaugguguuuugauggaauccggaacaaucagauucucgaggaaaacguggaggucgaaaucuggacaaaggagggcgagcgcaaaaagcugaaaccccgcuggcuugacgcucggaucuauucugauccucuggcccucaaggaguucaaagaguucgcggccgggagaaagagccugacccugaaucucauuacagaaaugggccgccuucccaccuuuaugacgcagaaggcucgggacgcccuggauaaccuggcugugcuccacaccgccgaggccggaggcagagcuuacaaucacgcgcuguccgaacuuccggagacacuggagacccuccugcugcucacacuucuggccaccguuacagggggaaucuuccuguuucucaugagcggcaaagggauuggaaagaugacccugggcaugugcugcaucauuacggcuucugugcuucugugguaugcccagauccaaccucauuggaucgccgcuuccauuauccucgaguucuuucugauuguccugcucauccccgagcccgaaaaacagcggacaccucaggacaaccagcuuaccuacguggucauugccauccugaccgugguugcggccacaauggcuaaugagaugggcuuccuggaaaagaccaaaaaggauuuugggcucggaagcaucgccacacaacagccggaguccaacauucuggacaucgaccuucgccccgcuucugccuggacgcuguaugcgguggccaccacauucauuaccccuaugcucagacacagcaucgaaaauuccucugugaacgucagccugacagcuauugccaaucaggcuaccguucugaugggccucgggaagggauggccccuuuccaaaauggauaucggcgugccucugcuggccauuggguguuacagccaggugaaccccaucacgcucaccgcugcccugcuucugcucgucgcgcauuacgccaucauuggaccuggccugcaagcuaaggccacacgggaagcucagaaacgcgccgccgcgggcaucaugaagaauccgaccguggacgggauuacaguuaucgaucuggaccccauuccuuaugaucccaaauuugagaagcagcucggacaggugaugcuucugguccugugcgugacccaaguccucaugaugagaacgacaugggcucugugugaagcccuuacccuggcuacaggcccuaucucuacccucugggaggggaaccccggacgguucuggaauaccacaaucgccguguccauggccaacauuuuucgcggcagcuaccuggcuggggccggacuccucuucucuaucaugaagaauacgaccaacacaagacggggcaccggcaacauuggggaaacacuuggagagaaauggaagucccgccugaaugcgcugggcaaaagcgaguuucagaucuauaagaaaucugggauucaggaaguugacagaacccucgccaaggagggaaucaaacggggcgaaacggaucaccaugcugugagcagaggguccgccaagcugcgcugguucgucgagcggaacaugaucacaccggagggaaaggugguugaccuuggcugcggcagagggggauggucuuacuauuguggcgggcugaaaaaugugcgcgaagucaagggacucaccaaaggcgggccuggacacgaggaacccauucccaugagcaccuacggcuggaaccuggugcggcugcaauccggcguggauguuuucuuuacaccucccgagaagugcgacacccuccuuugugauaucggggaaagcuccccuaauccgacagucgaggcuggaagaacgcugcgcgugcugaaccucguggagaauuggcugaacaauaacacccaguucugcauuaaaguccuuaaucccuauaugccuucuguuaucgaaaagauggaggcccugcagcggaaguacggcggggcgcucgugagaaacccccugagccgcaauuccacacacgaaauguacugggugucuaacgccagcggaaauauugucuccucugugaacaugaucagccggaugcugaucaacagauuuaccaugaaacauaagaaagcuacauaugagccugacguugaucucggcuccgggacccgcaauauuggaaucgaaagcgaggugcccaaccuugacauuaucggcaagcggauugagaaaaucaagcaggaacacgagacgucuuggcauuacgaccaagaucacccguauaagaccugggccuaccacggcuccuaugaaacaaaacagaccgggagcgcuucuuccauggucaauggagugguuagacugcugacaaagccuugggacgugauucccauggucacccagauggccaugacagauaccacgccuuucggccagcaacgcguguuuaaagagaagguggacacaagaacccaggaacccaaagaggggaccaagaagcucaugaaaaucacagcugaguggcuguggaaggaacuuggcaaaaagaaaacgccucggauguguacccgcgaggaguucacaagaaagguccggagcaacgccgcgcugggcgccaucuuuaccgaugagaauaaauggaagucugcuagagaggccguugaagacucccgguucugggagcucguggauaaggaacgcaaccugcaucuggaggggaaaugcgaaacauguguguacaauaugaugggaaagagagagaaaaagcucggcgaguuuggcaaagcuaaggggagccgggccauuugguauauguggcugggagcccgcuuccuugaauuugaggcgcugggcuuccucaacgaagaccacugguuuuccagagagaauagccugucuggggucgaaggagagggccuucauaagcugggguacauccuccgggaugugagcaaaaaggagggcggagcuauguacgccgacgauaccgccggcugggacacacgcauuacccuggaagaccugaaaaacgaggaaaugguuacgaaucacauggagggggaacauaagaaacucgcugaggccaucuucaagcugaccuaucagaacaagguggucagagugcagcggcccacaccgcgcggaaccguuauggauauuaucuccagacgggaccaacgcggcucuggacaggugggaacauacggccuuaauaccuucacgaacauggaggcucagcugaucagacaaauggaaggggagggcgucuuuaaaagcauucagcaccucacagccaccgaagagaucgcggugcagaauuggcugacacggguuggacgcgagagacuuucccggauggccauuucuggcgaugacugcguggucaagccucuggaugacagauucgcuagcgcccucaccgcucugaacgauauggggaaagugcgcaaggacauccagcaaugggaacccuccaaaggauggaacgauuggacgcagguccccuuuugcucucaccauuuccacgagcugauuaugaaggacggccgggugcucguugugccuuguagaaaucaggaugaacugaucgggcgcgcccggaucagccagggagcgggcuggucccuuagagagaccgccugccuggggaaguccuaugcucaaauguggucucucauguacuuucaucgccgggaccugagacuugccgcuaacgccauuuguuccgcugucccgagccacugggugcccacaucucgcaccacaugguccauccacgccaaacaugaauggaugaccacagaggauaugcugaccguguggaaucggguuuggauucaggagaacccuuggauggaagacaagacgcccguggagagcugggaagagaucccuuaucucggcaaaagagaagaccaguggugcggaucccugauuggccugacaucucgcgcgaccugggccaagaauauccagaccgcuauuaaccaaguccggagccucaucgggaaugaggaguacacagauuauaugcccuccaugaaaagauuccggagagaagaggaagaggccggagugcugugguga

SEQ ID NO: 19557 - RNA, 9876 nt, Artificial Sequence
  derived and/or modified CDS sequence (opt5) from DENV-2__KF744399__SS-prME
acagccggaaugaucauuaugcugauccccacagugauggcuuuccaccucacgacccggaauggggaaccucauaugauugucagccggcaggaaaagggaaaaucccugcuuuuuaagacagaggacggcguuaauaugugcacccugauggccauggaucucggggaacugugugaggacacaaucaccuacaaaugcccgcuucugagacaaaacgaacccgaggauauugacuguuggugcaauucuacaagcaccugggugacguauggaaccuguacaaccacaggcgagcacagacgggaaaagcgcuccguggcgcucgucccucauguggggaugggacuggagaccagaacggaaacauggaugucuagcgagggcgcuuggaaacacgcccagcggaucgagaccuggauccugcgccaucccggcuucacacucauggccgcuauucuggccuacaccaucgggaccacaaacuuucagagagcucuuauuuucauccugcucacggccguugcgccuuccaugaccaugcggugcauuggaaucucuaaucgcgauuuuguggaaggcgucagcgggggauccuggguggacauuguucuggagcacggcagcugugugacaaccauggccaagaacaagcccacacuugauuucgaacugaucaaaaccgaggcuaagcacccugccacgcucagaaaauauugcaucgaagcuaagcugacaaauaccaccacagagucucgguguccgacccagggggagcccucccugaacgaagaacaagacaaacgcuuugucugcaagcauagcaugguggauagaggauggggcaauggcuguggacucuucggaaagggcgggauugugacaugcgccauguuuacgugcaaaaagaacauggaaggaaaaaucguccagccugagaaucuggaauacaccauuguuaucacaccccacucuggcgaggagaacgcgguggggaaugacaccggaaagcauggcaaagaaauuaaggugacaccucaguccagcaucaccgaggccgaacuuacgggcuaugggaccgucacaauggaguguucuccccggaccggacugggcuucaacgaaauggugcuccugcagauggagaauaaggcuuggcuuguucaccgccaaugguuucuggaucucccgcugccuuggcugcccggggccgacacacagggauccaacuggauccagaaggagacccucgugacguucaagaacccucacgcuaaaaagcaggaugucgugguucugggcagccaagaaggggccaugcauacagcccuuaccggcgcuacagagauucagauguccucuggaaaucugcucuuuaccggccaccugaaaugcagacuucggauggacaagcugcagcucaaagggaugagcuacuccauguguaccggaaaguucaagguggucaaagaaaucgcggagacacaacauggcacgauuguggucagagugcaguaugagggggacggaagccccugcaagauccccuucgaaauuauggaucuggagaaacgccacguucugggccggcucaucaccgugaacccuaucgucacagaaaaggacucuccggugaauauugaggccgaacccccuuuuggggauuccuacguuaucauuggcguggagcccggacagcugaaacuuagcugguucaagaagggcucuagcaucgggcagauguuugagaccacaaugagaggagcuaaacgcauggccauucugggcgacaccgccugggauuucgggucccucggaggcgucuuuacgucuaucgggaaggcucugcaucaaguguucggcgccauuuacggagcggcuuuuagcggcguguccuggacaaugaaaauccugaucgggguugucauuaccuggaucggaaugaacagccggucuaccucccuuagcgugucucucgugcuggucggcgugguuacacuguaucucggggugaugguccaggccgacuccggaugugugguuagcuggaagaauaaagaacugaagugcggcuccgggauuuucaucaccgauaacgugcacacauggacggagcaguacaaguuucagccugaaucucccagcaaacuugccuccgcuauucaaaaggcccaccaggagggcaucuguggaaucagaucugucacccgccuggaaaaucucauguggaaacagauuacaccggagcugaaccauauccugagcgagaaugaagugaaacuuaccauuaugacaggcgacaucaaagggauuaugcacgcuggaaagcggucccucagaccucagcccaccgagcugcgcuauagcuggaaagccuggggcaaggcgaagauccugucuacggaacuccauaaccaaaccuuccugaucgaugggccugagacagccgaaugccccaauaccaaccgggcuuggaauagccuugagguugaggacuacggauuuggcguguucacaaccaacauuuggcugaaacucagagaaaagcaggaugccuuuugugacagcaaacugaugucugcugccaucaaggacaaucgcgcgguccacgccgauaugggcuauuggauugaguccgcucugaacgacacauggaaaaucgaaaaggccagcuucauugaggugaagucuugccacuggccuaaaagccauacccuuugguccaacggggugcucgagagcgaaaugaucauccccaagaauuucgcuggaccggucucucagcacaacuaccggccuggcuaucauacgcagacagccgggcccuggcaccugggaaaacuggagauggauuuugacuucuguaagggcaccaccguuguggugacagaagauugcgggaauagaggacccucccuccggaccacgacagccagcggcaaacugauuaccgaguggugcugucgcuccugcacacuuccuccgcugagauaccggggcgaagacggguguugguacggaauggagaucagaccccucaaggagaaggaagagaaccuggucaauucucuggugaccgcuggccaugggcaaauugauaacuuuagccuuggaguucucggcauggcgcuguuccuggaagagaugcuccgcacacggguggggaccaaacacgccauccugcuugucgcuguguccuuuguuacgcugauuaccggaaauaugucuuucagagaccucggccgcgugauggucauggugggcgccacaaugaccgaugacaucgggaugggaguuacauaucuggcccugcuugcugccuuuaaggugagaccuaccuucgcggcuggccugcuccugcggaaacucacgagcaaggaacugaugaugacaaccauugggaucguccuucugucccagucuacaauccccgagaccauucucgagcugaccgaugcccuggcccuuggaaugauggugcugaaaaucgugcgcaagauggaaagauaccagcucgcugucacaauuauggccauccugugcguuccuaacgcggugauucuccaaaaugcuuggaaggugagcuguacgauccuggccgucguguccguuagcccccuucugcucaccucuucccagcagaaagccgacuggaucccucuggcucugacaauuaagggccuuaaccccaccgccaucuuucugacaacccucagccggacgucuaaaaagcgcuccuggccgcugaaugaggcuauuauggccguggggauggucagcauccucgcgucuucccugcuuaaaaacgauauuccuaugacaggaccccugguggccggcggccugcucaccguuugcuaugugcugaccgggagaagcgcugaccuugaacuggagaaggccgcugacguccggugggaagaacaggccgagaucuccggaagcucuccuauccucagcauuaucauuuccgaagauggcucuaugagcaucaaaaaugaggaagaggagcaaacacugaccauucucauccgcacagggcugcuugugauuuccggacuguuccccgucucuaucccgaucacggccgcugcgugguaccugugggaagugaagaagcagagagccggcguucucugggacgugccuucucccccucccgucgggaaagcugagcuggaagauggagccuaucggauuaagcagaaaggcauccuuggcuacucccagauuggggccggaguguauaaggagggcaccuuucacacaauguggcauguuacccgcggggcugugcugaugcacaaaggaaagagacucgaacccuccugggccgacgucaagaaagaucugaucagcuacggcgggggauggaagcucgagggcgaguggaaagaaggcgaggaagugcaagugcuggcgcuugagccugggaagaacccgcgggcuguucagacaaaacccggacuguucaagaccaauacgggcaccauuggggccgucucccuggacuuuagcccuggaacaucuggcucccccaucaucgauaagaaagggaagguggugggacucuacggcaacggcgucgugaccagaaacgggagcuauguuucugccauugcucagacagaaaaauccaucgaggacaauccugagauugaagaugacaucuuccgcaagaaacggcugaccauuauggaucuucaucccggagccggcaagacaaagagauaccugccugcgaucgugcgcgaggcuaucaaacgggggcucagaacgcugauucucgccccgacccgcgucguggccgcugaaauggaggaagcccugcggggacuucccaucagauaucagaccccugcuauucgcgccgagcacaccggccgggagaucguugaccugaugugucaugcgaccuucacaaugagacugcucagccccauucgggugccuaacuacaaucugaucauuauggaugaagcccacuuuacggaccccgcuuccaucgccgcucgcggguauaucucuaccagagucgagaugggcgaagccgccggaauuuucaugacagcuaccccgccuggcagccgggaccccuuuccccaauccaacgcgccuaucauggaugaggagcgcgaaauucccgagagaagcuggaacucugggcacgaaugggugacagacuucaagggaaaaaccguuugguuugugccuuccaucaaggccggcaacgauauugcugccugccuucggaaaaaugggaagaaggucauccagcugagcagaaaaacguucgacucugaguacgugaagacacgcaccaacgauugggacuuuguggucaccacagauaucagcgaaaugggagccaauuucaaagcugagcggguuauugacccgagacgcuguaugaagcccgugauccucaccgauggcgaggaacgggugauucuggccgggccuaugcccgucacacauuccucugcggcucagagacgcggccggaucggaagaaacccuaaaaaugagaacgaccaauauauuuacaugggcgaaccccuggagaaugaugaagacugcgcccacuggaaggaggccaaaaugcuccuugacaacaucaauaccccggaggggaucauuccuagcauguuugaacccgagcgcgaaaagguggaugcuaucgacggagaguacagacugcggggcgaagcccgcaagacguucguugaucugaugagaagaggggaccucccuguguggcuggcguauaaagucgccgcugagggaauuaacuacgccgaucgcagaugguguuuugacggcauccggaacaaucagauucuugaggaaaacguggagguugaaaucuggacaaaggagggggagcgcaagaagcugaaaccccgcuggcucgaugcucggauuuauuccgacccucuggcccugaaggaguucaaggaguucgcugccggcagaaaaucucucacccuuaaucugaucacagaaaugggacgccugcccaccuuuaugacgcagaaggcgcgggaugcccucgacaaccuggcugugcuucauaccgccgaggcuggcgggagagccuacaaucacgcccugagcgaacucccggagacacuggagacccugcuccuucugacacugcucgcuaccgucacaggaggcaucuuccuguuucuuauguccgggaaaggaauuggcaagaugacccugggcaugugcugcaucauuacggcgagcgugcuccugugguaugcccagauccaaccucacuggauugcugccucuaucauccuggaguucuuucucauuguccuucugauccccgagcccgaaaaacagcggacaccucaggauaaccagcugaccuacgugguuauugccauccucaccgugguggcugccacaauggcgaaugagaugggguuccuggaaaagaccaagaaagacuuuggacuuggcuccauugccacacaacagccggagagcaacauccuggauaucgaccuccgccccgcuuccgccuggacgcuguaugcugucgccaccacauucauuaccccuaugcugagacauucuaucgagaauagcuccguuaacgugucucucacagcgauugccaaucaggcuaccgugcuuauggggcugggaaagggcuggccccugagcaaaauggacaucggggucccucuccuggccauuggauguuacucccaggugaaccccaucacgcuuaccgcugcccugcuccugcugguugcucacuacgccauuaucggcccuggccuccaagcgaaggccacacgggaagcucagaaacgcgccgcugccgggaucaugaagaauccgaccguggauggaauuacagucaucgaccuugaucccauuccuuaugaccccaaguuugagaaacagcugggccaggugaugcugcucguccugugcgugacccaaguucuuaugaugagaacgacaugggcccugugugaagcgcucacccuggcuacagggccuaucagcacccugugggagggaaaccccggccgguucuggaauaccacaauugccgugucuauggcuaacaucuuucgcggguccuaccucgccggagccggccuucuguucagcaucaugaagaauacgaccaacacaagacggggcaccgggaacauuggagaaacacugggcgagaaauggaagucucgccucaaugcucuggggaaauccgaguuucagaucuauaagaaaagcggcauucaggaagucgauagaacccuugccaaggagggcaucaagagaggggaaacggaccaucacgcggugucuagaggaagcgccaaacugcgcugguucguugagcggaacauggugacaccggagggcaaggucguggaucucggcugcgggagaggaggcugguccuacuauugugggggacugaaaaaugugcgcgaaguuaagggccugaccaaagggggaccuggccaugaggaacccauucccaugucuaccuacggcuggaaccucguccggcuucaaagcgggguggacguguucuuuacaccucccgagaagugcgauacccugcugugugacaucggagaauccagcccuaauccgacagucgaggcuggcagaacgcuccgcguucugaaccuuguggagaauuggcugaacaauaacacccaguucugcaucaaggugcucaaucccuauaugccuuccgucauugagaagauggaggcccugcagcggaaguacgggggagcucuggugagaaacccccucucucgcaauagcacacacgaaauguacuggguuuccaacgccucuggcaauaucgugagcuccgucaacaugauuucucggaugcuuaucaacagauuuaccaugcgccacaaaaaggcgacauaugagccugauguggaccuggggagcggaacccggaauauuggcaucgaauccgagauccccaaccuggauauuaucggcaaaagaauugagaagaucaagcaggaacaugagacgagcuggcacuacgaccaagaccauccguauaaaaccugggccuaccacgggucuuaugaaacaaagcagaccggauccgcuagcucuaugguuaauggcgugguccgccuccugacaaaaccuugggaugugauucccauggugacccagauggccaugacagacaccacgccuuucgggcagcaaagagucuuuaaggagaaaguugauacacggacccaggaacccaaggagggaaccaagaaacuuaugaagaucacagcugaguggcuguggaaagaacucggcaagaaaaagacgccucgcauguguaccagagaggaguucacacggaaagugagauccaacgccgcucugggggccauuuuuaccgacgagaauaaguggaaaagcgcgcgggaggccguggaagauucucgcuucugggagcuggucgacaaagaaagaaaccuccaccuggagggaaagugcgaaacauguguguacaauaugaugggcaaacgggagaagaaacuuggcgaguuugggaaggcuaagggaucccgcgccaucugguauauguggcugggcgcuagauuccucgaauuugaggcccugggguuccuuaacgaagaucauugguuuagccgggaaaauucccugagcggaguugaaggcgaggggcuccacaaacugggcuacauccugcgcgaggugucuaagaaagaaggaggcgccauguacgcggacgauaccgcugggugggacacaagaauuacccucgaggaucugaagaacgaagagauggucacgaaucauauggaaggagagcacaagaaacuugccgaggccaucuucaaacugaccuaucagaacaaagugguucgggugcagcgccccacaccgagaggcaccgucauggacauuaucagccggcgcgaccaaagaggguccggacaggugggcacauacgggcucaauaccuucacgaacauggaagcucagcugauucggcaaauggagggcgaaggaguuuuuaagucuauccagcaucuuacagccaccgaggagaaugcugugcagaacuggcuggcccgcgucggcagagaacggcucagcagaauggcgaucuccggggaugacugcguggucaaaccucuggaugaccgcuucgccucugcucugacagcccucaacgauaugggaaaggugcggaaagacauucagcaaugggagcccagcagaggcuggaaugauuggacccagguucccuuuugcucccaccacuuccaugaacugaucaugaaggacgggcgcgugcuugucgugccuugucggaaccaggaugagcugauugggcgggcucgcaucucucagggcgccggguggagccuccgggaaacggcgugccugggcaaguccuaugcccaaauguggagccuuauguacuuucacagacgcgaccugcggcucgcugccaaugcuauuuguucugccgugccgucccauuggguucccaccagcagaacaaccuggucuauccacgcuaaaaacgaguggaugacaaccgaggauaugcugacaguguggaaucgcgucuggauccaggaaaacccuuggauggaggacaagacccccguggaauccugggaggaaauuccuuaucugggaaaacgggaggaucaguggugcggcagccucaucgggcugacguccagagccacaugggcgaagaauauucagaccgccaucaaccaaguucggucucuuauuggaaaugaggaauacaccgacuauaugcccagcaugaaaagauuccgccgggaggaagaggaagcuggcgugcugugguga

SEQ ID NO: 19558 - RNA, 9876 nt, Artificial Sequence
  derived and/or modified CDS sequence (opt5) from DENV-2__JX286516__SS-prME
acagccggcgugaucgugaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaaucgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucgucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggauguaucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccgucguggugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggucaauucccucguuaccgccggccaugggcagaucgauaacuuuucucugggagugcugggcauggcucuuuuccucgaagagaugcugagaacgcgcguggggaccaaacacgcgauccugcucgucgcccugagcuuugugacacuuauuaccggaaauauguccuuccgggaccugggcagaguuauggugauggucggcgcuacaaugaccgaugacaucgggaugggagugacguaucucgcccugcuggccgcuuuuaagguucgcccuacauucgccgcgggccuucugcucagaaaacugaccucuaaggagcucaugauggcuacaauugggaucgcccugcuuagccaguccacccugcccgaaaccauucucgagcugacagaugcccuggcucuuggaaugauggcccugaaaaucgugcggaacauggaaaaguaccaacucgcggucacgaucauggcuauuucuugcgugccuaaugccguuauccugcagaacgccuggaaggugagcuguaccauucucgcugccgucuccgugagcccccugcuucugacaucuucccagcagaaagcugacuggaucccucucgcccugaccauuaagggccugaaucccacagcgaucuuucuuaccacgcugagccgcacaucuaaaaagagauccuggccgcucaacgaggccaucauggcuguggggauggucagcauucuggccucuucccuccugaaaaaugacaucccuaugaccggaccccuuguugcuggcggccugcugaccgugugcuaugugcucacagggcggagcgccgaucuggaacuugagcgcgccgcugacgucaagugggaggaucaagcggaaauuuccggaagcucuccuauccugagcauuaccaucuccgaggacggcucuaugagcauuaaaaacgaagaggaggaacagacacucacgauccugaucagaaccgggcuccuggugauuuccggaguuuuccccgugucuaucccgauuacagccgcugccugguaccuuugggaggucaagaagcagcgggccggcgugcugugggauguuccuucucccccucccguggggaaagcugaacuggaggacggagccuaucgcaucaagcagagaggcauucucggcuacucccaaaucggggcgggagucuauaaagaaggcaccuuucacacaauguggcaugugaccagaggggcuguccugaugcaccgcggaaagagaaucgagcccuccugggccgaugugaaaaaggaccuuauuagcuacggcgggggauggaagcuggagggcgaauggaaagagggcgaagagguucaggugcucgcccuggaaccugggaagaauccgcgggcuguccagacgaaacccggaaucuucaagaccaacacaggcaccauuggggccgugucccucgauuuuagcccuggaacaucuggcucccccaucguugacagaaaagggaagguggucggacuguacggcaauggcguggugacccgcagcggggcguauguuucugcuauugcccagacagagaaguccaucgaggauaacccugaaaucgaggacgauauuuuccggaaaaagagacuuacgaucauggaccugcaucccggagccggcaaaaccaagcgcuaccugccugcuauuguccgggaagccaucaaaagagggcuccgcacacugauucuugcuccgacccgggugguggccgcggagauggaagaggcccugagaggacuccccauccgcuaucaaaccccugcuauucgggccgagcacacaggcagagaaaucgucgaccugaugugucaugcuacguucaccaugcggcuccugagccccgugcgcguuccuaacuacaaucuuaucauuauggaugaggcccacuuuacagaccccgccuccaucgcugcgagaggguauauuucuacccggguggaaaugggcgaggccgcuggaaucuucaugacagccaccccgccuggcagccgcgaucccuuuccccaguccaacgccccuauuauggacgaggaaagagagauccccgaacggagcuggaacucugggcacgagugggucacggauuucaagggaaagacagugugguuuguuccuuccaucaaagcuggcaacgacauugccgcgugccugagaaagaaugggaaaaaggugauccagcugagccgcaaaaccuucgauucugaauacgucaagacccgggcuaacgacugggauuuugugguuacaaccgacauuagcgagaugggagccaauuucaaggccgagagagugaucgauccgcgccgguguaugaaacccgucauucucacagacggcgaagagagagugauccuggcugggccuaugcccgugacccauuccucugccgcgcaacgccggggcagaaucggacgcaacccuaagaaugaaaacgaccaguauauuuacaugggcgagccccuugaaaaugaugaggacugcgcccacuggaaagaggcuaagaugcugcucgauaacaucaauacgccggaagggauuaucccuagcauguuugagcccgaaagagagaaagucgacgccauugauggagaauaccggcugcgcggcgaggcuagaaagacauucguugaccugaugcggcgcggggaucucccuguguggcuugccuauaaaguggcugccgagggaaucaacuacgcggacagaaagugguguuuugauggcauuaagaauaaccagauccuggaagagaacgucgaaguggagaucuggaccaaagagggggaacggaagaaacugaagcccagauggcucgacgcccgcauuuauuccgauccucuggcucuuaaaggcuucaaggaguucgccgcuggacggaagucucugacacucaaucugaucaccgaaaugggcagacugcccacguuuaugacccagaaagcccgcaacgcccucgacaaucuugcuguucugcauacagcggaggucgggggaaaggccuacacccacgcucugagcgaacucccggagacacuggagacccuucugcuccugacacugcucgccgccgucaccggcgggauuuuccuuuuucugauguccggaaaaggcaucggcaagaugacgcuggggaugugcugcauuaucacagcuagcauccuccugugguaugcccaaauucagccucacuggaucgcggccucuauuauccuugaguucuuucugauugugcuccugauccccgagcccgaaaaacagcggaccccucaggauaaccaacugaccuacguugugaucgcuauucucacagucguggccgcuaccauggccaaugagaugggauuccuugaaaagacaaagaaagaccugggcuuuggguccaucacgacccaggagagcgaguccaacauucuggacaucgaucucagaccggcgucugccuggacacuguaugcugucgccaccacauucgugacccccaugcuucggcauagcauugaaaauuccucuguuaacgugagccugacggcuaucgccaaucaggcuaccgugcucaugggacugggcaagggguggccucuguccaaaauggacauuggagucccccuccuugccaucggcuguuacagccagguuaacccuaucacacugaccgcggcccugcuccugcuuguggcucacuacgccauuaucggccccgggcugcaagcuaaggccacacgcgaggcccagaaaagagcggcugccggaauuaugaagaauccuaccguggauggcaucacggucauugaccucgaaccgauccccuaugauccuaaguuugagaaacagcugggacaggugaugcugcucauccuuugcguuacacaagugcugaugaugcggaccacaugggcucugugugaagcccucacccuggccaccggacccauuucuacacuuugggagggcaacccugggcgcuucuggaauacgaccaucgcugucuccauggccaacauuuuuagaggaagcuaccuggcgggcgccggccuccuguucucuaucaugaagaauacaaccaacacacggcgcgggaccggaaaugugggcgagacgcugggggaaaaauggaaguccagacucaacgcucuuggaaaaagcgaguuucagauuuauaagaaaucuggcauccaggaagucgaccggacacuggccaaggaggggaucaagcgcggagagaccgaucaucacgcugugagcagaggcuccgccaaacugcggugguucguugaaagaaacauggugacccccgagggcaaggucguggaccucgggugcggacgcggcggguggucuuacuauuguggaggccugaaaaauguucgggaagugaaggggcuuacaaaaggaggcccgggccaugaggaaccuauucccaugagcaccuacggguggaaccuggucagacuccaauccggaguggauguguucuuuacacccccugagaagugcgacacgcugcugugugauaucggcgagagcucccccaauccuaccauugaagcggggcgcacacuccggguucuuaaccuggucgagaauuggcugaacaauaacacccaguucugcaucaaggugcucaauccguauaugcccucugugauugagaagauggagacacugcagagaaaguacggaggcgcccuuguccgcaacccucugagccggaauagcacccacgaaauguacuggguuucuaacgcuacggggaauaucgugagcuccgugaacaugaucucuagaaugcucauuaaucgcuuuaccaugaaacacaagaaagccacauaugagcccgacgucgaucugggaagcggcacccggaacaucggcauugaguccgaaaucccuaaccuggacauuaucgggaagagaauugagaagaucaaacaggaacaugagacaagcuggcacuacgaccaagaucaucccuauaagaccugggcuuaccacggaucuuaugaaacaaaacagaccggcuccgccagcucuauggugaaugggguugugcgccuccuuacgaagccgugggacgucgugccuaugguuacacagauggcuaugaccgauaccacacccuucggacagcaacggguguuuaaagagaaggucgacacgagaacccaggagccuaaggaaggcaccaagaagcugaugaaaaucaccgccgaguggcuguggaaggaacucgggaaagagaagacaccccgcauguguaccagagaggaguucacacggaaagugcgcuccaacgcggcccugggagcuguguuuaccgaugagaauaaguggaaaagcgccagagaagcugucgaggacggccgguucugggaacuuguugauagagagcggaaccugcaccucgagggcaaaugcgaaacguguguguacaauaugauggggaagcgcgagaaaaagcugggagaauuuggcaaagccaaggggucuagagccauuugguauauguggcugggagcgcgguuccucgaguuugaagcucugggcuuccuuaacgaggaccauugguuuucccgcgggaauagccuguccggcguggagggagaaggccuccacagacugggguacauccuucgggaggucggaaagaaagaaggcggggccauguacgccgaugacaccgcuggaugggauacacgcauuacccuggaggaccucaagaacgaagagauggugacaaaucauaugaaaggcgagcacaagaaacuggccgaagcuaucuucaagcugaccuaucagaacaagguugugagaguccagcggccuacgccccgcgggacagugauggacauuaucagcagaaaagaucaacggggcucuggacagguuggcaccuacgggcucaauacauucaccaacauggaggcccagcugauccgccaaauggaaggagagggcauuuuuaagagcauccagcaucuuacggcgaccgaggaaauugccgugcagaauuggcuggcuagagucgggcgggagcgccucuccagaauggccaucucuggagacgauugcgugguuaaaccgauugacgaucgguucgcuagcgcccugacagcgcuuaacgacaugggcaaggugagaaaagauauccagcaaugggaaccuucccgcggguggaaugacuggacccagguccccuuuugcucucaccacuuccaugagcuggugaugaaggauggccggguccucgugguucccuguagaaaccaggacgaacugaucggacgcgcccggauuagccagggcgcuggguggucccugaaggagacagccugccucggaaaaucuuaugcucaaauguggacccugauguacuuucacagacgcgaucuucggcuggccgcuaacgccaucuguagcgcggugccuucccauugggucccgacaagcagaaccacguggucuauucacgccaagcacgaguggaugacaaccgaagacaugcucgcuguguggaaucgcguguggauccaggagaaccccuggauggaagauaaaaccccuguugaguccugggaagaggugcccuaucugggcaagcgggaggaccaguggugcgggagccuuauuggacugacaucuagagccaccugggccaaaaauauccagacagcuauuaaccaaguccgcucccucaucggcaaugaaggguacacggacuauaugccuagcaugaagcgguucagacgggaggaagaggaagccggcgugcugugguga

SEQ ID NO: 19559 - RNA, 9876 nt, Artificial Sequence
  derived and/or modified CDS sequence (opt5) from DENV-2__JX286518__SS-prME
acagccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauagaguggcugccgagggaauuaacuacgcggaccggaaaugguguuuugauggcaucaagaauaaccagauucuggaagagaacgucgaaguggagaucuggacaaaggagggggaacgcaagaagcugaaaccccgcuggcucgacgcccggaucuauuccgauccucuggcucuuaaggaguucaaagaguucgccgcuggcagaaagucucugacccucaaucugauuacggagaugggacgccugcccaccuuuaugacacagaaggcccggaacgcccucgacaaucuugcuguucugcauaccgcggaagugggcgggaaagccuacacacacgcucugagcgagcucccggagacccuggaaacacuucugcuccugacccugcucgccgccgucacgggaggcaucuuccuuuuucugauguccgggaagggaauuggcaaaaugacacugggcaugugcugcaucauuaccgcuagcauccuccugugguaugcccaaauccagccucacuggauugcggccucuaucauucuugaguucuuucugaucgugcuccugauucccgaacccgagaagcagagaaccccucaggauaaccaacugacauacguugugaucgcuauccucaccgucguggccgcuacaauggccaaugaaaugggguuccuugagaaaacgaagaaggaccugggauuuggcuccauuaccacacaggagagcgaauccaacauccuggacauugaucuccggccggcgucugccuggacccuguaugcugucgccacaaccuucgugacgcccaugcuucgccauagcaucgaaaauagcucuguuaacgugagccugaccgcuauugccaaucaggcuacagugcucauggggcugggaaaaggcuggccucuguccaagauggacaucggggucccccuccuugccauuggauguuacagccagguuaacccuaucacccugacagcggcccugcuccugcuuguggcucacuacgccaucauuggccccggccugcaagcuaaagccaccagagaagcccagaagcgggcggcugccgggaucaugaaaaauccuacgguggauggaauuacagucaucgaccucgagccgauucccuaugauccuaaguuugaaaagcagcugggccaggugaugcugcucauccuuugcguuacccaagugcugaugaugcgcacaaccugggcucugugugaggcccucacccuggccacagggcccaucucuacgcuuugggagggaaacccuggcagauucuggaauaccacaauugcugucuccauggccaacaucuuucgggggagcuaccuggcgggagccggccuccuguucucuauuaugaaaaauaccacaaacacccgcagaggcacggggaaugugggagaaacacugggcgagaaguggaaaucccggcucaacgcucuuggaaagagcgaauuucagaucuauaaaaagucuggcauucaggaggucgaccgcacccuggccaaagagggcaucaagagaggggaaaccgaucaucacgcugugagccggggauccgccaagcugagaugguucguugagcgcaacauggugacacccgaaggcaaagucguggaccucggcugcgggcggggaggcuggucuuacuauugugggggacugaagaauguuagagaggugaaaggccuuaccaaagggggaccgggccaugaggagccuauccccaugagcacauacggcuggaaccugguccgccuccaauccgggguggauguguucuuuacgcccccugagaaaugcgacacccugcugugugauauuggagaaagcucccccaauccuacaaucgaggcgggccggacccucagaguucuuaaccuggucgaaaauuggcugaacaauaacacacaguucugcauuaaggugcucaauccguauaugcccucugugaucgagaagauggaaacccugcagcgcaaauacgggggagcccuuguccggaacccucugagcagaaauuccacgcacgagauguacuggguuucuaacgcuaccggcaauauugugagcuccgugaacaugaucucucgcaugcucaucaaucgguuuacaaugaagcacaaaaaggccaccuaugagcccgacgucgaucuggggagcggaacaagaaacauuggcaucgaauccgagauuccuaaccuggacaucauuggcaaacgcaucgaaaagauuaagcaggagcaugaaaccagcuggcacuacgaccaagaucaucccuauaaaacaugggcuuaccacgggucuuaugagaccaagcagacgggauccgccagcucuauggugaauggcguugugcggcuccuuacaaaaccgugggacgucgugccuaugguuacccagauggcuaugaccgauacaacgcccuucgggcagcaaagaguguuuaaggagaaagucgacacccgcacacaggaaccuaaggagggaaccaagaaacugaugaagaucacagccgaauggcuguggaaagagcucggcaaggagaaaacccccagaauguguacacgggaagaguucacccgcaaggugagauccaacgcggcccugggggcuguguuuacggaugaaaauaaauggaaaagcgcccgggaggcugucgaagacggaagauucugggagcuuguugaucgggagcgcaaccugcaccucgaaggcaagugcgagaccuguguguacaauaugaugggcaaaagagaaaagaaacugggggaguuuggaaaggccaaaggcucucgggccaucugguauauguggcugggggcgcgcuuccucgaauuugaggcucugggauuccuuaacgaggaccauugguuuuccagaggcaauagccuguccgggguggaaggcgagggacuccaccggcugggcuacauucuucgcgaagucgggaagaaggagggaggcgccauguacgccgaugacacagcugggugggauaccagaaucacacuggaagaccucaaaaacgaggagauggugaccaaucauaugaagggagaacacaaaaagcuggccgaggcuauuuucaaacugacguaucagaacaagguugugcggguccagcgcccuacacccagaggcaccgugauggacaucauuagccggaaggaucaacgcgggucuggccagguuggaacauacggccucaauaccuucacgaacauggaagcccagcugaucagacaaauggagggggagggaaucuuuaaaagcauucagcaucuuaccgcgacagaagagaucgccgugcagaauuggcuggcucgggucggccgcgaaagacucucccggauggccauuucuggggacgauugcgugguuaagccgaucgacgauagauucgcuagcgcccugaccgcgcuuaacgacaugggaaaagugcgcaaggauauucagcaaugggagccuucccggggcuggaaugacuggacacagguccccuuuugcucucaccacuuccaugaacuggugaugaaagaugggagaguccucgugguucccugucgcaaccaggacgagcugaucggccgggccagaaucagccagggagcuggcuggucccugaaggagaccgccugccucgggaagucuuaugcucaaauguggacacugauguacuuucaccgccgggaucuuagacuggccgcuaacgccauuuguagcgcggugccuucccauugggucccgaccagccgcacgacauggucuauccacgccaaacacgaauggaugaccaccgaggacaugcucgcuguguggaaucggguguggauucaggaaaaccccuggauggaggauaagacaccuguugaauccugggaggaggugcccuaucugggaaaaagagaagaccaguggugcggcagccuuaucgggcugaccucucgcgccacaugggccaagaauauucagacggcuaucaaccaaguccggucccucauuggaaaugagggcuacaccgacuauaugccuagcaugaaaagauuccggagagaagaggaagaggccggggugcugugguga

SEQ ID NO: 19560 - RNA, 9876 nt, Artificial Sequence
  derived and/or modified CDS sequence (opt5) from DENV-2__JX286519__SS-prME
accgccggagugaucguuaugcugauucccacagcuauggccuuccaccucacgacccggaauggggagccucauaugaucguuggacggcaggaaaagggcaagagccugcuuuuuaagacagaggacgggauuaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaaauuguccagccugagaaccucgaauacaccaucguuaucacaccccacagcggggaggagcaugcggugggaaaugacaccggcaagcacggcaaagaaauuaagaucacaccucagucuuccaccacggaggccgaacugaccggguauggaacagugaccauggaguguagcccccggacaggccuugauuucaacgaaaugguccugcuccaaauggaggacaaggcuuggcuggugcaccgccagugguuucuugaucugccgcucccuuggcugcccggggccgacacccagggaucuaauuggauucagaaggagacgcugguuacauucaagaacccucaugcuaaaaagcaagacguggucgugcucggcucccaggaaggggccaugcacaccgcccugacaggcgcuaccgagauccagaugagcuccggaaaucuucuguuuaccggccaucucaaaugcagacugcggauggauaaacuucaacugaaagggaugucuuacagcauguguacaggaaaguucaagauuguuaaagaaaucgcggagacgcagcacggcaccaucgugauuagaguccaguaugagggggacggaucccccugcaagauccccuucgaaauuacagaucucgagaaacgccaugugcugggccggcugaucaccgucaacccuauugugacagaaaaggacagcccgguuaacaucgaggccgaacccccuuuuggggauucuuacauuaucgugggcgucgagcccggacagcucaaacugaauugguucaagaagggcuccagcaucgggcaaauguuugagaccacgaugagaggagcuaaacgcauggccauucuuggcgacacagccugggauuucgggucucugggaggcguguuuaccagcaucgggaaggcucuccaccagguuuucggcgccauuuacggagcggcuuuuuccggcgugucuuggaccaugaaaauccugauuggggucaucaucacauggauuggaaugaacagccgguccaccagccugucugugucccuugugcucguuggcgucgugacacuguaucugggggccauggugcaggccgacagcggauguaucgucucuuggaagaauaaagaacucaagugcggcuccgggauuuucaucacggauaacgugcacaccuggacagagcaguacaaguuucaaccugaaagccccuccaaacuggcuucugccauucagaaggcucaugaggaaggcaucuguggaaucagaagcguuacccgccuugagaaucugauguggaaacagauuacaccggagcucaaccacauccuguccgaaaaugaggugaagcugaccauuaugacgggcgacaucaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgaggucgaagacuacggauuuggcguguucaccacgaacaucuggcugaaacuucgggagaaacaggacgucuuuugugauuccaagcugaugagcgccgcuauuaaagacaauagagccgugcacgcggauaugggcuauuggaucgaaucugcccucaacgacacauggaagauggagaaggcuuccuucauugaggucaaaagcugccacuggccuaagucucauacccuguggagcaauggggugcuggaauccgagaugaucauucccaaaaacuucgccggaccgguuagccagcacaacuaccgcccuggcuaucauacccaaacagcugggcccuggcaccuuggaaagcucgaaauggauuuugacuucugugagggcaccacgguggucgugacagaagauugcgggaaucggggacccucucugagaaccacaaccgccuccggcaaacugaucacagaguggugcugucggagcugcacccucccuccgcugcgcuacagaggcgaggacggguguugguacggaauggaaauucggccccuuaaggagaaggaagagaaccuggugaauagccucgucacggccggccaugggcagaucgauaacuuuucucugggaguucugggcauggcucuuuuccucgaagagaugcugagaacccgcguggggacaaaacacgcgauccugcucguggcccugagcuuugucacccuuauuacaggaaauauguccuuccgggaccugggcagagugaugguuauggugggcgcuaccaugacggaugacaucgggaugggagucacauaucucgcccugcuggccgcuuuuaaggugcgcccuaccuucgccgcgggccuucugcucagaaaacugacaucuaaggagcucaugauggcuaccauugggaucgcccugcuuagccaguccacccugcccgaaacaauucucgagcugacggaugcccuggcucuuggaaugauggcccugaaaaucguucggaacauggaaaaguaccaacucgcggugaccaucauggcuauuucuugcgucccuaaugccgugauccugcagaacgccuggaagguuagcuguacaauucucgcugccguguccgucagcccccugcuucugaccucuucccagcagaaagcugacuggaucccucucgcccugacaauuaagggccugaaucccaccgcgaucuuucuuacgacacugagccgcaccucuaaaaagagauccuggccgcucaacgaggccaucauggcuguggggauggugagcauucuggccucuucccuccugaaaaaugacaucccuaugaccggaccccuugucgcuggcggccugcugacaguuugcuaugugcucaccgggcggagcgccgaucuggaacuugagcgcgccgcugacgugaagugggaggaucaagcggaaauuuccggaagcucuccuauccugagcauuacaaucuccgaggacggcucuaugagcauuaaaaacgaagaggaggaacagacgcucaccauccugaucagaacagggcuccuggucauuuccggaguguuccccguuucuaucccgauuaccgccgcugccugguaccuuugggaggugaagaagcagcgggccggcguccugugggaugugccuucucccccucccguugggaaagcugaacuggaggacggagccuaucgcaucaagcagagaggcauucucggcuacucccaaaucggggcgggaguguauaaagaaggcacauuucacaccauguggcaugucacgagaggggcugugcugaugcaccgcggaaagagaaucgagcccuccugggccgaugucaaaaaggaccuuauuagcuacggcgggggauggaagcuggagggcgaauggaaagagggcgaagaggugcagguucucgcccuggaaccugggaagaauccgcgggcugugcagaccaaacccggaaucuucaagacaaacaccggcacaauuggggccgucucccucgauuuuagcccuggaaccucuggcucccccaucguggacagaaaagggaagguugugggacuguacggcaauggcgucgugacacgcagcggggcguaugugucugcuauugcccagacggagaaguccaucgaggauaacccugaaaucgaggacgauauuuuccggaaaaagagacuuaccaucauggaccugcaucccggagccggcaaaacaaagcgcuaccugccugcuauuguucgggaagccaucaaaagagggcuccgcacccugauucuugcuccgacccgggucguggccgcggagauggaagaggcccugagaggacuccccauccgcuaucaaaccccugcuauucgggccgagcacacgggcagagaaaucguggaccugaugugucaugcuaccuucacaaugcggcuccugagccccguccgcgugccuaacuacaaucuuaucauuauggaugaggcccacuuuaccgaccccgccuccaucgcugcgagaggguauauuucuacacggguugaaaugggcgaggccgcuggaaucuucaugaccgccacgccgccuggcagccgcgaucccuuuccccaguccaacgccccuauuauggacgaggaaagagagauccccgaacggagcuggaacucugggcacgagugggugacagauuucaagggaaagaccgucugguuugugccuuccaucaaagcuggcaacgacauugccgcgugccugagaaagaaugggaaaaagguuauccagcugagccgcaaaaccuucgauucugaauacgugaagacacgggcuaacgacugggauuuugucgugaccacagacauuagcgagaugggagccaauuucaaggccgagagaguuaucgauccgcgccgguguaugaaacccgugauucucaccgacggcgaagagagagucauccuggcugggccuaugcccgugacgcauuccucugccgcgcaacgccggggcagaaucggacgcaacccuaagaaugaaaacgaccaguauauuuacaugggcgagccccuugaaaaugaugaggacugcgcccacuggaaagaggcuaagaugcugcucgauaacaucaauacaccggaagggauugugccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcagcgcccucgacaaccuugcuguucugcauaccgcggaagugggcgggaaggccuacacacacgcucuguccgagcucccggagacccuggaaacacuucugcuccugacccugcucgccgccgucacgggaggcaucuuccuuuuucugaugagcgggaaaggaauuggcaagaugacacugggcaugugcugcaucauuaccgcuucuauccuccugugguaugcccaaauccagccucacuggauugcggccuccaucauucuugaguucuuucugaucgugcuccugauucccgaacccgagaaacagcggaccccucaggauaaucaacugacauacguugugaucgcuauccucaccgucguggccgcuacaauggccaacgaaaugggguuccuugagaagacgaagaaagaccugggauuuggcagcauuaccacacaggaguccgaaucuaauauccuggacauugaucucagaccggcgagcgccuggacccuguaugcugucgccacaaccuucgugacgcccaugcuucggcauuccaucgagaacucuagcguuaaugugucccugaccgcuauugccaaccaggcuacagugcucauggggcugggaaagggcuggccucugagcaaaauggacaucggggucccccuccuugccauuggauguuacucucagguuaauccuaucacccugacagcggcccugcuccugcuuguggcucacuacgccaucauuggccccggccugcaagcuaaggccacccgcgaagcccagaaaagagcggcugccgggaucaugaagaacccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucuccacgcuuugggagggaaauccuggccgcuucuggaacaccacaauugcugucagcauggccaauaucuuuagagggucuuaccuggcgggagccggccuccuguucuccauuaugaagaacaccacaaauacccggcgcggcacggggaacgugggagaaacacugggcgagaaauggaaaagcagacucaaugcucuugggaaaucugaauuucagaucuauaagaaaagcggcauucaggaggucgaccggacccuggccaaggagggcaucaagcgcggggaaaccgaucaucacgcuguguccagaggaucugccaaacugcggugguucguugagagaaacauggugacacccgaaggcaaggucguggaccucggcugcgggcgcggaggcuggagcuacuauugugggggacugaaaaacguucgggaggugaagggccuuaccaaagggggaccgggccaugaagaaccuauccccauguccacauacggcuggaaucuggucagacuccaaagcgggguggauguguucuuuacgcccccugagaagugcgacacccugcugugugauauuggagaauccucucccaacccuacaaucgaggcgggccgcacccuccggguucuuaaucuggucgaaaacuggcugaauaacaauacacaguucugcauuaaggugcucaacccguauaugcccagcgugaucgagaaaauggaaacccugcagagaaaguacgggggagcccuuguccgcaauccucugucccggaacucuacgcacgagauguacuggguuagcaaugcuaccggcaacauuguguccucugugaauaugaucagcagaaugcucaucaaccgcuuuacaaugaaacacaagaaagccaccuaugagcccgacgucgaucugggguccggaacacggaauauuggcaucgaaagcgagauuccuaaccuggacaucauuggcaagagaaucgaaaagauuaaacaggagcaugaaaccucuuggcacuacgaccaagaucaucccuauaagacaugggcuuaccacggguccuaugagaccaaacagacgggaagcgccucuuccauggugaacggcguugugcgccuccuuacaaagccgugggacgucgugccuaugguuacccagauggcuaugaccgauacaacgcccuucgggcagcaacggguguuuaaagagaaggucgacaccagaacacaggaaccuaaggagggaaccaaaaagcugaugaaaaucacagccgaauggcuguggaaggagcucggcaaagagaagacaccccgcauguguacaagagaagaguucacccggaaagugcgcagcaaugcggcccugggggcuguguuuacggaugaaaacaaguggaagucugccagagaggcugucgaagacggacgguucugggagcuuguugauagagagcggaaucugcaccucgaaggcaaaugcgagaccuguguguacaacaugaugggcaagcgcgagaagaagcugggggaguuuggaaaagccaagggcuccagagccaucugguauauguggcugggggcgcgguuccucgaauuugaggcucugggauuccuuaaugaggaccauugguuuagccgcggcaacucccugagcgggguggaaggcgagggacuccacagacugggcuacauucuucgggaagucgggaagaaagagggaggcgccauguacgccgaugacacagcugggugggauacccgcaucacacuggaagaccucaagaaugaggagauggugaccaaccauaugaaaggagaacacaagaaacuggccgaggcuauuuucaagcugacguaucagaauaagguugugagaguccagcggccuacaccccgcggcaccgugauggacaucauuucuagaaaagaucaacgggggagcggccagguuggaacauacggccucaacaccuucacgaauauggaagcccagcugauccgccaaauggagggggagggaaucuuuaaguccauucagcaucuuaccgcgacagaagagaucgccgugcagaacuggcuggcuagagucggccgggaacgccucucuagaauggccauuagcggggacgauugcgugguuaaaccgaucgacgaucgguucgcuuccgcccugaccgcgcuuaaugacaugggaaaggugagaaaagauauucagcaaugggagccuucucgcggcuggaacgacuggacacagguccccuuuugcagccaccacuuccaugaacuggugaugaaggaugggcggguccucgugguucccuguagaaaucaggacgagcugaucggccgcgcccggaucucccagggagcuggcuggucucugaaggagaccgccugccucgggaaaagcuaugcucaaauguggacacugauguacuuucacagacgcgaucuucggcuggccgcuaacgccauuuguuccgcggugccuagccauugggucccgaccucuagaacgacaugguccauccacgccaagcacgaauggaugaccaccgaggacaugcucgcuguguggaaccgcguguggauucaggaaaaucccuggauggaggauaaaacaccuguugaaagcugggaggaggugcccuaucugggaaagcgggaagaccaguggugcggcucucuuaucgggcugaccuccagagccacaugggccaaaaacauucagacggcuaucaaucaaguccgcagccucauuggaaacgagggcuacaccgacuauaugccuuccaugaagcgguucagacgggaagaggaagaggccggggugcugugguga

SEQ ID NO: 19561 - RNA, 9876 nt, Artificial Sequence
  derived and/or modified CDS sequence (opt5) from DENV-2__KP188549__SS-prME
accgccggcgugaucgucaugcugauucccacagcuauggccuuccaccucacgaccagaaacggggaaccucauaugaucguuggacggcaggaaaagggcaaaagccugcuuuuuaagacagaagacggggugaauaugugcacccugauggcgauugaucucggagaacugugugaggacacaaucaccuacaaaugcccgcuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggagggauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagauggugauucccaaaaacuucgccggaccggucagccagcacaacuaccgcccuggcuaucauacccaaacagcugggcccuggcaccuuggaaagcucgaaauggauuuugacuucugugagggcaccacggugguggucacagaagauugcgagaaacgggggcccucucugagaaccacaaccgccuccggaaagcugaucacagaguggugcugucggagcugcacccucccuccgcugcgcuacagaggcgaagacggcuguugguacgggauggagauucggccccuuaaggaaaaagaggaaaaucugguuaacucccucgugacggccggacauggccagaucgauaauuuuucucugggggugcugggaauggcucuuuuccucgaggagaugcugagaacccgcgucggcacaaagcacgcgauucugcucguggcccugagcuuuguuacccuuaucacagggaacauguccuuccgggaccugggaagagugauggucauggugggcgcuaccaugacggaugacaucggcauggggguuacauaucucgcccugcuggccgcuuuuaaagugcgcccuaccuucgccgcgggacuucugcucagaaagcugacaucuaaagaacucaugauggcuaccauuggcaucgcccugcuuagccaguccacccugcccgagacaauucucgaacugacggaugcccuggcucuugggaugauggcccugaagaucguccggaauauggagaaguaccaacucgcggugaccauuauggcuaucucuugcguuccuaacgccgugauccugcagaaugccuggaaagucagcuguacaauucucgcugccguguccgugagcccccugcuucugaccucuucccagcagaaggcugacuggaucccucucgcccugacaauuaaaggacugaaccccaccgcgaucuuucuuacgacacugagccgcaccucuaagaaaagauccuggccgcucaaugaagccauuauggcugucggcaugguuagcauccuggccucuucccuccugaagaacgacaucccuaugaccgggccccuuguggcuggaggccugcugacagugugcuauguccucaccggccggagcgccgaucuggagcuugagcgcgccgcugacgugaaaugggaagaucaagcggagauuuccgggagcucuccuauccugagcauuacaaucuccgaagacggaucuaugagcauuaagaaugaggaggaagaacagacgcucaccauccugauuagaacaggccuccugguuaucuccgggguguuccccgucucuaucccgauuaccgccgcugccugguaccuuugggaagugaagaaacagcgggccggaguucugugggaugugccuucucccccucccgucggcaaggcugagcuggaagacggggccuaucgcaucaaacagagagggauucucggcuacucccaaaucggcgcggggguguauaaggagggaacauuucacaccauguggcaugucacgcggggcgcugugcugaugcaccgcgggaaaagaauugagcccuccugggccgauguuaagaaggaccuuaucagcuacggaggcggguggaaacuggaaggagaguggaaggaaggcgaggaagugcagguccucgcccuggagccuggcaaaaacccgcgggcugugcagaccaagcccgggaucuucaaaacaaauaccggaacaauuggcgccguuucccucgauuuuagcccugggaccucuggaucccccaucguggacagaaagggcaaggucguggggcuguacggaaacggcgugguuacacgcagcggcgcguaugucucugcuauugcccagacggagaaauccaucgaagauaauccugagauugaagacgauaucuuccggaagaaaagacuuaccaucauggaccugcaucccggggccggaaagacaaaacgcuaccugccugcuauugugcgggaggccaucaagagaggccuccgcacccugauucuugcuccgacccggguggucgccgcggaaauggaggaggcccugagagggcuccccauccgcuaucaaacgccugcuauucgggccgaacacacgggaagagagaucguggaccugaugugucaugcuaccuucacaaugcggcuccugagccccguucgcgugccuaacuacaaccuuauuaucauggaugaagcccacuuuaccgaccccgccuccaucgcugcgagaggcuauauuucuacacgggucgagaugggggaggccgcuggcaucuucaugaccgccacgccgccuggaagccgcgaucccuuuccccaguccaaugccccuauuauggacgaagagagagaaauccccgagcggagcuggaacucuggccacgaaugggugacagauuucaaggggaaaaccguuugguuugugccuuccauuaaggcuggaaaugacaucgccgcgugccugcgcaagaauggcaagaaagucauccagcugagccgcaagaccuucgauucugaguacgugaagacacgggcuaaugacugggauuuuguugugaccacagacauuagcgagaugggggccaacuucaaagccgaaagagucaucgauccgcgccgguguaugaagcccgugauucucaccgacggagaggaaagagugauccuggcuggcccuaugcccgucacgcauuccucugccgcgcaacgccgggggagaauuggccgcaauccuaaaaacgagaaugaccaguauaucuacaugggagaaccccuugagaacgaugaggacugcgcccacuggaaggaagcuaaaaugcugcucgauaauaucaacacaccggagggcauuaucccuagcauguuugaacccgagagagaaaagguugacgccauugauggggaguaccggcugcgcggagaggcuagaaaaaccuucguggaccugaugcggcgcggcgaucucccuguguggcuugccuauaaggucgcugccgaagggaucaauuacgcggacagaaagugguguuuugauggaauuaaaaacaaucagauccuggaggaaaacguggagguugagauuuggacaaaggaaggcgagcggaaaaagcugaaacccagauggcucgacgcccgcaucuauuccgauccucuggcucuuaaggaguucaaggaguucgccgcugggcggaaaucucugacccucaaccugaucacggaaaugggcagacugcccaccuuuaugacacagaaggcccgcaaugcccucgacaaccuugcugugcugcauaccgcggaggucggaggcaaagccuacacacacgcucugagcgagcucccggaaacccuggagacacuucugcuccugacccugcucgccgccgugacagggggaauuuuccuuuuucugauguccggcaaggggaucggaaaaaugacacugggcaugugcugcauuaucaccgcuagcauucuccugugguaugcccaaauccagccucacuggaucgcggccucuauuauccuugaguucuuucugauuguucuccugauccccgagcccgaaaagcagcggaccccucaggauaaucaacugacauacguggucauugcuauccucaccguggucgccgcuacaauggccaacgagaugggcuuccuugagaagacgaaaaaggaccugggguuuggauccaucaccacacaggaaagcgaguccaauauucuggacaucgaucucagaccggcgucugccuggacccuguaugcuguggccacaaccuucguuacgcccaugcuucggcauagcauugaaaacuccucugugaaugugagccugaccgcuaucgccaaccaggcuacaguccucaugggccuggggaaaggauggccucuguccaagauggacauuggcguuccccuccuugccaucggguguuacagccaggugaauccuauuacccugacagcggcccugcuccugcuuguggcucacuacgccaucaucggacccggccugcaagcuaaagccacccgcgaggcccagaagagagcggcugccggcauuaugaagaacccuacggucgaugggaucacagugauugaccucgaaccgauccccuaugauccuaaauuugagaagcagcugggacagguuaugcugcucauucuuugcgugacccaaguccugaugaugcggacaaccugggcucugugugaggcccucacccuggccacaggccccaucucuacgcuuugggaagggaauccuggacgcuucuggaacaccacaaucgcuguguccauggccaauauuuuuagaggcagcuaccuggcgggggccggacuccuguucucuaucaugaaaaacaccacaaauacccggcgcggcacgggcaacgucggggagacacugggagaaaaguggaaauccagacucaaugcucuuggcaagagcgaguuucagauuuauaaaaagucugggauccaggagguggaccggacccuggccaaggaaggaauuaaacgcggcgagaccgaucaucacgcuguuagcagaggguccgccaagcugcggugguucguggaaagaaacauggucacacccgagggaaaagugguugaccucggcugcggccgcgggggauggucuuacuauuguggcgggcugaagaacgugcgggaagucaaaggacuuaccaagggcgggccgggacaugaggagccuauccccaugagcacauacggcuggaaucuggugagacuccaauccggcguggauguuuucuuuacgcccccugaaaagugcgacacccugcugugugauaucggggagagcucccccaacccuacaauugaagcgggacgcacccuccggguccuuaaucugguggagaacuggcugaauaacaauacacaguucugcaucaaagugcucaacccguauaugcccucugucauugaaaagauggagacccugcagagaaaauacggcggggcccuuguucgcaauccucugagccggaacuccacgcacgagauguacugggugucuaaugcuaccggaaacaucgugagcuccgucaauaugauuucuagaaugcucaucaaccgcuuuacaaugaagcacaaaaaggccaccuaugaacccgacguggaucugggcagcgggacacggaauaucggaauugaguccgaaaccccuaaccuggacaucauuggcaagagaaucgagaaaauuaagcaggaacaugagacaagcuggcacuacgaccaagaucaucccuauaaaaccugggcuuaccacggcucuuaugagacgaagcagacaggguccgccagcucuaugguuaacggagugguccgccuccuuaccaaaccgugggacgugguuccuauggugacccagauggcuaugacagauacgacccccuucggccagcaacgggucuuuaaggaaaagguggacacaagaacccaggagccuaaagaagggacaaagaaacugaugaagaucaccgccgaguggcuguggaaagagcucggaaaggagaagacaccccgcauguguaccagagaggaguucacgcggaaggugcgcuccaaugcggcccugggcgcugucuuuaccgaugagaacaaguggaaaagcgccagagaagcuguugaggacgggcgguucugggagcuuguggauagagaacggaaucugcaccucgagggaaagugcgaaacauguguguacaacaugaugggcaaacgcgagaagaaacugggcgaauuugggaaggccaagggaucuagagccauuugguauauguggcugggcgcgcgguuccucgaguuugaggcucugggguuccuuaaugaagaccauugguuuucccgcggaaacagccuguccggcgucgagggggaaggccuccacagacugggauacauccuucgggaggugggcaaaaaggaagggggagccauguacgccgaugacaccgcuggcugggauacacgcaucacccuggaggaccucaaaaaugaggaaaugguuacgaaccauaugaagggggagcacaaaaagcuggccgaagcuauuuucaagcugacauaucagaauaaaguggucagagugcagcggccuacccccagaggaacaguuauggacaucauuagcagaaaggaucaacggggcucuggacaggugggcaccuacggacucaacacguucaccaauauggaggcccagcugauccgccaaauggagggcgaagggauuuuuaaaagcauccagcaucuuacagcgaccgaggaaacagccguccagaacuggcuggcuagagugggacgggagcgccucuccagaauggccaucucuggcgacgauugcguugugaagccgauugacgaucgguucgcuagcgcccugaccgcgcuuaaugacauggggaaagucagaaaggauauccagcaaugggaaccuucccgcggauggaacgacuggacacaggugcccuuuugcucucaccacuuccaugagcuggucaugaaggauggccgggugcucguugugcccuguagaaaucaggacgagcugauugggcgcgcccggaucagccagggcgcuggauggucccugaaagaaaccgccugccucggcaagucuuaugcucaaauguggacgcugauguacuuucacagacgcgaucuucggcuggccgcuaacgccauuuguagcgcggucccuucccauugggugccgacaagcagaaccaccuggucuauccacgccaaacacgaguggaugacaaccgaagacaugcucgcuguguggaaccgcguuuggauccaggagaaucccuggauggaagauaagacaccuguggaguccugggaggaaguccccuaucuggggaaacgggaggaccaguggugcggaagccuuauuggccugacgucuagagccaccugggccaagaacauccagacagcuauuaaucaagugcgcucccucaucgggaacgaaggauacaccgacuauaugccuagcaugaagcgguucagacgggaggaagaggaggccggcguucugugguga

SEQ ID NO: 19562 - RNA, 9876 nt, Artificial Sequence
  derived and/or modified CDS sequence (opt5) from DENV-2__KP188550__SS-prME
acagccggagugaucgucaugcugauucccacaguuauggcuuuccaccucacgacccggaauggggagccucauaugaucgugggacggcaggaaaagggcaagagccugcuuuuuaagacagaggacggggugaauaugugcacccugauggccauugaucucggagaacugugugaggacacaaucaccuacaagugcccgcuucugcgccaaaaugaacccgaggauauugacuguuggugcaauagcacaucuaccugggucacguauggcaccuguacaaccacaggggagcacagacgggaaaagcgcagcguggcgcucguuccucaugugggaaugggccuggagaccagaacggaaacauggauguccucugagggcgcuuggaagcacguccagcggaucgagaccuggauccugcgccaucccggguucacaauuauggccgccauccucgcuuacaccauuggaaccacacacuuucagagagcccugaucuucauucuucugacggcuguggccccuagcaugaccaugcggugcaucggcauuuccaaccgcgauuuuguugaaggggugucuggaggcagcugggucgacaucgugcucgagcacggguccugugugacaaccauggcgaagaauaagcccacacuggauuucgaacuuaucaagaccgaggccaagcagccugcuacgcugagaaaauauugcauugaagccaagcucacaaacaccaccacagagagccgguguccgacccaaggagagcccucucugaaugaagaacaggacaaacgcuuuaucugcaagcauuccauggucgauagaggcuggggcaacggguguggacuguucggcaaagggggaauuguuacaugcgcuauguuuacgugcaaaaagaauauggaaggcaaaaucgugcagccugagaaccucgaauacaccauugugaucacaccccacagcggggaggagcaugccgucggaaaugacaccggcaagcacggcaaagaaaucaagauuacaccucagucuuccaccacggaggcggaacugaccggguauggaacagugaccauggaguguagcccccggacaggccuugauuucaacgaaaugguucugcuccaaauggaggacaaagccuggcuggugcaccgccagugguuucuugaucugccgcucccuuggcugcccggggcugacacccagggaucuaauuggauccagaaggagacgcuggucacauucaagaacccucaugccaaaaagcaagacgugguugugcucggcucccaggaaggggcuaugcacaccgcccugacaggcgccaccgagauucagaugagcuccggaaaucuucuguuuaccggccaucucaaaugcagacugcggauggauaaacuucaacugaaagggaugucuuacagcauguguacaggaaaguucaagaucgucaaagaaauugcugagacgcagcacggcaccaucgugaucagaguccaguaugagggggacggaucccccugcaagauucccuucgaaaucacagaucucgagaaacgccaugugcugggccggcugauuaccguuaacccuaucgugacagaaaaggacagcccggucaacauugaggcggaacccccuuuuggggauucuuacaucauugugggcguugagcccggacagcucaaacugaauugguucaagaagggcuccagcaucgggcaaauguuugagaccacgaugagaggagccaaacgcauggcuauccuuggcgacacagccugggauuucgggucucugggaggcguguuuaccagcauugggaaggcccuccaccaggucuucggcgcuaucuacggagccgcguuuuccggcgugucuuggaccaugaaaauucugaucggggugauuaucacauggaucggaaugaacagccgguccaccagccugucuguuucccuuguccucgugggcguggucacacuguaucugggggcuauggugcaggccgacagcggauguauuguuucuuggaagaauaaagaacucaagugcggcuccgggaucuucauuacggauaacgugcacaccuggacagagcaguacaaguuucaaccugaaagccccuccaaacuggccucugcuauccagaaggcccaugaggaaggcauuuguggaaucagaagcgucacccgccuugagaaucugauguggaaacagaucacaccggagcucaaccacauucuguccgaaaaugaggugaagcugaccaucaugacgggcgacauuaaagggaucaugcaggcuggaaagcggucucuuagaccucaacccaccgaacucaaauauagcuggaagacauggggcaaggccaaaaugcuguccaccgagagccauaaccagacauuccugauugaugggccugaaaccgcggagugccccaauacaaaccgcgccuggaacucucucgagguugaagacuacggauuuggcguguucaccacgaacaucuggcugaaacuucgggagaaacaggacgucuuuugugauuccaagcugaugagcgcugccaucaaagacaauagagcugugcacgccgauaugggcuauuggauugaaucugcgcucaacgacacauggaagauggagaaggccuccuucaucgagguuaaaagcugccacuggccuaagucucauacccuguggagcaauggggugcuggaauccgagaugauuauccccaaaaacuucgcuggaccggucagccagcacaacuaccgcccuggcuaucauacccaaacagccgggcccuggcaccuuggaaagcucgaaauggauuuugacuucugugagggcaccacggugguggucacagaagauugcgggaaucggggacccucucugagaaccacaaccgcuuccggcaaacugauuacagaguggugcugucggagcugcacccucccuccgcugcgcuacagaggcgaggacggguguugguacggaauggaaauccggccccuuaaggagaaggaagagaaccugguuaauucccucgugacggccggccaugggcagauugauaacuuuucucugggagugcugggcauggcccuuuuccucgaagagaugcugagaacccgcgucgggacaaaacacgcuauccugcucguggcgcugagcuuuguuacccuuaucacaggaaauauguccuuccgggaccugggcagagugauggucauggugggcgccaccaugacggaugacauugggaugggaguuacauaucucgcucugcuggccgccuuuaaggugcgcccuaccuucgcugccggccuucugcucagaaaacugacaucuaaggagcucaugauggcgaccaucgggauugcucugcuuagccaguccacccugcccgaaacaauccucgagcugacggaugcccuggcccuuggaaugauggcucugaaaauuguccggaacauggaaaaguaccaacucgccgugaccaucauggcgaucucuugcguuccuaaugcugugauucugcagaacgccuggaaggucagcuguacaauccucgccgcuguguccgugagcccccugcuucugaccucuucccagcagaaagccgacuggauuccucucgcucugacaaucaagggccugaaucccaccgccauuuuucuuacgacacugagccgcaccucuaaaaagagauccuggccgcucaacgaggcgaucauggccgucgggaugguuagcauccuggcuucuucccuccugaaaaaugacauuccuaugaccggaccccuuguggccggcggccugcugacagugugcuauguccucaccgggcggagcgcugaucuggaacuugagcgcgccgccgacgugaagugggaggaucaagcugaaaucuccggaagcucuccuauucugagcaucacaauuuccgaggacggcucuaugagcaucaaaaacgaagaggaggaacagacgcucaccauucugaucagaacagggcuccugguuaucuccggaguguuccccgucucuauuccgaucaccgcggccgcuugguaccuuugggaggugaagaagcagcgggccggcguucugugggaugugccuucucccccucccgucgggaaagccgaacuggaggacggagcuuaucgcauuaagcagagaggcauccucggcuacucccaaauuggggccggaguguauaaagaaggcacauuucacaccauguggcaugucacgagaggggcggugcugaugcaccgcggaaagagaaucgagcccuccugggcugauguuaaaaaggaccuuaucagcuacggcgggggauggaagcuggagggcgaauggaaagagggcgaagaggugcagguccucgcccuggaaccugggaagaauccgcgggccgugcagaccaaacccggaauuuucaagacaaacaccggcacaaucggggcuguuucccucgauuuuagcccuggaaccucuggcucccccauuguggacagaaaagggaaggucgugggacuguacggcaauggcgugguuacacgcagcggggccuaugucucugcgaucgcucagacggagaaguccauugaggauaacccugaaaucgaggacgauaucuuccggaaaaagagacuuaccauuauggaccugcaucccggagccggcaaaacaaagcgcuaccugccugccaucgugcgggaagcuauuaaaagagggcuccgcacccugauccuugccccgacccggguggucgcugccgagauggaagaggcgcugagaggacuccccauucgcuaucaaaccccugccauccgggcugagcacacgggcagagaaauuguggaccugaugugucaugccaccuucacaaugcggcuccugagccccguucgcgugccuaacuacaaucuuaucaucauggaugaggcucacuuuaccgaccccgccuccauugccgcuagaggguauaucucuacacgggucgaaaugggcgaggcggccggaauuuucaugaccgcuacgccgccuggcagccgcgaucccuuuccccaguccaacgccccuaucauggacgaggaaagagagauucccgaacggagcuggaacucugggcacgagugggugacagauuucaagggaaagaccguuugguuugugccuuccaucaaagccggcaacgacaucgcugccugccugagaaagaaugggaaaaaggucauucagcugagccgcaaaaccuucgauucugaauacgugaagacacgggcgaacgacugggauuuuguugugaccacagacaucagcgagaugggagcuaauuucaaggccgagagagucauugauccgcgccgguguaugaaacccgugauccucaccgacggcgaagagagagugauucuggccgggccuaugcccgucacgcauuccucugcugcccaacgccggggcagaaucggacgcaacccuaagaaugaaaacgaccaguauaucuacaugggcgagccccuugaaaaugaugaggacugcgcgcacuggaaagaggccaagaugcugcucgauaacauuaauacaccggaagggaucauuccuagcauguuugagcccgaaagagagaaaguugacgcuaucgauggagaauaccggcugcgcggcgaggccagaaagaccuucguggaccugaugcggcgcggggaucucccuguguggcuugcuuauaaagucgccgcugagggaauuaacuacgccgacagaaagugguguuuugauggcaucaagaauaaccagauucuggaagagaacguggaaguugagaucuggacaaaagagggggaacggaagaaacugaagcccagauggcucgacgcgcgcaucuauuccgauccucuggcccuuaaagaguucaaggaguucgcugccggccggaagucucugacccucaaucugauuacggagaugggaagacugcccaccuuuaugacacagaaagcucgcaacgcccucgacaaucuugccgugcugcauaccgcugaagucggcgggcgggcgcacacacacgcccugagcgagcucccggagacccuggaaacacuucugcuccugacccugcucgcuacggugacaggaggcaucuuccuuuuucugauguccgggaagggaauuggcaaaaugacccugggcaugugcugcaucauuaccgccagcauccuccugugguacgcccaaauccagccucauuggauugcugccucuaucauucuugaguucuuucugaucguucuccugauucccgaacccgagaagcagagaacaccucaggauaaccaacugaccuauguggucaucgcgauccucacaguggucgccgcuacgauggccaaugaaaugggguuccuugagaaaaccaagaaggaccugggauuuggcacaauuaccacacaggaguccgaaagcaacauccuggacauugaucuccggccggcuuccgccuggacccuguacgcgguggccacgaccuucguuacacccaugcuucgccacucuaucgagaauagcuccgugaacgugucucugaccgcuauugccaaucaggcuacaguccucauggggcugggaaaaggcuggccucugagcaagauggacaucgggguuccccuccuugccauuggauguuauucccaggugaacccuaucacccugacggcugcccugcuccugcuuguggcgcauuacgccaucauuggccccggccugcaagcuaaagccacaagagaagcucagaagcgggccgccgcggggaucaugaaaaauccuaccgucgauggaauuacagugaucgaccucgagccgauucccuacgauccuaaguuugaaaagcagcugggccagguuaugcugcucauccuuugcgugacccaaguccugaugaugcgcaccacaugggcucugugugaggcccucacgcuggcuaccgggcccaucagcacacuuugggagggaaacccuggcagauucuggaauaccacaauugccgugucuauggccaacaucuuucggggguccuaucuggcuggagccggccuccuguucagcauuaugaaaaauaccacgaacacacgcagaggcaccgggaaugucggagaaacccugggcgagaaguggaaaucucggcucaacgcgcuugggaaguccgaauuucagaucuacaaaaagagcggcauucaggagguggaccgcacacuggccaaagagggcaucaagagaggggaaaccgaucaccaugcuguuucucggggaagcgccaagcugagaugguucguggagcgcaacauggucacacccgaaggcaaagugguugaccucggcugcgggcggggaggcugguccuauuacugugggggacugaagaaugugagagaggucaaaggccuuacgaaagggggaccgggccacgaagaaccuauccccaugucuaccuauggcuggaaccuggugcgccuccaaagcgggguggauguuuucuuuacacccccugagaaaugcgacacccugcugugugauauuggagaauccagccccaauccuacaaucgaggcuggccggacccucagaguccuuaaccugguggaaaauuggcugaacaauaacacgcaguucugcauuaaggugcucaauccguacaugcccuccgucaucgagaagauggaaacccugcagcgcaaauaugggggagcccuuguucggaacccucugucuagaaauagcacacacgagauguacuggguguccaacgcgaccggcaauauugugucuagcgucaacaugaucucccgcaugcucaucaaucgguuuacaaugaagcauaaaaaggccaccuacgagcccgacguggaucuggggucuggaacaagaaacauuggcaucgaaagcgagauuccuaaccuggacaucauuggcaaacgcaucgaaaagauuaagcaggagcacgaaaccuccuggcauuaugaccaagaucaccccuacaaaacgugggcuuaucacgggagcuacgagacaaagcagaccggaucugccuccagcaugguuaauggcgugguccggcuccuuaccaaaccgugggacgugguuccuauggugacacagauggcuaugacggauaccacacccuucgggcagcaaagagucuuuaaggagaaaguggacacccgcacacaggaaccuaaggagggaaccaagaaacugaugaagaucacagccaaauggcuguggaaggaacucggcaaagagaagacccccagaauguguacgcgggaggaguucacccgcaaagugagaucuaacgcugcccugggggcgaucuuuacagaugagaauaaguggaaguccgcccgggaagcugucgaggacggaagauucugggaacuuguugaucgggagcgcaaccugcaucucgagggcaaaugcgaaaccuguguguauaauaugaugggcaagagagagaaaaagcugggggaauuuggaaaagccaagggcagccgggcuauuugguacauguggcugggggcccgcuuccucgaguuugaagcccugggauuccuuaacgaggaccacugguuuucuagaggcaauucccugagcgggguggagggcgaaggacuccaucggcugggcuauauccuucgcgaggucgggaagaaagaaggaggcgcgauguacgcugaugacacagccgggugggauaccagaauuacgcuggaggaccucaagaacgaagagauggugacaaaucacaugaaaggagagcauaagaaacuggccgaagcuaucuucaagcugaccuaccagaacaagguugugcggguccagcgcccuacacccagaggcaccgugauggacauuaucucccggaaagaucaacgcgggagcggccagguuggaacguauggccucaauaccuucacaaacauggaggcccagcugaucagacaaauggaaggggagggaauuuuuaagaauauccagcaccuuaccgcuacagaggaaauugccgugcagaacuggcuggcgcgggucggccgcgagagacucucucggauggccaucagcggggacgauugcgugguuaaaccgauugacgauagauucgcuuccgcccugaccgcucuuaaugacaugggaaaggugcgcaaagauauccagcaaugggaaccuucucggggcuggaacgacuggacacagguccccuuuugcagccaccauuuccacgagcuggugaugaaggaugggagaguccucgugguucccugucgcaaccaggacgaacugaucggccgggccagaauuucccagggagcgggcuggucucugaaggagaccgccugccucgggaaaagcuacgcucaaauguggacgcugauguauuuucaucgccgggaucuuagacuggccgcuaaugccaucuguuccgcugugccuucucacugggucccgacaagccgcaccaccugguccauucacgccaagcaugaguggaugacaaccgaagacaugcucgcgguguggaaccggguguggauccaggagaaucccuggauggaagauaaaacaccuguugagagcugggaagaggugcccuaccugggaaagagagaggaccaguggugcggcucucuuauugggcugacgucccgcgccaccugggcuaaaaacauccagacagccauuaaucaaguccggagccucaucggaaacgaaggcuauaccgacuacaugccuucuaugaagagauuccggagagaggaagaggaagccggggugcugugguga

SEQ ID NO: 19563 - RNA, 9876 nt, Artificial Sequence
  derived and/or modified CDS sequence (opt5) from DENV-2__KP188553__SS-prME
accgccggcgugaucgucaugcugauucccacagcuauggccuuccaccucacgaccagaaacggggaaccucauaugaucguuggacggcaggaaaagggcaaaagccugcuuuuuaagacagaagacggggugaauaugugcacccugauggcgauugaucucggagaacugugugaggacacaaucaccuacaaaugcccgcuucugagacaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagauggugauucccaaaaacuucgccggaccggucagccagcacaacuaccgcccuggcuaucauacccaaacagcugggcccuggcaccuuggaaagcucgaaauggauuuugacuucugugagggcaccacggugguggucacagaagauugcgagaaacgggggcccucucugagaaccacaaccgccuccggaaagcugaucacagaguggugcugucggagcugcacccucccuccgcugcgcuacagaggcgaagacggcuguugguacgggauggagauucggccccuuaaggaaaaagaggaaaaucugguuaacucccucgugacggccggacauggccagaucgauaauuuuucucugggggugcugggaauggcucuuuuccucgaggagaugcugagaacccgcgucggcacaaagcacgcgauucugcucguggcccugagcuuuguuacccuuaucacagggaacauguccuuccgggaccugggaagagugauggucauggugggcgcuaccaugacggaugacaucggcauggggguuacauaucucgcccugcuggccgcuuuuaaagugcgcccuaccuucgccgcgggacuucugcucagaaagcugacaucuaaagaacucaugauggcuaccauuggcaucgcccugcuuagccaguccacccugcccgagacaauucucgaacugacggaugcccuggcucuugggaugauggcccugaagaucguccggaauauggagaaguaccaacucgcggugaccauuauggcuaucucuugcguuccuaacgccgugauccugcagaaugccuggaaagucagcuguacaauucucgcugccguguccgugagcccccugcuucugaccucuucccagcagaaggcugacuggaucccucucgcccugacaauuaaaggacugaaccccaccgcgaucuuucuuacgacacugagccgcaccucuaagaaaagauccuggccgcucaaugaagccauuauggcugucggcaugguuagcauccuggccucuucccuccugaagaacgacaucccuaugaccgggccccuuguggcuggaggccugcugacagugugcuauguccucaccggccggagcgccgaucuggagcuugagcgcgccgcugacgugaaaugggaagaucaagcggagauuuccgggagcucuccuauccugagcauuacaaucuccgaagacggaucuaugagcauuaagaaugaggaggaagaacagacgcucaccauccugauuagaacaggccuccugguuaucuccgggguguuccccgucucuaucccgauuaccgccgcugccugguaccuuugggaagugaagaaacagcgggccggaguucugugggaugugccuucucccccucccgucggcaaggcugagcuggaagacggggccuaucgcaucaaacagagaggcauucucggauacucccaaaucggcgcggggguguauaaggagggaacauuucacaccauguggcaugucacgcggggcgcugugcugaugcaccgcgggaaaagaauugagcccuccugggccgauguuaagaaggaccuuaucagcuacggaggcggguggaaacuggaaggagaguggaaggaaggcgaggaagugcagguccucgcccuggagccuggcaaaaacccgcgggcugugcagaccaagcccgggaucuucaaaacaaauaccggaacaauuggcgccguuucccucgauuuuagcccugggaccucuggaucccccaucguggacagaaagggcaaggucguggggcuguacggaaacggcgugguuacacgcagcggcgcguaugucucugcuauugcccagacggagaaauccaucgaagauaauccugagauugaagacgauaucuuccggaagaaaagacuuaccaucauggaccugcaucccggggccggaaagacaaaacgcuaccugccugcuauugugcgggaggccaucaagagaggccuccgcacccugauucuugcuccgacccggguggucgccgcggaaauggaggaggcccugagagggcuccccauccgcuaucaaacgccugcuauucgggccgaacacacgggaagagagaucguggaccugaugugucaugcuaccuucacaaugcggcuccugagccccguucgcgugccuaacuacaaccuuauuaucauggaugaagcccacuuuaccgaccccgccuccaucgcugcgagaggcuauauuucuacacgggucgagaugggggaggccgcuggcaucuucaugaccgccacgccgccuggaagccgcgaucccuuuccccaguccaaugccccuauuauggacgaagagagagaaauccccgagcggagcuggaacucuggccacgaaugggugacagauuucaaggggaaaaccguuugguuugugccuuccauuaaggcuggaaaugacaucgccgcgugccugcgcaagaauggcaagaaagucaucccguacagccgcaagaccuucgauucugaguaugugaagacacgggcuaaugacugggauuuuguugugaccacagacauuagcgagaugggggccaacuucaaagccgaaagagucaucgauccccgccgguguaugaagccugugauucugaccgacggagaggaaagagugauccucgcuggccccaugccugucacgcauuccucugccgcgcagcgccgggggagaauuggccgcaaucccaaaaacgagaaugaccaauacaucuacaugggagaaccgcuggagaacgaugaggacugcgcccacuggaaggaagcuaaaaugcuucuggauaauaucaacacaccugagggcauuauccccagcauguuugaaccugagagagaaaagguugacgccauugauggggaguaucggcuccgcggagaggcuagaaaaaccuucguggaccugaugcggcgcggcgaucugcccguguggcucgccuacaaggucgcugccgaagggaucaauuaugcggacagaaagugguguuuugauggaauuaaaaacaaucagauccuugaggaaaacguggagguugagauuuggacaaaggaaggcgagcggaaaaagcugaaaccuagauggcuggacgcccgcaucuacuccgauccccucgcucugaaggaguucaaggaguucgccgcugggcggaaaucucuuacccugaaccucaucacggaaaugggcagacugccgaccuuuaugacacagaaggcccgcaaugcccuggacaaccucgcugugcuucauaccgcggaggucggaggcaaagccuauacacacgcucugagcgagcugccugaaacccucgagacacugcuucugcucacccugcuggccgccgugacagggggaauuuuccucuuucuuauguccggcaaggggaucggaaaaaugacacugggcaugugcugcauuaucaccgcuagcauucugcucugguacgcccagauccaaccccacuggaucgcggccucuauuauccuggaguucuuucuuauuguucugcucauccccgagccugaaaagcagcggaccccgcaggauaaucagcugacauauguggucauugcuauccugaccguggucgccgcuacaauggccaacgagaugggcuuccucgagaagacgaaaaaggaccuuggguuuggauccaucaccacacaagaaagcgaguccaauauucuggacaucgaucugagacccgcgucugccuggacccucuacgcuguggccacaaccuucguuacgccuaugcugcggcauagcauugaaaacuccucugugaaugugagccuuaccgcuaucgccaaccaggcuacaguccugaugggccucgggaaaggauggccccuguccaagauggacauuggcguuccucugcucgccaucggguguuacagccaggugaaucccauuacccuuacagcggcccugcugcuccugguggcucacuaugccaucaucggaccuggccuucaggcuaaagccacccgcgaggcccaaaagagagcggcugccggcauuaugaagaacccgacggucgaugggaucacagugauugaccuggaacccaucccuuacgaucccaaauuugagaagcagcucggacagguuaugcugcugauucucugcgugacccagguccuuaugaugcggacaaccugggcucugugugaggcccugacccucgccacaggcccuaucucuacgcugugggaagggaaucccggacgcuucuggaacaccacaaucgcuguguccauggccaauauuuuuagaggcagcuaucuugcgggggccggacuccuguucucuaucaugaaaaacaccacaaauacccggcgcggcacgggcaacgucggggagacacugggagaaaaguggaaauccagacugaaugcucucggcaagagcgaguuucaaauuuacaaaaagucugggauccaggagguggaccggacccuugccaaggaaggaauuaaacgcggcgagaccgaucaucacgcuguuagcagaggguccgccaagcugcggugguucguggaaagaaacauggucacaccggagggaaaagugguugaccugggcugcggccgcgggggauggucuuauuacuguggcgggcucaagaacgugcgggaagucaaaggacugaccaagggcgggccuggacaugaggagcccauccccaugagcacauauggcuggaaucuugugagacugcaguccggcguggauguuuucuuuacgccucccgaaaagugcgacacccuccugugugauaucggggagagcuccccuaacccgacaauugaagcgggacgcacccugcggguccucaaucuuguggagaacuggcugaauaacaauacacaauucugcaucaaagugcugaaccccuacaugccuucugucauugaaaagauggagacccuccagagaaaauacggcggggcccugguucgcaauccccuuagccggaacuccacgcacgagauguauugggugucuaaugcuaccggaaacaucgugagcuccgucaauaugauuucuagaaugcugaucaaccgcuuuacaaugaagcacaaaaaggccaccuacgaaccugacguggaucucggcagcgggacacggaauaucggaauugaguccgaaacccccaaccuggacaucauuggcaagagaaucgagaaaauuaagcaggaacaugagacaagcuggcacuaugaccaggaucauccguacaaaaccugggcuuaucacggcucuuacgagacgaagcaaacaggguccgccagcucuaugguuaacggagugguccgccugcucaccaaaccuugggacgugguucccauggugacccagauggcuaugacagauacgaccccuuucggccagcagcgggucuuuaaggaaaagguggacacaagaacccaagagcccaaagaagggacaaagaaacuuaugaagaucaccgccgaguggcuguggaaagagcugggaaaggagaagacaccucgcauguguaccagagaggaguucacgcggaaggugcgcuccaaugcggcccucggcgcugucuuuaccgaugagaacaaguggaaaagcgccagagaagcuguugaggacgggcgguucugggagcugguggauagagaacggaaucuucaccuggagggaaagugcgaaacauguguguauaacaugaugggcaaacgcgagaagaaacucggcgaauuugggaaggccaagggaucuagagccauuugguacauguggcugggcgcgcgguuccuggaguuugaggcucucggguuccugaaugaagaccauugguuuucccgcggaaacagccuuuccggcgucgagggggaaggccugcacagacucggauacauccugcgggaggugggcaaaaaggaagggggagccauguaugccgaugacaccgcuggcugggauacacgcaucacccuugaggaccugaaaaaugaggaaaugguuacgaaccauaugaagggggagcacaaaaagcucgccgaagcuauuuucaagcugacauaccagaauaaaguggucagagugcagcggcccaccccgcgcggaacaguuauggacaucauuagcagaaaggaucagcggggcucugggcaagugggcaccuauggacugaacacguucaccaauauggaggcccagcucauccgccagauggagggcgaagggauuuuuaaaagcauccaacaucugacagcgaccgaggaaacagccguccagaacuggcuugcuagagugggacgggagcgccuguccagaauggccaucucuggcgacgauugcguugugaagccuauugacgaucgguucgcuagcgcccucaccgcgcugaaugacauggggaaagucagaaaggauauccagcagugggaacccucccgcggauggaacgacuggacacaagugcccuuuugcucucaccacuuccaugagcuugucaugaaggauggccgggugcugguugugccuuguagaaaucaggacgagcucauugggcgcgcccggaucagccagggcgcuggauggucccugaaagaaaccgccugccugggcaagucuuacgcucagauguggacgcucauguauuuucacagacgcgaucugcggcuugccgcuaacgccauuuguagcgcggucccgucccauugggugcccacaagcagaaccaccuggucuauccacgccaaacacgaguggaugacaaccgaagacaugcuggcuguguggaaccgcguuuggauccaagagaauccuuggauggaagauaagacacccguggaguccugggaggaagucccuuaccucgggaaacgggaggaccaguggugcggaagccugauuggccuuacgucuagagccaccugggccaagaacauccagacagcuauuaaucaggugcgcucccugaucgggaacgaaggauauaccgacuacaugcccagcaugaagcgguucagacgggaggaagaggaggccggcguucucugguga

SEQ ID NO: 19564 - RNA, 9876 nt, Artificial Sequence
  derived and/or modified CDS sequence (opt5) from DENV-2__KP188556__SS-prME
accgccggcgugaucgucaugcugauucccacagcuauggccuuccaccucacgaccagaaacggggaaccucauaugaucguuggacggcaggaaaagggcaaaagccugcuuuuuaagacagaagacggggugaauaugugcacccugauggcgauugaucucggagaacugugugaggacacaaucaccuacaaaugcccgcuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggagggauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagauggugauucccaaaaacuucgccggaccggucagccagcacaacuaccgcccuggcuaucauacccaaacagcugggcccuggcaccuuggaaagcucgaaauggauuuugacuucugugagggcaccacggugguggucacagaagauugcgagaaacgggggcccucucugagaaccacaaccgccuccggaaagcugaucacagaguggugcugucggagcugcacccucccuccgcugcgcuacagaggcgaagacggcuguugguacgggauggagauucggccccuuaaggaaaaagaggaaaaucugguuaacucccucgugacggccggacauggccagaucgauaauuuuucucugggggugcugggaauggcucuuuuccucgaggagaugcugagaacccgcgucggcacaaagcacgcgauucugcucguggcccugagcuuuguuacccuuaucacagggaacauguccuuccgggaccugggaagagugauggucauggugggcgcuaccaugacggaugacaucggcauggggguuacauaucucgcccugcuggccgcuuuuaaagugcgcccuaccuucgccgcgggacuucugcucagaaagcugacaucuaaagaacucaugauggcuaccauuggcaucgcccugcuuagccaguccacccugcccgagacaauucucgaacugacggaugcccuggcucuugggaugauggcccugaagaucguccggaauauggagaaguaccaacucgcggugaccauuauggcuaucucuugcguuccuaacgccgugauccugcagaaugccuggaaagucagcuguacaauucucgcugccguguccgugagcccccugcuucugaccucuucccagcagaaggcugacuggaucccucucgcccugacaauuaaaggacugaaccccaccgcgaucuuucuuacgacacugagccgcaccucuaagaaaagauccuggccgcucaaugaagccauuauggcugucggcaugguuagcauccuggccucuucccuccugaagaacgacaucccuaugaccgggccccuuguggcuggaggccugcugacagugugcuauguccucaccggccggagcgccgaucuggagcuugagcgcgccgcugacgugaaaugggaagaucaagcggagauuuccgggagcucuccuauccugagcauuacaaucuccgaagacggaucuaugagcauuaagaaugaggaggaagaacagacgcucaccauccugauuagaacaggccuccugguuaucuccgggguguuccccgucucuaucccgauuaccgccgcugccugguaccuuugggaagugaagaaacagcgggccggaguucugugggaugugccuucucccccucccgucggcaaggcugagcuggaagacggggccuaucgcaucaaacagagagggauucucggcuacucccaaaucggcgcggggguguauaaggagggaacauuucacaccauguggcaugucacgcggggcgcugugcugaugcaccgcgggaaaagaauugagcccuccugggccgauguuaagaaggaccuuaucagcuacggaggcggguggaaacuggaaggagaguggaaggaaggcgaggaagugcagguccucgcccuggagccuggcaaaaacccgcgggcugugcagaccaagcccgggaucuucaaaacaaauaccggaacaauuggcgccguuucccucgauuuuagcccugggaccucuggaucccccaucguggacagaaagggcaaggucguggggcuguacggaaacggcgugguuacacgcagcggcgcguaugucucugcuauugcccagacggagaaauccaucgaagauaauccugagauugaagacgauaucuuccggaagaaaagacuuaccaucauggaccugcaucccggggccggaaagacaaaacgcuaccugccugcuauugugcgggaggccaucaagagaggccuccgcacccugauucuugcuccgacccggguggucgccgcggaaauggaggaggcccugagagggcuccccauccgcuaucaaacgccugcuauucgggccgaacacacgggaagagagaucguggaccugaugugucaugcuaccuucacaaugcggcuccugagccccguucgcgugccuaacuacaaccuuauuaucauggaugaagcccacuuuaccgaccccgccuccaucgcugcgagaggcuauauuucuacacgggucgagaugggggaggccgcuggcaucuucaugaccgccacgccgccuggaagccgcgaucccuuuccccaguccaaugccccuauuauggacgaagagagagaaauccccgagcggagcuggaacucuggccacgaaugggugacagauuucaaggggaaaaccguuugguuugugccuuccauuaaggcuggaaaugacaucgccgcgugccugcgcaagaauggcaagaaagucauccagcugagccgcaagaccuucgauucugaguacgugaagacacgggcuaaugacugggauuuuguugugaccacagacauuagcgagaugggggccaacuucaaagccgaaagagucaucgauccgcgccgguguaugaagcccgugauucucaccgacggagaggaaagagugauccuggcuggcccuaugcccgucacgcauuccucugccgcgcaacgccgggggagaauuggccgcaauccuaaaaacgagaaugaccaguauaucuacaugggagaaccccuugagaacgaugaggacugcgcccacuggaaggaagcuaaaaugcugcucgauaauaucaacacaccggagggcauuaucccuagcauguuugaacccgagagagaaaagguugacgccauugauggggaguaccggcugcgcggagaggcuagaaaaaccuucguggaccugaugcggcgcggcgaucucccuguguggcuugccuauaaggucgcugccgaagggaucaauuacgcggacagaaagugguguuuugauggaauuaaaaacaaucagauccuggaggaaaacguggagguugagauuuggacaaaggaaggcgagcggaaaaagcugaaacccagauggcucgacgcccgcaucuauuccgauccucuggcucuuaaggaguucaaggaguucgccgcugggcggaaaucucugacccucaaccugaucacggaaaugggcagacugcccaccuuuaugacacagaaggcccgcaaugcccucgacaaccuugcugugcugcauaccgcggaggucggaggcaaagccuacacacacgcucugagcgagcucccggaaacccuggagacacuucugcuccugacccugcucgccgccgugacagggggaauuuuccuuuuucugauguccggcaaggggaucggaaaaaugacacugggcaugugcugcauuaucaccgcuagcauucuccugugguaugcccaaauccagccucacuggaucgcggccucuauuauccuugaguucuuucugauuguucuccugauccccgagcccgaaaagcagcggaccccucaggauaaucaacugacauacguggucauugcuauccucaccguggucgccgcuacaauggccaacgagaugggcuuccuugagaagacgaaaaaggaccugggguuuggauccaucaccacacaggaaagcgaguccaauauucuggacaucgaucucagaccggcgucugccuggacccuguaugcuguggccacaaccuucguuacgcccaugcuucggcauagcauugaaaacuccucugugaaugugagccugaccgcuaucgccaaccaggcuacaguccucaugggccuggggaaaggauggccucuguccaagauggacauuggcguuccccuccuugccaucggguguuacagccaggugaauccuauuacccugacagcggcccugcuccugcuuguggcucacuacgccaucaucggacccggccugcaagcuaaagccacccgcgaggcccagaagagagcggcugccggcauuaugaagaacccuacggucgaugggaucacagugauugaccucgaaccgaucccccaugauccuaaauuugagaagcagcugggacagguuaugcugcucauucuuugcgugacccaaguccugaugaugcggacaaccugggcucugugugaggcccucacccuggccacaggccccaucucuacgcuuugggaagggaauccuggacgcuucuggaacaccacaaucgcuguguccauggccaauauuuuuagaggcagcuaucuggcgggggccggacuccuguucucuaucaugaaaaacaccacaaauacccggcgcggcacgggcaacgucggggagacacugggagaaaaguggaaauccagacucaaugcucuuggcaagagcgaguuucagauuuacaaaaagucugggauccaggagguggaccggacccuggccaaggaaggaauuaaacgcggcgagaccgaucaccaugcuguuagcagaggguccgccaagcugcggugguucguggaaagaaacauggucacacccgagggaaaagugguugaccucggcugcggccgcgggggauggucuuauuacuguggcgggcugaagaacgugcgggaagucaaaggacuuaccaagggcgggccgggacacgaggagccuauccccaugagcacauauggcuggaaucuggugagacuccaauccggcguggauguuuucuuuacgcccccugaaaagugcgacacccugcugugugauaucggggagagcucccccaacccuacaauugaagcgggacgcacccuccggguccuuaaucugguggagaacuggcugaauaacaauacacaguucugcaucaaagugcucaacccguacaugcccucugucauugaaaagauggagacccugcagagaaaauauggcggggcccuuguucgcaauccucugagccggaacuccacgcacgagauguacugggugucuaaugcuaccggaaacaucgugagcuccgucaauaugauuucuagaaugcucaucaaccgcuuuacaaugaagcauaaaaaggccaccuacgaacccgacguggaucugggcagcgggacacggaauaucggaauugaguccgaaaccccuaaccuggacaucauuggcaagagaaucgagaaaauuaagcaggaacacgagacaagcuggcauuaugaccaagaucaccccuacaaaaccugggcuuaucacggcucuuacgagacgaagcagacaggguccgccagcucuaugguuaacggagugguccgccuccuuaccaaaccgugggacgugguuccuauggugacccagauggcuaugacagauacgacccccuucggccagcaacgggucuuuaaggaaaagguggacacaagaacccaggagccuaaagaagggacaaagaaacugaugaagaucaccgccgaguggcuguggaaagagcucggaaaggagaagacaccccgcauguguaccagagaggaguucacgcggaaggugcgcuccaaugcggcccugggcgcugucuuuaccgaugagaacaaguggaaaagcgccagagaagcuguugaggacgggcgguucugggagcuuguggauagagaacggaaucugcaucucgagggaaagugcgaaacauguguguauaacaugaugggcaaacgcgagaagaaacugggcgaauuugggaaggccaagggaucuagagccauuugguacauguggcugggcgcgcgguuccucgaguuugaggcucugggguuccuuaaugaagaccacugguuuucccgcggaaacagccuguccggcgucgagggggaaggccuccauagacugggauauauccuucgggaggugggcaaaaaggaagggggagccauguacgccgaugacaccgcuggcugggauacacgcaucacccuggaggaccucaaaaaugaggaaaugguuacgaaccacaugaagggggagcauaaaaagcuggccgaagcuauuuucaagcugacauaccagaauaaaguggucagagugcagcggccuacccccagaggaacaguuauggacaucauuagcagaaaggaucaacggggcucuggacaggugggcaccuauggacucaacacguucaccaauauggaggcccagcugauccgccaaauggagggcgaagggauuuuuaaaagcauccagcaccuuacagcgaccgaggaaacagccguccagaacuggcuggcuagagugggacgggagcgccucuccagaauggccaucucuggcgacgauugcguugugaagccgauugacgaucgguucgcuagcgcccugaccgcgcuuaaugacauggggaaagucagaaaggauauccagcaaugggaaccuucccgcggauggaacgacuggacacaggugcccuuuugcucucaccauuuccacgagcuggucaugaaggauggccgggugcucguugugcccuguagaaaucaggacgagcugauugggcgcgcccggaucagccagggcgcuggauggucccugaaagaaaccgccugccucggcaagucuuacgcucaaauguggacgcugauguauuuucauagacgcgaucuucggcuggccgcuaacgccauuuguagcgcggucccuucccacugggugccgacaagcagaaccaccuggucuauccacgccaaacaugaguggaugacaaccgaagacaugcucgcuguguggaaccgcguuuggauccaggagaaucccuggauggaagauaagacaccuguggaguccugggaggaaguccccuaccuggggaaacgggaggaccaguggugcggaagccuuauuggccugacgucuagagccaccugggccaagaacauccagacagcuauuaaucaagugcgcucccucaucgggaacgaaggauauaccgacuacaugccuagcaugaagcgguucagacgggaggaagaggaggccggcguucugugguga

SEQ ID NO: 19565 - RNA, 9876 nt, Artificial Sequence
  derived and/or modified CDS sequence (opt5) from DENV-2__GU369819__SS-prME
acagccggagugaucgucaugcugauucccacagcuauggccuuccaccucacgacccggaacggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggagaauaaggcuuggcuggugcaccgccagugguuucuugaccugccgcucccuuggcugcccggggccgauacacagggaucuaacuggauccagaaggagacccuggucacguucaagaauccucaugcuaaaaagcaagacgugguugugcucggcucccaggaaggggccaugcacacagcccugaccggcgcuacagagauucagaugagcuccggaaaccuucuguuuaccggccaucucaaaugcagacugcggauggacaaacuucaacugaaagggaugucuuacagcauguguaccggaaaguucaagaucgucaaagaaauugcggagacacagcacggcacgaucgugaucagaguccaguaugagggggauggaucccccugcaagauucccuucgaaaucaccgaccucgagaaacgccaugugcugggccggcugauuacaguuaacccuaucgugaccgaaaaggauagcccggucaauauugaggccgaacccccuuuuggggacucuuacaucauuaucggcguggagcccggacagcucaaacugaacugguucaagaagggcuccagcaucgggcaaauguuugagacaaccaugagaggagcuaaacgcauggccauucuuggcgauacggccugggacuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaauagccgguccacaagccugucugugucccuuguucucgucggcguggugacccuguaucugggggccauggucagagccgauagcggaugugugguuucuuggaagaacaaagaacucaagugcggcuccgggaucuucauuacagacaaugugcacacguggaccgagcaguacaaguuucagccugaaagccccuccaaacuggcuucugccauccaaaaggcucaugaggaaggcauuuguggaauccgcagcgucacacggcuugagaaccugauguggaaacagaucaccccggagcucaaucacauucuguccgaaaacgaggugaagcugacaaucaugaccggcgauauuaaagggaucaugcaggccggaaagagaucucuucgcccucagcccacggaacucaaauauagcuggaagaccuggggcaaggcgaaaaugcuguccacagagagccauaaucaaaccuuccugauugacgggccugaaacagccgagugccccaacaccaaucgggcuuggaacucucucgagguugaagauuacggauuuggcguguucacaaccaauaucuggcugaaacuuagagagaaacaggacgucuuuugugacuccaagcugaugagcgccgcuaucaaagauaaccgcgccgugcacgcggacaugggcuauuggauugaaucugcccucaaugauacguggaagauggagaaggcuuccuucaucgagguuaaaagcugccacuggccuaagucucauacacuguggagcaacggggugcuggaauccgagaugauuauccccaaaaacuucgccggaccggucagccagcacaauuaccggccuggcuaucauacccagaccgcugggcccuggcaccuuggaaagcucgaaauggacuuugaucugugugagggcacaaccgugguggucacggaagacugcgggaacagaggacccucucugcggacaaccacagccuccggcaaacucauuaccgaguggugcugucgcagcugcacacugccuccgcuuagauaccggggcgaggauggguguugguacggaauggaaaucagaccccugaaggagaaggaagagaaucucguuaacucccuggugaccgccggccaugggcaaauugacaauuucucucugggagugcuuggcauggcucucuuucuggaagagaugcugcgcacgcggaucgggaccaaacacgcgauccuccuggucgccgugagcuucguuacacuuauuaccggaaacauguccuuuagagaucugggccgcgugauggucauggugggcgcuacaaugaccgacgauaucgggaugggaguuacguaucucgcccugcuggccgcuuucaaggugagaccuacauuugccgcgggccuucugcuccggaaacugaccucuaaggagcucaugauggcuacaauugggaucgcccugcuuagccaguccaccauucccgaaaccauccuggagcucacagacgcccuggcucugggaaugaugguccuuaaaaucgugcgcaauauggaaaaguaccagcuggccguuacgauuauggcgaucucuugcgugccuaacgcugucauucuccaaaaugccuggaaggugagcuguaccauccuggccgcuguguccgucagcccccuccugcuuacaucuucccagcagaaagccgauuggauuccucuggcucucaccaucaagggccugaaccccacagccaucuuccugaccacgcuuagcagaacaucuaaaaagcgguccuggccgcugaaugaggcgauuauggccguugggauggugagcauccucgcuucuucccugcucaaaaacgacauuccuaugaccggaccccugguggccggcggccuucugaccgucugcuaugugcugacagggcgcagcgcugaccucgaacuggagagagccgccgauguuaagugggaggaccaggcugaaaucuccggaagcucuccuauucuuagcaucaccauuuccgaggauggcucuaugagcaucaaaaaugaagaggaggaacaaacacugacgauccucauucggaccgggcugcucgugaucuccggagucuuucccgugucuauuccgaucacagcggccgcuugguaccugugggagguuaagaagcagcgcgccggcgugcuuugggacgucccuucucccccucccguggggaaagccgaacuggaggauggagcuuauagaauuaagcagaaaggcauccugggcuacucccagaucggggccggagucuauaaggaaggcaccuuccacacaauguggcaugugaccagaggggcgguucucaugcaccgcggaaaaagaauugagcccuccugggcugacgugaagaaggaucugaucagcuacggcgggggauggaaacuugagggcgaauggaaggagggcgaagagguccaagugcuggcccucgaaccugggaaaaacccgcgggccguucagacgaagcccggaauuuuuaaaaccaauacaggcaccaucggggcugugucccuggacuucagcccuggaacaucuggcucccccauugucgauagaaaggggaagguggugggacucuacggcaacggcguugucacccgcagcggggccuaugugucugcgaucgcucagacagagaaauccaucgaggacaacccugaaauugaggaugacaucuuucggaagaaaagacugacgauuauggaucuucaucccggagccggcaagaccaaacgcuaccugccugccaucgugcgggaagcuauuaagagagggcugcgcacacucauccuggccccgacccgggucguggcugccgagauggaagaggcgcuuagaggacugcccauucgcuaucagaccccugccaucaagacagagcacacgggccgggaaaucguugaccucaugugucaugcuaccuucacaaugagacugcucagccccgugcgggucccuaauuacaaccugauuaucauggacgaggcccacuucaccgaucccgcuuccauugccgcccgcggguauaucucuacaagaguggaaaugggcgaggcugcgggaauuuuuaugaccgccacgccgccuggcagccgggaccccuucccccaauccaaugcuccuaucauggaugaggaacgcgagauccccgaaagaagcuggaacucugggcacgaguggguuacagacuuuaaaggaaagaccgugugguucgucccuuccauuaaagccggcaaugauaucgccgcuugccuucggaagaacgggaaaaaggugauucagcugagcagaaagaccuuugacucugaauacguuaaaacacgcgccaaugauugggacuucguggucaccacagauaucagcgagaugggagcgaacuuuaaggcugagcgggugauugacccgagacgcuguaugaaacccgugauccugaccgauggcgaagaacgggucauccucgccgggccuaugcccguuacgcauuccucugccgcucagagacgcggccggauuggaagaaauccuaagaacgaaaaugaccaauauaucuacaugggcgagccccuggaaaacgacgaggauugcgcccacuggaaagaggcgaagaugcuucuggacaauauuaacacaccggaagggaucauuccuagcauguucgagcccgaacgcgagaaaguggaugccaucgacggagaauacagacuccggggcgaggcucgcaagaccuuuguggaucugaugagaagaggggaccugccugucuggcucgccuauaagguggcugccgagggaauuaauuacgcugaucgcaaaugguguuucgacggcaucaagaacaaccagauccuugaagagaauauugaaguugagaucuggacaaaagagggggaaagaaagaaacugaagccccgguggcuggaugccagaauuuauuccgacccucucgcgcugaaggaguuuaaagaguucgccgcuggccgcaagucucuuacccugaaccucaucacggagaugggacggcugcccaccuucaugacacagaaagccagaaaugcucuggauaaccucgccgugcuucauaccgccgaagcuggcgggcgcgcguacaaucacgcccugagcgagcugccggagacacucgaaacccugcuucugcucacacugcuggcuaccgucacgggaggcauuuuucucuuccuuauguccgggcggggaaucggcaagaugacacugggcaugugcugcaucauuaccgccagcauccugcucugguaugcccagauucaaccucacuggaucgcugccucuauuauccuggaguuuuuccuuaucgugcugcucauucccgaacccgagaaacagagaaccccucaggacaaccagcugacauacguugugaucgcgauucugaccgucguggccgcuacaauggccaaugaaaugggguuucucgagaagacgaagaaagaucuuggacugggcuccaucaccacacaagagagcgaauccaacauucuggacaucgaccuccggccggcuucugccuggacccuguaugcggucgccacaaccuucgugacgcccaugcuucgccauagcauugaaaauagcucuguuaacgugagccugaccgcuaucgccaaucaggcuacagugcucauggggcugggaaagggcuggccucuguccaaaauggauaucggggucccccuccuugccauuggauguuacagccagguuaacccuaucacccugacagcugcccugcuccugcuuguggcgcacuacgccauuaucggccccggccugcaggcuaaggccaccagagaagcucaaaaacgggccgccgcggggauuaugaagaauccuacgguggacggaaucacagucaucgaucucgagccgauucccuaugacccuaaguuugaaaaacagcugggccaggugaugcugcucauccuuugcguuacccaggugcugaugaugcgcacaaccugggcucugugugaggcccucacccuggcuacagggcccauuucuacgcuuugggagggaaacccuggcagauucuggaauaccacaaucgccgucuccauggccaacauuuuucgggggagcuaccuggcuggagccggccuccuguucucuaucaugaagaauaccacaaacacccgcagaggcacggggaacaucggagaaacacugggcgagaaauggaagucccggcucaaugcgcuugggaaaagcgaauuucaaguguauaagaaaucuggcauucaggaggucgaucgcacccuggccaaggagggcaucaagagaggggaaaccgaccaucacgcugugagccggggauccgccaaacugagaugguucguugagcgcaacauggugacacccgaaggcaaggucguggaucucggcugcgggcggggaggcuggucuuacuauugugggggacugaaaaauguuagagaggugaagggccuuaccaaagggggaccgggccaugaggagccuauucccaugagcacauacggcuggaaccugguccgccuccaguccgggguggacguguuuuucacgcccccugagaagugcgauacccugcugugugacaucggagaaagcucccccaauccuacaauugaggcuggccggacccucagaguucuuaaccuggucgaaaauuggcugaacaauaacacacaauucugcaucaaggugcucaauccguauaugcccucugugaucgagaaaauggaagcccugcagcgcaaguacgggggagcgcuuguccggaacccucugagcagaaauuccacccacgagauguacuggguuucuaacgccacgggcaauauugugagcuccgugaacaugaucucucgcaugcucauuaaccgguuuaccaugaaacacaagaaagcuacauaugagcccgaugucgaccuggggagcggaaccagaaauaucggcauugaauccgagaucccuaaccuggauauuaucggcaagcgcaucgaaaagauuaaacaggagcaugaaacaagcuggcacuacgaccaggaccaucccuauaagaccugggccuaccacgggucuuaugagacaaaacaaaccggauccgcuagcucuauggugaauggcguugugcggcuccuuacgaagccgugggauguccugccuauggugacacagauggccaugaccgacaccacacccuucgggcagcagagaguuuuuaaagagaagguggauacgcgcacccaagaaccuaaggagggaaccaagaagcugaugaaaaucaccgcugaauggcucuggaaggagcugggcaaaaagaaaacacccagaauguguacccgggaggaguucacacgcaaggucagauccaacgccgcgcuuggggccauuuuuaccgacgagaauaaguggaaaagcgcucgggaagccguggaggauggaagauucugggaacugguggaccgggagcgcaaccuccaccuggagggcaagugcgaaacgugugucuacaauaugaugggcaaaagagagaagaaacugggggaauuuggaaaggcuaagggcucucgggccaucugguauauguggcucggggcccgcuuccuggaguuugaagcgcuuggauuccugaacgaggaucauugguuuuccagaggcaauagccucuccgggguugagggcgaaggacugcaccggcuuggcuacauucugcgcgacguggggaaaaaggagggaggcgcuauguacgccgaugacaccgccgggugggauacaagaaucacccucgaagaccugaaaaacgaggaaauggugacaaaucauaugaagggagagcacaaaaagcuggcugaggccaucuucaagcucaccuaucagaacaaagucgugcggguucagcgcccuacgcccagaggcacagugauggacauuaucagccggcgcgaucagagagggucuggccaagucggaaccuacggccugaauacauuuaccaacauggaagcucagcuuauucggcagauggagggggaaggaaucuucaagagcauucaacaucugacggccaccgaggagaucgcggugcagaauuggcucgcccgcguuggcagagaacggcuguccagaauggcuaucucuggggacgauugcguggucaaaccgauugacgaucgcuucgccagcgcucuuacagcccugaacgacaugggaaaggugcggaaagauauccagcagugggagccuuccagaggcuggaacgacuggacccaaguucccuuuugcucucaccacuuccaugaacucgugaugaaggaugggcgcguccuggugguccccugucggaaucaggacgagcugauuggcagagcgcgcaucagccagggagccggcuggucccucaaggaaacagcuugccuggggaaaucuuaugcccagauguggacccuuauguacuuucaccggagagaucugcgccucgcugccaacgcuauuuguagcgccgugccuccgcauuggguucccacaucccggaccacguggagcauccacgcgaagcacgaguggaugacaaccgaggacaugcuggccguguggaauagagucuggauucaagaaaacccuuggauggaggauaaaacccccguggaaucuugggaggaagugccuuaucuuggaaagcgcgaggaccaguggugcggcucccugaucgggcucacaagccgggcuaccugggccaaaaauauccagacagccauuaaccagguuagaucucugaucggaaaugaggaauacacggacuauaugcccuccaugaagcgguucagacgcgaggaagaggaagcuggcgugcugugguga

SEQ ID NO: 19566 - RNA, 9876 nt, Artificial Sequence
  derived and/or modified CDS sequence (opt5) from DENV-2__JX649147__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaauccgaacccgaggauaucgacuguuggugcaacucuacaagcaccugggugacguauggcaccuguacaaccacaggggagcacagacgggaaaagcgcuccguggcucucgucccucaugugggaaugggccuggagaccagaacggaaacauggaugucuagcgagggcgccuggaaacacgcccagcggaucgagaccuggauucugcgccaucccggguucacaaucauggcugccauucucgcuuacaccaucggaaccacacacuuucagaaggcccugauuuucauccuucugacggcgguugccccuuccaugaccaugagaugcauuggcaucucuaaucgggauuuuguggaaggggucagcggaggcuccuggguggacaucguucucgagcacgggagcugugugacaaccauggcuaagaacaaacccacacuggauuucgaacuuauuaagaccgaggccaaagaaccugcuacgcugcgcaaguauugcaucgaggccaaacucacaaauaccaccacagagucuagauguccgacccagggagaacccucccugaacgaggaacaagacaagcgguuugucugcaagcauagcaugguggaucgcggcuggggcaauggguguggacuguucggcaaagggggaauugugacaugcgcgauguuuacgugcaagaaaaacauggagggcaagaucguccagccugaaaaucucgaguacaccauuguuaucacaccccacucuggggaggaacaugccgugggaaacgacaccggcaaacacggcaaggagaucaaaauuacaccucaguccagcaucaccgaagcugagcugacgggguauggaaccgugacaauggaauguucucccagaaccggccuugauuucaaugagaugguccugcuccagauggaggacaaggccuggcuggugcaccggcaaugguuucuugaucugccgcucccuuggcugcccggggcugacacacagggauccaacuggauucagaaggaaacccugguuacguucaaaaauccucaugccaagaaacaggacguggucgugcucggcagccaagagggggccaugcacacagcucugaccggcgcgacagaaauccagauguccucuggaaaccuucuguuuaccggccaucucaagugccgccugagaauggauaaacuucagcugaaggggaugagcuacuccauguguaccggaaaguucaaaauuguuaaggagaucgccgagacacaacacggcacgaucgugauucggguccaguaugaaggggacggaagccccugcaaaauccccuucgagauuauggaucucgaaaagagacaugugcugggccgccugaucaccgucaauccuauugugacagagaaagacucuccgguuaacaucgaagcugagcccccuuuuggggauuccuacauuaucaucggcguggagcccggacagcucaagcugaacugguucaagaaaggcagcucuauugggcagauguuugaaaccacaaugcggggagccaagagaauggccauccuuggcgacaccgcuugggauuucgggagccugggaggcgucuuuacguccauugggaaagcccuccaccaaguguucggcgcgaucuacggagcugccuuuucuggcguuagcuggacaaugaagauucugaucggggugaucauuaccuggaucggaaugaauucccgcagcaccucucuguccgucagccuugugcucgugggcguuauuacacuguaucugggggccaugguccaggcugacucuggaugugugguguccuggaaaaacaaggagcucaagugcggcagcgggaucuucauuaccgauaauguccacacauggacggaacaguacaaauuucagccugagucccccucuaagcuggccagcgcuauccaaaaagcccaugaagagggcaucuguggaauucgguccgugaccagacuugagaaccugauguggaagcagaucacaccggaacucaaucacauucugucugagaacgaaguuaaacugaccaucaugacaggcgacauuaaggggaucaugcaggcgggaaaacgcagccuucggccucagcccaccgagcucaaguauuccuggaagacguggggcaaagccaagaugcugagcaccgaaucucauaaucaaacauuccugaucgaugggccugagaccgcugagugccccaacaaaaauagagccuggaacucccucgaaguggaggacuacggauuuggcgucuucacaaccaauauuuggcugaagcuucgcgaaaaacaggacguguuuugugauagcaagcugaugucugcugccaucaaggacaaccgggcgguucacgccgauaugggcuauuggauugaguccgcucucaaugacacauggaaaauggagaaggccagcuucaucgaagugaaaucuugccacuggccuaagagccauacccugugguccaacgggguccuggagagcgaaaugauuauccccaaaucuuucgcuggaccggugucccagcacaauuacagaccuggcuauuacacgcagacagccgggcccuggcaucuuggaaagcucgagauggauuuugacuucugugaaggcaccaccguuguggucacagaggauugcgggaaccgcggacccagccugcggaccacgacagccuccggcaagcugauuaccgaguggugcuguagaucuugcacacucccuccgcugcgguaccgcggcgaagacggguguugguauggaauggagaucagaccccuuaaagaaaaggaggaaaaccuggugaauagccucgugaccgcuggccacgggcaaaucgauaacuuuucccugggaguccugggcauggcgcuuuuccucgaggagaugcugcggacaagaguugggaccaaacaugccauucugcucguggcugugucuuuugucacgcugaucaccggaaauaugagcuuccgcgaccuuggccgggugaugguuauggugggcgccacaaugaccgaugacauugggaugggagucacauaccuggcccuccuggcugccuuuaaggugagaccuaccuucgcggcuggccugcuucugaaaaagcucacguccaaggaacugaugauggccacaaucgggauugcccuccugucucagagcaccauccccgagacaauccuugaacugaccgaugcucucgcccugggaaugaugguucugaaaauugugcgcaacauggagaaguaucagcuugcggucaccaucauggcuauuuccugcgugccuaaugccguuauccugcaaaacgccuggaaagugagcuguacaauucucgcugccgucucuguguccccccugcuccugacgagcucucagcagaaggcugacuggaucccucuugcccugaccaucaaaggccucaaucccacagcgauuuuucugaccacacuguccagaaccagcaagaaacggucuuggccgcuuaacgaagccaucauggcuguggggauggucuccauucuggccagcucccuccugaagaaugacaucccuaugacgggaccccucguugcuggcggccugcuuacagugugcuacgugcugaccgggcgcagcgccgaucuggagcucgagagagccaccgacgucaagugggaagaucaggcugagauuucuggaagcuccccuauccugucuauuacaaucagcgaagacggcuccaugucuaucaaaaacgaggaggaagagcaaacccuuacaauucugauccggacggggcuccuggugauuagcggacucuuccccauguccaucccgauuaccgcggccgcuugguaucugugggaaguuaagaaacagcgcgccggcgugcuuugggaugucccuucucccccucccguggggaaggccgagcuggaagacggagcuuacagaaucaaacagaagggcauccugggcuauagccagauuggggccggaguuuacaaggagggcacauuucacaccauguggcacgugacacggggggcgguccucaugcaucgcggaaaaagaaucgagcccuccugggcugaugugaagaaagaccugauuagcuacggcgggggauggaagcuugaaggcgaguggaaagaaggcgaggaaguccaagugcuggcccucgagccugggaagaauccgcgggccguucagaccaagcccggacuguucaaaacgaacaccggcacaaucggggcugugucucucgauuuuuccccuggaaccagcggcucucccauugucgaccgcaaggggaaagugguuggacuguauggcaauggcguggucacaagauccggggccuacgugagcgcgaucgcucagaccgagaaguccaucgaagauaacccugagauugaagacgauaucuuccggaaaaagagacuuacaauuauggaccugcaccccggagccggcaagacgaaacgcuaucugccugccaucgugcgggaggcuauuaagagagggcuccgcacccugauccuugccccgacacggguugucgcugccgaaauggaggaggcgcugagaggacuccccauucgcuaccagaccccugccauccgggcugaacauaccggcagagagaucguggaccugaugugucacgccacauucacgaugcgccuccugucucccgugcgggucccuaauuauaaccuuauuaucauggaugaagcucauuuuaccgaccccgccagcauugccgcuagaggguacaucuccacacggguggagaugggcgaggcggccggaauuuucaugaccgcuacaccgccuggcagccgcgaucccuuuccccaaucuaacgccccuaucauggacgaagagagagaaauccccgagcgguccuggaauagcgggcacgaauggguuaccgauuucaaaggaaagacggugugguuugucccuucuauuaaagccggcaacgacaucgcugccugccugcgcaagaaugggaagaaagugauucagcugagcagaaagacauucgauuccgaguauguuaaaacccggaccaacgacugggauuuuguggucacaaccgacaucucugagaugggagcgaauuucaaggcugaaagagugauugauccgcgccgguguaugaaacccguuauccucacagacggcgaggaaagagugauccuggccgggccuaugcccgucacccacagcuccgccgcucagcgccggggcagaauuggacgcaacccuaagaaugagaacgaccaauacaucuacaugggcgaaccccuugagaaugaugaggacugcgcccauuggaaagaagcgaagaugcugcucgauaacauuaauacgccggaggggaucauuccuucuauguuugaacccgagcgggaaaagguggacgccaucgauggagaguauagacugcgcggcgaggcuagaaaaacauucguggaccugaugcggcgcggggaucucccugucuggcuugccuacagaguugcugccgaaggaauuaacuaugcugaccggcgcugguguuuugauggcgugaagaauaaccagauccuggaggaaaauguggaggucgagaucuggaccaaagaaggggagagaaagaaacugaagccccgguggcucgacgccagaauuuacagcgauccucuggcgcuuaaggaauucaaagaguucgccgcuggccgcaagucccugacacucaaccugaucaccgaaaugggacggcugcccacguuuaugacccagaaagccagagacgcucucgauaaccuugccgugcugcacacagccgaggcuggcgggcgcgcguauaaucaugcccugagcgagcucccggaaacccuggagacacuucugcuccugacccugcucgcuacaguuaccggaggcauuuuccuuuuucugaugucugggaagggagugggcaaaaugacgcugggcaugugcugcaucauuacagccuccauccuccugugguacgcccagauccaaccucacuggauugcugccagcaucauucuugaauucuuucugaucguccuccugauucccgagcccgaaaagcagcggaccccucaggacaaccagcugaccuaugugguuaucgcgauccucacaguggucgccgcuaccauggccaaugagaugggguuccuugagaagacaaaaaaggaccugggacugggcuccauugcuacgcaagaaccggagucuaacauccucgauauugaccugagacccgccagcgcguggacccuuuacgccguggcuacaaccuuugucacaccuaugcugcggcacuccaucgaaaauucuagcgugaacguuucccucaccgccauugcuaaucaggccacggugcugauggggcugggaaaaggcuggccccucagcaagauggauaucggggugccucuucuggcuauuggauguuacucucaggucaaccccaucacccugacagccgcgcuccugcuucugaucgcccauuaugcuauuaucggcccuggccuccaggccaaagcuacccgcgaggcccaaaagagagccgcggcugggauuaugaagaauccgacaguugacggaaucaccgugauugaucuggaccccaucccuuacgaucccaaauucgaaaagcagcugggccaggugaugcuccuuauccugugcgucacgcaggugcugaugaugcggacaaccugggcccucugugaggcucugacacuugccaccgggccuauuuccacccugugggagggaaaccccggccgcuuuuggaauacaacgaucgccguuagcauggcuaacauuuucagagggucuuaucucgccggagcgggccugcuguuuuccaucaugaaaaauaccacaaacacccggcgcggcacagggaauauuggagaaacccucggcgagaaguggaaaagcagacuuaacgcccuggggaagucugaauuccaaaucuacaaaaagagcggaauccaggagguggaccggacgcuggcuaaggagggcauuaaacgcggggaaacagaucaccaugccgucuccagaggaucugcuaagcuccggugguuuguggagagaaauauggucaccccggaaggcaaagugguugaccugggcugcgggcgcggaggcuggagcuauuacugugggggacuuaagaacgugcgggaggucaaaggccugaccaaggggggaccuggccacgaagagcccauccccauguccacauauggcuggaaccucgugagacugcagagcgggguugauguguucuucaccccucccgagaagugcgacacacugcucugugauauuggagaauccucuccuaauccgacgaucgaggccggccgcacccuucggguccugagccugguggaaaacuggcucaauaacgacacacaauuuugcauuaaagugcugaaucccuacaugccuuccguuaucgagaagauggaaacccuucagagaaaauacgggggagcgcugguccgcaacccccucucucggaauagcacacaugagauguauuggguguccaacgccaccggcaauaucgugucuagcgucaacaugauuuccagaaugcugaucaaucgcuucacgaugaagcacaaaaaggcuaccuacgagccugacguugaucuggggagcggaacacggaacauuggcaucgaaucugagauucccaaucucgacaucauuggcaagagaaucgaaaaaaucaagcaggagcacgaaaccuccuggcauuaugaucaggaccacccguacaaaacaugggccuaucaugggagcuacgagaccaagcaaacaggaucugcuuccagcauggugaacggcgugguccgccuucugaccaaaccuugggaugugguucccauggugacgcagauggccaugacagacaccaccccuuuugggcagcagcgggucuucaaggagaagguggauacaagaacgcaagaacccaaagagggaaccaagaaacugaugaagauuacagcugaauggcucuggaaagagcugggcaagaaaaagaccccucgcauguguacaagagaggaauuuacccggaagguucgcucuaaugccgcgcuuggggccaucuucacagacgagaacaaauggaaguccgcuagagaagccguggaggauagccgguuuugggaacuggucgacaaagagagaaaccuccaccuggagggaaagugcgaaaccuguguguauaauaugaugggcaaacgggagaagaagcugggcgaauucgggaaagcuaagggaucccgcgccauuugguacauguggcucggcgccagauuucuggaguucgaagcgcuuggguuucugaacgaggaucacugguucagccgggagaauucucucagcggaguggaaggcgaggggcugcauaaacuuggcuacauccugcgcgacgucuccaagaaagaaggaggcgcuauguaugccgacgauacggccgggugggacaccagaauuacacucgaggaucugaagaacgaagagaugguuaccaaucacauggagggagaacauaagaaacuggcugaggccaucuuuaagcucacauaccagaacaaaguggugcggguccagcgccccaccccgagaggcacggugauggacaucauuucucggcgcgaucagagagggagcggacaaguuggcacauaugggcugaauaccuucacaaacauggaagcucagcuuauccggcagauggagggcgagggaauuuucaaguccauccaacaccugaccgugacggaagagauugccguccaggacuggcucgcgcgcgugggcagagaacggcugucucgcauggccaucagcggggaugacugcguugugaaaccucuugaugacagauuugcuuccgcccugaccgcucucaaugauaugggaaagguccggaaggacauccagcagugggagcccucuagaggcuggaacgauuggacacaagugcccuucugcagccaucacuuucacgaacugauuaugaaagacgggcgcguucugguggucccuugucggaaucaggacgagcucaucggaagagcccgcauuucccagggcgcgggguggagccugaaggagaccgccugccuuggcaaaucuuacgcucagauguggucccugauguauuuccaucggagagaucuccgccuggccgcuaacgccaucuguagcgcugugccgucucacuggguccccacaucccggaccacauggagcauucaugccaagcacgaauggaugaccacggaggacaugcuuacaguguggaauagaguuuggauccaagaaaacccuuggauggaggauaaaacccccguggaauccugggaggaggucccuuaccugggaaagcgcgaagaccaguggugcggcucucucauugggcugaccagccgggcgacaugggccaagaauauccagaccgcuaucaaccaggugagaucccugauuggaaacgaggaauauacagauuacaugcccagcaugaaacgcuuucggagagaggaagaggaggccggcgugcucugguga

SEQ ID NO: 19567 - RNA, 9876 nt, Artificial Sequence
  derived and/or modified CDS sequence (opt5) from DENV-2__KF704356__SS-prME
accgccggcaugaucauuaugcugauccccacagugauggcuuuccaccucacgacccggaacggggaaccucauaugauugucagccggcaggaaaagggaaagucccugcuuuuuaauacaggcgacgggguucacaugugcacccugauggccaugcaucucggagagcugugugaagauacaaucaccuacaagugcccgcuucugagacaaaacgagcccgaagacauugauuguuggugcaauucuacaagcaccugggugacguauggcaccuguacaaccacaggggagcaccggcgggagaaacgcuccguggcgcucgucccucaugugggaaugggccuggaaaccagaacggagacauggaugucuagcgaaggcgcuuggaagcacgcccagcggaucgagaccuggauccugcgccaccccggguucacaauuauggccgcuauccucgccuacaccauuggaaccacacauuuucagagagcucugaucuucauucuucugacggccguugcgccuuccaugaccaugcggugcaucggcauuucuaaccgcgacuuuguggagggggucagcggaggcuccuggguggauaucguucucgaacacgggagcugugugacaaccauggccaaaaauaagcccacacuggaccuugagcugaucaagaccgaagcuaaacagccugccacgcucagaaaguauugcauugaggcuaaacugacaaacaccaccacagaaucucgguguccgacccaaggagagcccucccugaaugaggaacaggauaagcgcuucgucugcaaacauagcaugguggacagaggcuggggcaacggguguggacucuuuggcaaggggucuaucgugacaugcgccauguucacgugcaagaaaauuaugaagggaaaagucguucagccugagaaucuggaauacaccaucgugauuacaccccacuccggcgaggaacacgcgguggggaacgauaccggaaagcauggcaaagagaucaagaucacaccucagagcucuauuaccgaggccgaacuuacgggcuaugggaccgucacaauggaguguagcccccggaccggacuggacuuuaaugaaauggugcuccugcaaauggaggauaaggcuuggcuuguucaccgccagugguuccuggaccucccgcugccuuggcugcccggcgccgauacacaggggagcaacuggauccagaaggaaacccucgugacguuuaagaauccucaugcuaaaaagcaagacgucgugguucugggaucccaggagggcgccaugcacacagcccuuaccggggcuacagagauucagaugucuagcggcaacgugcuguucaccggacaucucaaaugcagacugcggauggacaaacuucaacugaaaggcauguccuacagcauguguaccgggaaguuuaaggucgugaaagaaaucgcggagacacagcacggaacgauugucaucagagugcaguaugaaggcgaugggucucccugcaagauccccuucgagauuauggaccucgagaaacgccacguucugggacggcugaucaccgugaauccuauugucacaggcaaggauuccccggugaacaucgaagccgagcccccuuucggggacagcuacauuaucauuggcguugaacccggacagcucaaacugaacugguuuaagaagggcucuagcaucgggcaaauguucgcuaccacaaugagaggagccaaacgcauggccauccuuggcgauaccgcuugggacuuugggucccugggaggcguguucacgucuauugggaaggcccuccaucaggucuuuggcgcgaucuacggagcugccuucagcggcguguccuggacaaugaaaauucugaucggggugauuaucaccuggaucggaaugaauagccggucuaccucccugagcguuucucuuguccucgugggcguggucacacuguaucugggggugaugguucaggccgauuccggauguguggucagcuggaagaacaaagagcucaagugcggcuccgggauuuuuaucaccgacaaugugcacacauggacggaacaguacaaguuccaaccugagucucccagcaaacuggcuuccgccauucagaaggcucaugaggaaggcaucuguggaauuagaucuguuacccgccuugagaaccugauguggaaacagaucacaccggaacucaaucacauccugagcgagaacgaagugaagcugaccauuaugacaggcgauaucaaagggauuaugcaggccggaaagcggucccuuagaccucaacccaccgagcucaaauauagcuggaagacguggggcaaggcgaaaaugcugucuaccgagucccacaaucagacauuucugaucgacgggccugaaaccgccgagugccccaacacaaaucgcgcuuggaacagccucgaagucgaggauuacggauucggcguguuuaccacaaauauuuggcugaaacuucgggaagaacaggacguuuucugugacucuaaacugauguccgccgcuaucaaggauaacagagccgugcaugcggacaugggcuauuggaucgagagcgcccucaaugauaccuggaaaauugaaaaggcuucuuuuaucgaggucaagagcugccacuggccuaaaucccauacgcuguggagcaacggggugcuggaaucugagaugauuauccccaagaauuucgccggaccggugucccagcacaacuaccgcccuggcuaucauacacaaaccgcugggcccuggcaccuuggaaaacucgagauggacuucgauuuuugugaaggcaccacagucguugugaccgaggacugcgggaaccggggacccagccugagaacgacaaccgccuccggcaagcugauuacagaauggugcugucggucuugcacccucccuccgcugcgcuacagaggcgaggauggguguugguacggaauggaaauccggccccuuaaagagaaggaggaaaaucuggugaacagccucgucacagccggccacgggcagauugacaauuucucccugggagugcugggcauggcucuuuuucucgaggaaaugcugagaacccgcguugggacgaagcaugcgauccugcucguggccgucucuuucgugacccugaucacaggaaacaugagcuuucgggaucuuggcagaguuauggugauggucggcgcuaccaugacagacgauauugggaugggagugaccuaucuggcccuccuggccgcuuucaaaguucgcccuacguuugccgcgggccugcuucugagaaagcucacauccaaagagcugaugaugaccacaaucgggauugugcuccugucucagagcaccauccccgaaaccauucuugagcugacagacgcucucgcccugggaaugaugguccugaagauggugcggaaaauggagaaguaccaacuugccgugacgaucauggcuauccugugcgucccuaaugccguuauucuccagaacaccuggaagguguccuguacaauccuggcgguggucagcgugucuccccucuuccugaccuccagccagcagaaagcugauuggauuccucuugcccugacaaucaagggccucaaucccaccgccauuuuucugacgacacugucucgcaccaacaaaaagagauccuggccgcuuaaugaagcuaucauggccguugggauggugagcauccuggcuucuucccuccugaaaaacgacauuccuaugaccggaccccucgucgccggcggccugcuuacagugugcuauguucugaccgggcggagcgcggaccuggagcucgaacgcgccgcugaugugaagugggaggaccaagccgaaaucuccggaagcucuccuauucugagcaucacaauuuccgaggauggcucuaugagcaucaaaaaugaggaagaggaacagacgcuuaccauucugaucagaacagggcuccuggucaucuccggacucuuccccgugucuauuccgaucaccgcugccgccugguaccugugggaggucaagaagcagcgggcuggcgugcuuugggacguuccuucucccccucccguggggaaagcggagcuggaagauggagccuaucgcauuaagcagaaaggcauccugggcuacucccaaauuggggcuggagucuauaaggagggcacauuucacaccauguggcaugugacgagaggggccguucucaugcacaaaggaaagcggaucgaacccuccugggccgacgugaagaaagaucugaucagcuacggcgggggauggaaacuugagggcgaauggaaagagggcgaggaaguccaggugcuggcucucgagccugggaagaacccgcgcgccgugcagaccaaacccggacuguucaagacaaaugcgggcaccauuggggcuguuucccucgacuuuagcccuggaacaucuggcucccccaucauugauagaaaggggaaagucgugggacuguacggcaacggcguggucacccggagcggggccuaugugucugccaucgcucagacagaaaaguccauugaggacaauccugaaaucgaggaugacaucuucagaaaacgcaaacuuacgauuauggaucugcaucccggagccggcaaaaccaagcgguaccugccugcgaucguuagagaggcuauuaagcgcgggcuccggacacugauccuugccccgaccagaguggucgccgcugaaauggaggaagcccugcgcggacuccccauucgguaucaaaccccugcuaucagagccgagcacacaggccgcgaaauuguggaccugaugugucacgcgacguucaccaugcggcuccugagccccguuagagugccuaacuacaaccuuaucaucauggacgaggcccauuuuacagaucccgcuuccauugccgcucggggguauaucucuacccgcgucgagaugggcgaagccgccggaauuuucaugacagcuaccccgccuggcagcagagaccccuuuccccaguccaaugcgccuaucauggaugaggaacgggagauucccgagcgcagcuggucuuccgggcacgaaugggugacggacuucaaaggaaagacaguuugguuugugccuagcaucagagccggcaacgauaucgcugccugccugcggaaaaaugggaagaaagucauucagcugucuagaaagaccuucgacagcgaguacgugaagacccgcacaaacgauugggacuuuguggucaccacagauaucuccgaaaugggagccaauuucaaagcugagcggguuauugacccgagacgcuguaugaagcccgugauccucaccgauggcgaagaacgggugauucuggccgggccuaugcccgucacgcauucuagcgcggcucaaagacgcggccggaucggaagaaacccuaaaaaugagaacgaccaguauaucuacaugggcgaaccccuugagaaugacgaagauugcgcccacuggaaggaggccaaaaugcugcucgacaacauuaauacaccggaagggaucauuccuuccauguuugagcccgagcgcgaaaagguggaugcuaucgacggagaguacagacugcggggcgaagcccgcaaaaccuucguugaucugaugagaagaggggaccucccuguguggcuugcguaucgcgucgccgcugagggaauuaacuacgccgauagacggugguguuuugacggcaucaagaauaaccagauucuggaagagaauguggagguugaaaucuggacaaaggagggggaacgcaagaagcugaaaccccgcuggcucgaugcucggaucuauucugacccucuggcccuuaaggaguucaaagaguucgcugccggcagaaagagccugacccucaaccugauuacggaaaugggacgccugcccaccuuuaugacacagaaggcgcgggaugcccucgacaaccuugcugugcugcacaccgccgaggcuggcgggagagccuacaaucaugcccuguccgaacucccggagacacuggaaacccuucugcuccugacacugcucgcuaccgucacgggaggcaucuuccuuuuucugaugagcgggcggggaauuggcaaaaugacacugggcaugugcugcaucauuaccgcgucuauccuccugugguaugcccaaauccagccucacuggauugcugccuccaucauucuugaguucuuucugaucgugcuccugauucccgagcccgaaaagcagcgcaccccucaggauaaccaacugacauacgucgugaucgccauccucaccguuguggcugccacaauggcgaaugagaugggguuccuugagaagacgaagaaagaccugggacugggcagcauuaccacacagcagccggaguccaacauccucgacauugaucugagacccgccucugcuuggacccuuuaugccguggcuacaaccuuugucacgccuaugcugcggcauagcaucgaaaauuccucuguuaacgugagccucaccgccauugcgaaucaggccacagugcugauggggcugggaaagggcuggccccucuccaagauggacaucggggucccucuucuggcuauuggauguuacagccaagugaaccccaucacccugacagccgcucucuuccugcuuguugcccacuacgcuaucauuggcccuggccugcaggccaaagcgacccgcgaggcccagaagagagcugccgcugggaucaugaaaaauccgacgguggauggaauuacagucaucgaccucgaucccauuccuuaugaccccaaguuugagaaacagcugggccaagugaugcugcucguccuuugcgugacccagguucugaugaugcggacaaccugggcccugugugaagcccucacccuggcgacagggccuaucucuacgcuuugggagggaaaccccggccgcuucuggaauaccacaaucgcuguguccauggccaacauuuuuagagggagcuaccuggcuggagccggccuccuguucucuaucaugaagaauaccacaaacacccggcgcggcacggggaauaugggagaaacacugggcgagaaguggaaauccagacucaacgcccuuggaaagagcgaauuucagauuuauaaaaagucuggaauccaagaggucgaucggacccuggcuaaagagggcauuaagagaggggaaaccgaccaucacgccgugagccgcggauccgcgaaacugcggugguucguugagagaaauauggugacaccggaaggcaaggucguggaucucggcugcgggcgcggaggcuggucuuacuauugugggggacugaagaacgugcgggagguuaaaggccuuaccaaaggcgggccugggcacgaggaacccauccccaugagcacauacggcuggaaccuggucagacuccaguccgggguggacguguucuuuacgccucccgagaaaugcgauacccugcugugugacaucggagaaagcuccccuaauccgacagucgaggccggccgcacccuccggguucuuaaccugguggaaaauuggcugaacaauaacacacaguucugcauuaaggugcucaaucccuauaugccuucugucaucgagaaaauggaggcucugcagagaaaguacgggggagcccuugugcgcaacccccugagcagaaauuccacccaugaaauguacuggguuucuaacgcuagcggcaauauuguguccucugucaacaugaucagcagaaugcucauuaaucgcuuuacgaugcggcacaagaaagccaccuucgagccugauguggaccugggguccggaacaagaaacaucggcaucgaaagcgagauucccaaucuggacaucauuggcaagcgcaucgagaagauuaagcaagaguaugagaccucuuggcauuacgaucaggaccacccguauaaaacaugggcguaccacggguccuaugaaaccaagcagacaggaagcgccucuuccaugguuaacggcguggucagacuccuuaccaagccuugggauguggugcccauggucacgcagauggcuaugacagacaccaccccuuuugggcaacagcggguuuucaaagagaagguggauacacgcacgcaggaacccaaagagggaaccaagaaacugaugaagaucacagccgaauggcuguggaaggagcucggcaaaaagaaaaccccuagaauguguacacgggaggaauuuaccagaaaggugcggagcaacgcugcccugggggcuauuuucacagacgagaauaaauggaagucugcccgcgaagcggucgaggauuccagauuuugggagcuuguggacaaagaacggaaccugcaucucgagggaaagugcgaaaccuguguuuacaauaugaugggcaagcgcgagaaaaagcugggcgaguucgggaaagccaagggaagcagagcuaucugguauauguggcugggcgcccgguuucucgaguucgaggcucugggguuucuuaacgaagaucacugguucucccgcgagaauagccugucuggaguggaaggcgaggggcuccauaaacugggcuacauccuuagagacgucagcaagaaggaaggaggcgccauguacgccgaugacacggcggggugggacacccggauuacacuggaggaucucaaaaacgaggaaauggugaccaaucacauggagggagaacauaagaaacuggcugaggccaucuucaagcugacauaucagaacaaaguugugcgcguccaaagacccaccccgcggggcacggugauggacauuaucucccgcagagaucagcgggggucuggacagguuggcacauacgggcucaauaccuuuacaaacauggaagcccaacugauucgccagauggagggcgagggaguguucaagaauauccagcaccuuaccgucacggaagagaucgcugugcagaacuggcuggccagagucggccgggaaagacucagccgcauggcuauuuccggggacgauugcgugguuaagccucuggacgaucgguuugccucugcgcuuaccgcccugaaugacaugggaaaagugagaaaggauauccaacagugggagcccagccgcggcuggaacgacuggacacagguccccuucugcucccaccauuuucacgagcucauuaugaaagaugggcgggugcuggugguuccuuguagaaaucaggacgaacugaucggacgcgcucggauuucucaaggcgccggguggagccucagagagaccgcuugccugggcaaguccuaugcccagauguggagccuuauguacuuccaucgccgggaucugagacucgcggccaacgcuaucuguucugccgugccgucccacuggguccccacaagccgcaccacauggucuauccacgcuaaacaugaauggaugaccacggaggacaugcugacaguguggaaccggguuuggauucaggaaaauccuuggauggaggacaagacccccguggaguccugggaagagaucccuuaucuuggaaagagagaagaucaguggugcggcagccugauugggcucaccucccgggccacaugggcuaaaaacauccaaaccgccauuaaucaggucagaucucugaucggaaacgaggaauacacagacuauaugcccagcaugaagcgcuuucggagagaggaggaagaggcgggcgugcugugguga

SEQ ID NO: 19568 - RNA, 9876 nt, Artificial Sequence
  derived and/or modified CDS sequence (opt5) from DENV-2__KF704355__SS-prME
accgccggcaugaucauuaugcugauccccacagugauggcuuuccaccucacgacccggaacggggagccucauaugauuguuagccggcaggaaaagggaaaaucccugcuuuuuaagacaggcgacgggguuaauaugugcacccugauggccauggaucucggagagcugugugaagacacaaucaccuacaaaugcccguuccuuagacaaaacgagcccgaagauauugacuguuggugcaauucuacaagcaccugggugacguauggcaccuguacaaccacaggggagcacagacgggagaagcgcuccguggcgcuggucccucaugugggaaugggccucgaaaccagaacggagacauggaugucuagcgaaggcgcuuggaaacacgcccagcggaucgagaccuggauccugcgccaucccggguuuacaauuauggccgcuauccuggccuacaccauuggaaccacacacuuccagagagcucucaucuuuauucugcuuacggccguugcgccuuccaugaccaugcggugcaucggcauuucuaaccgcgauuucguggagggggucagcggaggcuccuggguggacaucguucuggaacacgggagcugugugacaaccauggccaagaauaagcccacacucgaucuggagcuuaucaaaaccgaagcuaagcagccugccacgcugagaaaauauugcauugaggcuaagcucacaaacaccaccacagaaucucgguguccgacccaaggagagcccucccugaaugaggaacaggacaaacgcuuugucugcaagcauagcaugguggauagaggcuggggcaacggguguggacuguucggcaaggggucuaucgugacaugcgccauguuuacgugcaaaaagauuaugaaaggaaaggucguucagccugagaaucucgaauacaccaucgugauuacaccccacuccggcgaggaacaugcgguggggaacgacaccggaaaauauggcaaggagaucaaaaucacaccucagagcucuauuaccgaggccgaacugacgggcuacgggaccgucacaauggaguguagcccccggaccggacuugauuucaaugaaauggugcugcuccaaauggaggacaaggcuuggcugguucaccgccagugguuucuugaucugccgcucccuuggcugcccggcgccgacacacaggggagcaacuggauccagaaggaaacccuggugacguucaaaaauccucacgcuaagaaacaagacgucgugguucucggaucccaggagggcgccaugcauacagcccugaccggggcuacagagauucagaugucuagcggcaacgugcuuuuuaccggacaccugaagugcagacuccggauggauaaacugcaacuuaagggcauguccuauagcauguguaccgggaaguucaaagucgugaaggaaaucgcggagacacagcauggaacgauugucaucagagugcaguacgaaggcgacgggucucccugcaaaauccccuucgagauuauggaucuggagaagcgccacguucucggacggcugaucaccgugaauccuauugucacaggcaaagacuccccggugaacaucgaagccgagcccccuuuuggggauagcuacauuaucauuggcguugaacccggacagcugaagcucaacugguucaagaaaggcucuagcaucgggcaaauguuuggaaccacaaugagaggcgcuaagcgcauggccauccugggggacaccgccugggauuucggaucccuuggcgggguguuuacgucuauuggcaaagcucugcaucaggucuucggagccaucuauggcgcggcuuuuagcgggguguccuggacaaugaagauucucaccggagugaucauuaccuggaucggcaugaauagccggucuacaucccugagcguuucucugguccuuguggggguggucacccucuaccugggagugaugguucaggccgacuccggcuguguggucagcuggaaaaacaaggagcugaagugcggguccggcaucuucauuacagauaaugugcacacguggaccgaacaguauaaauuucaaccugagucucccagcaagcucgccuccgcuauccagaaagcccacgaggaaggaauuuguggcaucagaucuguuacacgccuggagaaccuuauguggaagcagauuaccccggaacugaaucauauccucagcgagaacgaagugaaacugacaaucaugaccggggacauuaagggaaucaugcaggcuggcaaacggucccugagaccucaacccacggagcuuaaguacagcuggaagaccugggggaaagccaagaugcucucuacagagucccacaaucagaccuuccugauugauggaccugaaacagcggagugccccaacaccaaucgcgccuggaacagccuggaagucgaggacuauggcuuuggcguguucacaaccaauaucuggcucaaacugcgggaaaagcaggacgucuuuugugauucuaaacuuauguccgcugccauuaaggacaacagagcugugcaugccgauaugggguacuggaucgagagcgcgcugaaugacacguggaagaucgagaaagccucuuucauugaagucaagagcugccacuggccuaaaucccacacacucuggagcaacggagugcuggagucugaaaugaucauucccaagaauuucgcuggcccggugucccagcauaacuaucgcccuggguaccacacccaaaccgccggacccuggcaucugggcaaacuugagauggauuuugacuucugugaggggacaaccgucguugugacggaagauugcggaaaccggggccccagccucagaacaaccacagcuuccggcaagcugaucaccgaguggugcugucggucuugcacacugccuccgcuccgcuacagaggggaagacggauguugguauggcauggagauucggccccugaaggaaaaagaggagaaucuugugaacagccuggucaccgccgggcacggacagaucgauaauuuuucccucggcgugcuggggauggcccuguuccuugaagagaugcucagaacgcgcguuggaaccaagcaugcuauucugcugguggcggucucuuuugugacacucaucaccggcaacaugagcuuccgggaccugggcagaguuauggugauggucggggccacaaugaccgaugacaucggaaugggcgugacguaccuugcucugcucgccgccuuuaaaguucgcccuacauucgcugccgggcugcugcuuagaaagcugaccuccaaagaacucaugaugacaaccauuggaaucgugcugcucucucagagcaccauucccgagacaauccuggaacuuacggaugcgcuggcucucggcaugaugguccugaagauggugcggaagauggagaaauaucaacuggccgugaccauuauggccauccuuugcgucccuaaugcuguuauccugcagaacgccuggaagguguccuguacaauucucgcgguggucagcgugucuccccuguuucucaccuccagccagcagaaagcugacuggaucccucuggcccuuacaauuaaggggcugaaucccaccgccaucuuccucacgacacugucucgcaccaacaaaaagagauccuggccgcugaaugaggcuauuauggccguuggaauggugagcauccuugcuucuucccugcucaaaaacgacaucccuaugaccggcccccuggucgccggcgggcuccugacagugugcuacguucuuaccggacggagcgcggaucuggaacuggagcgcgccgcugacgugaagugggaagaucaagccgagauuuccggcagcucuccuauccucagcauuacaaucuccgaagacgggucuaugagcauuaagaaugaggaggaggaacagacgcugaccauccuuauuagaacaggacugcucgucaucuccggccuguuucccgugucuaucccgauuaccgcugccgccugguaucucugggaagucaaaaagcagcgggcuggggugcugugggauguuccuucucccccucccgugggaaaagcggagcuugaggacggcgccuaccgcaucaagcagaaaggcauucugggguauucccaaaucggagcuggcgucuacaaggaagggacauuccacaccauguggcacgugacgagaggagccguucugaugcauaagggcaaacggauugagcccuccugggccgaugugaagaaagaccucaucagcuacgggggaggcuggaagcuggaaggcgaguggaaagaaggggaggagguccaggugcuugcucuggaaccuggaaagaacccgcgcgccgugcagaccaagcccggccucuuuaaaacaaaugcggggaccaucggagcuguuucccuggauuucagcccuggcacaucugggucccccauuaucgacagaaagggaaaagucgugggccucuauggcaacgggguggucacccggagcggagccuacgugucugccauugcucagacagagaaguccaucgaagauaauccugagauugaagacgauaucuucagaaaacgcaagcugacgaucauggaccuucaccccggcgccgggaagaccaaacgguaucugccugcgauuguuagagaggcuaucaagcgcggacugcggacacucauucuggccccgaccagaguggucgccgcugagauggaagaggcccuucgcggccugcccauccgguaccaaaccccugcuauuagagccgaacauacagggcgcgagaucguggaccucaugugucacgcgacguuuaccaugcggcugcucagccccguuagagugccuaacuauaaccugauuaucauggaugaagcccauuucacagaccccgcuuccaucgccgcucggggcuacauuucuacccgcgucgagaugggagaggccgccggcaucuuuaugacagcuaccccgccugggagcagagaucccuucccccaguccaaugcgccuauuauggacgaagaacgggaaauccccgagcgcagcuggucuuccggacacgagugggugacggauuuuaaaggcaagacaguuugguucgugccuagcauuagagccgggaacgacaucgcugccugccuucggaaaaauggaaagaaggucauccagcugucuagaaaaaccuuugauagcgaauaugugaagacccgcacaaacgacugggauuucguggucaccacagacauuuccgagaugggcgccaauuuuaaagcugaacggguuaucgauccgagacgcuguaugaagcccgugauucugaccgacggggaggaacgggugauccucgccggcccuaugcccgucacgcacucuagcgcggcucaaagacgcggacggauuggcagaaacccuaaaaaugagaacgaccaguacaucuacaugggggagccccuggaaaaugaugaggacugcgcccauuggaaggaagccaaaaugcuucuggauaacaucaauacaccggagggaauuaucccuuccauguucgaacccgagcgcgagaagguggacgcuauugauggcgaauauagacucagaggggaagcccgcaagaccuuuguugaccugaugagacggggagaucugccuguguggcucgcguaccgcgucgccgcugaaggcaucaacuaugccgacagacggugguguuucgaugggauuaaaaauaaccagauccuugaggaaaauguggagguugagauuuggacaaaggaaggcgagcgcaagaagcugaaaccccgcuggcuggacgcucggaucuacucugauccucucgcccugaaggaguucaaggaguuugcugccggaagaaaaagccuuacccugaaccucaucacggagaugggccgccugcccaccuucaugacacagaaggcgcgggacgcccuggauaaccucgcugugcuucacaccgccgaagcugggggacgggccuauaaucaugcccuguccgagcugccggaaacacucgagacccugcuucugcucacacugcuggcuaccgucacgggcgggauuuuucucuuccuuaugagcggacggggcaucggcaaaaugacacuggggaugugcugcauuaucaccgcgucuauucugcucugguacgcccaaauccagccucacuggaucgcugccuccauuauccuggaauuuuuccuuauugugcugcucauccccgagcccgagaagcagcgcaccccucaggacaaccaacugacauaugucgugauugccauccugaccguuguggcugccacaauggcgaaugaaaugggauuucucgagaaaacgaagaaggaccuuggccuggggagcaucaccacacagcagccggaauccaacauucuggauaucgaccucagacccgccucugcuuggacccuguacgccguggcuacaaccuucgucacgccuaugcuucggcacagcauugaaaauuccucuguuaacgugagccugaccgccaucgcgaaucaggccacagugcucaugggacugggcaaaggguggccccuguccaagauggauauuggagucccucuccuugcuaucggcuguuacagccaagugaaccccauuacccugacagccgcucuguuucuccugguugcccauuaugcuaucaucggcccugggcuucaggccaaagcgacccgcgaagcccagaagagagcugccgcuggaauuaugaaaaauccgacgguggacggcaucacagucauugaucuggaccccaucccuuacgaucccaaguucgagaagcagcucgggcaagugaugcugcugguccucugcgugacccagguucuuaugaugcggacaaccugggcccugugugaggcccugacccucgcgacaggaccuauuucuacgcugugggaaggcaaccccgggcgcuuuuggaauaccacaaucgcuguguccauggccaacaucuucagaggaagcuaucuugcuggcgccggccugcucuuuucuauuaugaaaaauaccacaaacacccggcgcgggacgggaaauaucggcgagacacugggggaaaaguggaaauccagacugaacgcccucggaaagagcgaguuccagauuuacaaaaagucuggcauccaagaagucgaccggacccuugcuaaagaggggauuaagagaggagagaccgaucaccaugccgugagccgcggcuccgcgaagcugcggugguucguugaaagaaauauggugacaccggagggcaaagucguggaccuggggugcggacgcggcggguggucuuauuacuguggaggccucaagaacgugcgggaaguuaaagggcugaccaagggaggcccuggccacgaggagcccauccccaugagcacauauggguggaaccuugucagacugcaguccggaguggauguguuuuucacgccucccgaaaaaugcgacacccuccugugugauaucggcgagagcuccccuaauccgacagucgaagccgggcgcacccugcggguucucaaccuuguggagaauuggcugaacaauaacacacaguuuugcauuaaggugcugaaucccuacaugccuucugucaucgaaaagauggaggcucuccagagaaaauacggaggcgcccuggugcgcaacccccuuagcagaaauuccacccaugagauguauuggguuucuaacgcuagcgggaauauuguguccucugucaacaugaucagcagaaugcugauuaaucgcuucacgaugcggcacaagaaagccaccuacgaaccugacguggaccucggauccggcacaagaaacaucggcaucgagagcgaaauucccaaucuggauaucauugggaagcgcaucgagaaaauuaagcaagaauaugagaccucuuggcacuacgaccaggaucauccguauaagacaugggcguaccacggauccuaugagaccaaacagacaggcagcgccucuuccaugguuaacgggguggucagacugcucaccaagccuugggacguggugcccauggucacgcagauggcuaugacagauaccaccccuuuuggacaacagcggguuuucaaagaaaagguggacacacgcacgcaggagcccaaagaaggcaccaagaaacuuaugaaaaucacagccgaguggcuguggaaggaacuggggaaaaagaaaaccccuagaauguguacacgggaggaguuuaccagaaaggugcggagcaacgcugcccucggagcuauuuucacagaugaaaauaaauggaagucugcccgcgaggcggucgaagacuccagauuuugggagcugguggauaaggagcggaaccuucaucuggaaggcaaaugcgagaccuguguuuacaauaugaugggcaagcgcgagaaaaagcucggggaguucggaaaagccaagggcagcagagcuaucugguacauguggcugggggcccgguuucuggaguucgaggcucucggauuucugaacgaggaccacugguucucccgcgaaaauagccuuucuggcguggagggggaaggccugcacaagcucggauauauccugagagaugucagcaaaaaggagggcggggccauguacgccgacgacacggcgggaugggauacccggauuacacuugaagaccugaaaaacgaggagauggugaccaaucauauggaaggcgagcacaagaaacucgcugaagccaucuucaagcugacauaucagaacaagguugugcgcguccaaagacccaccccgcgggggacggugauggauauuaucucccgcagagaccagcggggaucuggccagguugggacauacggccugaauaccuuuacaaacauggaggcccaacucauucgccagauggaaggagagggcguguucaaaaauauccagcaucugaccgucacggaggaaaucgcugugcagaacuggcuugccagagucgggcgggagagacugagccgcauggcuauuuccggagaugacugcgugguuaagccucucgaugaccgguuugccucugcgcugaccgcccuuaaugauaugggcaaagugagaaaggacauccaacagugggaacccagccgcggguggaacgauuggacacagguccccuucugcucccaccauuuucacgagcugauuaugaaagacggacgggugcucgugguuccuuguagaaaucaggaugagcugaucggccgcgcucggauuucucaaggggccggcuggagccugagagaaaccgcuugccucggaaaguccuaugcccagauguggagccugauguacuuccaccgccgggaccuuagacuggcggccaacgcuaucuguucugccgugccgucccauuggguccccacaagccgcaccacauggucuauccacgcuaagcaugaguggaugaccacggaagacaugcucacaguguggaaccggguuuggauucaggagaauccuuggauggaagauaaaacccccguggaguccugggaggaaaucccuuaucugggcaagagagaggaccaguggugcgggagccuuauuggacugaccucccgggccacaugggcuaaaaacauccaaaccgccauuaaucaggucagaucucucaucggcaacgaagaguacacagauuacaugcccagcaugaagcgcuuucggagagaagaggaggaagcgggggugcugugguga

SEQ ID NO: 19569 - RNA, 9876 nt, Artificial Sequence
  derived and/or modified CDS sequence (opt5) from DENV-2__KF704354__SS-prME
accgccggcaugaucauuaugcugauccccacagugauggcuuuccaccucacgaccagaaacggggagccucauaugauugugagccggcaggaaaagggaaagucccugcuuuuuaagacagaggacggcguuaauaugugcacccugauggccauggaucucggggaacugugugaggacacaaucaccuacaagugcccguuccuuagacaaaacgaacccgaggauauugacuguuggugcaauucuacaagcaccugggugacguauggaaccuguacaaccacaggcgagcacagacgggaaaagcgcuccguggcgcuggucccucauguggggaugggacucgagaccagaacggaaacauggaugucuagcgagggcgcuuggaagcacgcccagcggaucgagaccuggauccugcgccaucccggcuuuacaauuauggccgcuauccuggccuacaccauugggaccacacacuuccagagagcucucaucuuuauucugcuuacggccguugcgccuuccaugaccaugcggugcaucggaauuucuaaccgcgauuucguggaaggcgucagcgggggauccuggguggacaucguucuggagcacggcagcugugugacaaccauggccaagaauaagcccacacucgauuuugaacugaucaaaaccgaggcuaagcagccugccacgcuuagaaaauauugcauugaagcuaagcugacaaacaccaccacagagucucgguguccgacccaaggggagcccucccucaaugaagaacaggacaaacgcuucgucugcaagcauagcaugguggauagaggauggggcaacggcugugggcuguuuggaaagggcgggaucgugacaugcgccauguucacgugcaaaaagauuaugaaaggaaaggucguucagccugaaaaucuggaguacaccaucgugauuacaccccacucuggcgaagaacaugcgguggggaacgacaccggaaaacacggcaaggagaucaaaaucacaccucaguccagcauuaccgaagccgagcucacgggcuaugggaccgucacaauggaauguucuccccggaccggacuggauuuuaaugagauggugcuucugcaaauggaaaacaaggcuuggcucguucaccgccagugguuccuggaccuuccgcugccuuggcuccccggcgccgauacacagggguccaauuggauccagaaggagacccuggugacguuuaaaaacccucaugcuaagaaacaagacgucgugguucugggaagccaggagggcgccaugcacacagcccucaccggggcuacagaaauucagauguccucuggcaaugugcuguucaccggacaucuuaagugcagacugcggauggacaaacuccaacugaagggcaugagcuacuccauguguaccgggaaguucaaagucgugaaggagaucgcggaaacacagcacggaacgauugucaucagagugcaguaugagggcgaugggagccccugcaaaauccccuuugagauuauggaccuugaaaagcgccauguucugggacggcucaucaccgugaacccuauugucacaggcaaagauucuccggugaacaucgaggccgaacccccuuucggggacuccuacauuaucauuggcguugagcccggacagcugaagcugaauugguuuaagaaaggcagcucuaucgggcaaauguucgcuaccacaaugagaggagccaagcgcauggccauccucggcgauaccgcuugggacuuugggagccugggaggcguguucacguccauugggaaagcccuucaccaggucuuuggcgcgaucuacggagcugccuucucuggcgugagcuggacaaugaagauucugaucggggugauuaucaccuggaucggaaugaacucccggagcaccucucucuccguuagccugguccuggugggcguggucacacuuuaucucggggugaugguucaggccgauucuggauguguggucuccuggaaaaauaaggaacugaagugcggcagcgggauuuuuaucaccgacaacgugcacacauggacggagcaguacaaauuccaaccugagucccccucuaagcuggcuagcgccauucagaaagcucaugaagagggcaucuguggaauuagauccguuacccgccucgaaaaucugauguggaagcagaucacaccggagcuuaaccacauccugucugaaaaugaggugaaacucaccauuaugacaggcgauaucaaggggauuaugcaggccggaaaacggagccugagaccucaacccaccgagcugaaguauuccuggaagacguggggcaaagcgaagaugcuuagcaccgaaucucauaaccagacauuucucaucgacgggccugagaccgccgaaugccccaauacaaaccgcgcuuggaacucccuggaggucgaagauuacggauucggcguguuuaccacaaacauuuggcugaaacuccgggaggagcaggacguuuucugugacagcaagcugaugucugccgcuaucaaagauaauagagccgugcacgcggacaugggcuauuggaucgaauccgcccuuaacgauaccuggaagauugagaaggcuagcuucaucgaagucaaaucuugccacuggccuaagagccauacgcugugguccaauggggugcucgagagcgagaugauuauccccaaaaacuuugccggaccggugucucagcacaacuaccgcccuggcuaucauacacaaaccgcugggcccuggcaccugggaaagcuggaaauggacuucgauuuuugugagggcaccacagucguugugaccgaagacugcgggaaucggggacccucccuuagaacgacaaccgccagcggcaaacucauuacagaguggugcugucgguccugcacccugccuccgcugcgcuacagaggcgaagauggguguugguacggaauggagauccggccccucaaggagaaggaagagaaccuggucaauucucuugucacagccggccaugggcagauugacaacuucagccugggagugcucggcauggcucuguuucuggaagagaugcuuagaacccgcguugggacgaaacacgcgauccuccugguggccgucuccuucgugacccugaucacaggaaauaugucuuuucgggaucucggcagaguuauggugauggucggcgcuaccaugacagacgauauugggaugggagugaccuaucuggcccuucuggccgcuuucaagguucgcccuacguuugccgcgggccuccugcugagaaaacuuacaagcaaggaacugaugaugaccacaaucgggauugugcuccugucccagucuaccauccccgagaccauucucgagcugacagacgcucuugcccugggaaugaugguccucaaaauggugcggaagauggaaaaguaccaacuggccgugacgaucauggcuauccugugcgucccuaacgccguuauucuucagaauaccuggaaagugagcuguacaauccuggcgguggucuccgugagcccccucuuccugaccucuucccagcagaaggcugauuggauuccucucgcccugacaaucaaaggccuuaaccccaccgccauuuuucugacgacacucagccgcaccaauaagaaaagaucuuggccgcugaacgaggcuaucauggccguugggaugguguccauccuggcuagcucucuucugaagaaugacauuccuaugaccggaccccucgucgccggcggccugcucacagugugcuauguucugaccgggcgguccgcggaccuugaacuggagcgcgccgcugaugugaaaugggaagaccaagccgagaucagcggauccagcccuauucugucuaucacaauuagcgaggauggcuccaugucuaucaagaacgaagaggaggaacagacgcucaccauucugaucagaacagggcuucuggucaucagcggacucuuccccguguccauuccgaucaccgcugccgccugguaccugugggaggucaagaaacagcgggcuggcgugcucugggacguuccuucucccccucccguggggaaggcggaacuggaggauggagccuaucgcauuaaacagaagggcauccuuggcuacagccaaauuggggcuggagucuauaaagaaggcacauuucacaccauguggcaugugacgagaggggccguucugaugcacaagggaaagcggaucgagcccuccugggccgacgugaaaaaggaucugaucucuuacggcgggggauggcgccucgaaggcgaguggaaagagggcgaagagguccaggugcuggcucuugaaccugggaagaauccgagagccgugcagaccaaacccggacuguucaagacaaacgcgggcaccauuggggcuguuagccucgacuucuccccuggaacaagcggcucucccaucauugauaagaaagggaaggucgugggacuguacggcaauggcguggucacccgguccggggccuaugugagcgccaucgcucagacagagaaaucuauugaagacaacccugagaucgaggaugacaucuuuagaaagcgcaaacucacgauuauggaucugcaucccggagccggcaagaccaagcgguaccuuccugcgaucguuagagaagcuauuaaacgcgggcugcggacacugauccucgccccgaccagaguggucgccgcugagauggaagaggcccugcgcggacuucccauucgguaucaaaccccugcuaucagagccgaacacacaggccgcgagauuguggaccugaugugucaugcgacguucaccaugcggcuccugucccccguuagagugccuaacuacaaucucaucaucauggacgaggcccacuuuacagaucccgcuagcauugccgcucggggguauaucuccacccgcgucgaaaugggcgaggccgccggaauuuucaugacagcuaccccgccuggcucuagagaccccuuuccccagagcaacgcgccuaucauggaugaggaacgggagauucccgaacgcuccuggagcucugggcacgagugggugacggacuucaagggaaaaacaguuugguuugugccuuccaucaaggccggcaaugauaucgcugccugccugcgcaagaaugggaagaaggucauucagcuuagccggaaaaccuucgacucugaauacgugaagaccagaacaaaugauugggacuuuguggucaccacagauaucagcgagaugggagccaacuucaaagcugaacgcguuauugacccgcggagauguaugaagcccgugauccugaccgauggcgaggagcgcgugauucuggccgggccuaugcccgucacgcauuccucugcggcucaacggagaggccgcaucggacggaauccuaaaaacgaaaaugaccaguauaucuacaugggcgagccccucgaaaacgacgaggauugcgcccacuggaaggaagccaaaaugcugcuugacaauauuaacacaccggaggggaucauuccuagcauguuugagcccgaaagagagaagguggaugcuaucgacggagaauaccgccugagaggcgaggcccggaagaccuucguugaucucaugcgcagaggggaccugccuguguggcuggcguaucgggucgccgcugaaggaauuaauuacgccgaucgcagaugguguuucgacggcaucaaaaacaaucagauucucgaggagaacguggaaguugagaucuggacaaaggaaggggagcggaagaaacuuaaacccagauggcuggaugcucgcaucuauuccgacccucuggcccucaaagaguuuaaggaguucgcugccggccggaaaucucugacccuuaaccugauuacggagaugggaagacuccccaccuuuaugacacagaaggcgcgcgaugcccuggacaaucuggcugugcuccauaccgccgaagcuggcgggcgggccuacaaccacgcccuuagcgagcugccggaaacacuggagacccuccugcuucugacacuccuggcuaccgucacgggaggcaucuuccuguuucucauguccgggagaggaauuggcaaaaugacacuuggcaugugcugcaucauuaccgcgagcauccugcugugguaugcccaaauccagccucacuggauugcugccucuaucauucucgaguucuuucugaucgugcuucugauucccgaacccgagaagcagcggaccccucaggauaaucaacucacauacgucgugaucgccauccugaccguuguggcugccacaauggcgaacgaaaugggguuccuggagaaaacgaagaaggaccucggauggggcuccauuaccacacagcagccggaaagcaauauccuugacauugaucugcgccccgccuccgcuuggacccuguaugccguggcuacaaccuuugucacgccuaugcucagacauucuaucgagaacagcuccguuaaugugucucugaccgccauugcgaaccaggccacagugcuuauggggcugggaaaaggcuggccccucagcaagauggacaucggggucccucugcuggcuauuggauguuacucccaagugaaucccaucacccucacagccgcucuuuuccugcugguugcccacuacgcuaucauuggcccuggccuccaggccaaagcgacccgggaggcccagaagcgcgcugccgcugggaucaugaaaaacccgacgguggauggaauuacagucaucgaccuggaucccauuccuuaugaccccaaguuugaaaagcagcuuggccaagugaugcugcucguccugugcgugacccagguucugaugaugagaacaaccugggcccucugugaggcccuuacccuggcgacagggccuaucagcacgcugugggaaggaaaucccggccgguucuggaacaccacaaucgcugugucuauggccaauauuuuucgcggguccuaccucgcuggagccggccugcuuuucagcaucaugaaaaacaccacaaauaccagacggggcacggggaacaugggagagacacugggcgaaaaguggaaaucucgccucaaugcccuggggaaguccgaguuccagauuuauaaaaagagcggaauccaagaggucgauagaacccuggcuaaagaaggcauuaagagaggggaaaccgaccaucacgccgugucuagaggaagcgcgaagcuccgcugguuuguugaacggaacauggugacaccggagggcaaagucguggaucuuggcugcgggagaggaggcugguccuacuauugugggggacugaagaacgugcgcgagguuaaaggccugaccaaagggggaccuggccaugaggagcccauccccaugucuacauacggcuggaaucucguccggcugcagagcgggguggacguguucuuuacgccucccgaaaaaugcgauacccuucugugugacaucggagaguccagcccuaacccgacagucgaagccggcagaacccuccgcguucugaaucugguggagaacuggcucaauaacaauacacaguucugcauuaaggugcuuaaccccuauaugccuuccgucaucgagaagauggaagcucugcagcggaaauacgggggagcccuggugagaaauccccucucucgcaacagcacccacgagauguacuggguuuccaaugcuucuggcaacauugugagcuccgucaauaugaucucucggaugcugauuaacagauuuacgaugcgccacaagaaagccaccuucgaaccugauguggaccuugggagcggaacacggaauaucggcaucgaguccgaaauucccaaccuggacaucauuggcaagagaaucgagaaaauuaagcaagaguaugaaaccagcuggcauuacgaucaggaccacccguauaagacaugggcguaccaugggucuuaugagaccaaacagacaggauccgccagcucuaugguuaacggcgugguccgccuccugaccaagccuugggauguggugcccauggucacgcagauggcuaugacagacaccaccccuuuugggcaacagagaguuuucaaagaaaagguggauacacggacgcaggagcccaaagaaggaaccaagaagcugaugaaaaucacagccgaguggcucuggaaggagcuuggcaaaaagaaaaccccucgcauguguacaagagaagaguuuacccggaaggugagauccaaugcugcccugggggcuauuuucacagacgaaaacaaauggaaaagcgcccgggaggcggucgaggauucucgcuuuugggaacugguggacaaggagagaaaucuccaccuggaaggaaaaugcgagaccuguguuuacaacaugaugggcaagcgggagaagaaacuuggcgaguucgggaaagccaagggaucccgcgcuaucugguauauguggcugggcgccagauuucucgaguucgaagcucugggguuccugaaugaggaucacugguuuagccgggaaaacucccucagcggaguggagggcgaagggcugcauaaacuuggcuacauccugcgcgacgucucuaaaaaggagggaggcgccauguacgccgaugacacggcggggugggacaccagaauuacacucgaggaucugaaaaaugaagagauggugaccaaccacauggaaggagagcauaagaaacuugcugaagccaucuucaagcugacauaucagaauaagguugugcggguccaacgccccaccccgagaggcacggugauggacauuaucagccggcgcgaucagagaggguccggacagguuggcacauacgggcucaacaccuuuacaaauauggaggcccaacugauucggcagauggagggcgaaggaguguucaaaaacauccagcaccugaccgucacggaggaaaucgcugugcagaauuggcucgcccgcgucggcagagagcggcugucuagaauggcuauuagcggggacgauugcgugguuaagccucuugacgaucgcuuugccuccgcgcugaccgcccucaacgacaugggaaaagugcggaaggauauccaacagugggagcccucuagaggcuggaaugacuggacacagguccccuucugcagccaucacuuucacgaacugauuaugaaagaugggcgcgugcuugugguuccuugucggaaccaggacgagcugaucggacgggcucgcauuucccaaggcgccggguggucucuccgggaaaccgcuugccugggcaagagcuaugcccagauguggucccugauguacuuccauagacgcgaucuccggcuggcggccaacgcuaucuguagcgccgugccgucucacuggguccccacauccagaaccacauggagcauccaugcuaagcacgaguggaugaccacggaagacaugcuuacaguguggaaucgcguuuggauucaggagaacccuuggauggaggacaaaacccccguggaaucuugggaggaaaucccuuaucugggaaagcgggaggaucaguggugcggcucccucauugggcugaccagcagagccacaugggcuaaaaauauccaaaccgccauuaaccagguccggucccuuaucggaaaugaagaguacacagacuauaugcccucuaugaagagauuucgccgggaggaagaggaagcgggcgugcugugguga

SEQ ID NO: 19570 - RNA, 9876 nt, Artificial Sequence
  derived and/or modified CDS sequence (opt5) from DENV-2__KF704357__SS-prME
accgccggcaugaucauuaugcugauccccacagugauggcuuuccaccucacgacccggaacggggagccucauaugauugucagccggcaggaaaagggaaaaucccugcuuuuuaagacaggcgacgggguuaauaugugcacccugauggccauggaucucggagagcugugugaagacacaaucaccuacaaaugcccgcuucugcgccaaaacgagcccgaagauauugacuguuggugcaauucuacaagcaccugggugacguauggcaccuguacaaccacaggggagcaccggcgggagaagcgcuccguggcgcucgucccucaugugggaaugggccuggaaaccagaacggagacauggaugucuagcgaaggcgcuuggaaacacgcccagcggaucgagaccuggauccugcgccaucccggguucacaauuauggccgcuauccucgccuacaccauuggaaccacacacuuucagagagcucugaucuucauucuucugacggccguugcgccuuccaugaccaugcggugcaucggcauuucuaaccgcgauuuuguggagggggucagcggaggcuccuggguggacaucguucucgaacacgggagcugugugacaaccauggccaagaauaagcccacacuggaucuugagcugaucaaaaccgaagcuaagcagccugccacgcucagaaaauauugcauugaggcuaagcugacaaacaccaccacagaaucucgguguccgacccaaggagagcccucccugaaugaggaacaggacaaacgcuucgucugcaagcauagcaugguggauagaggcuggggcaacggguguggacucuuuggcaaggggucuaucgugacaugcgccauguucacgugcaaaaagauuaugaaaggaaaggucguucagccugagaaucuggaauacaccaucgugauuacaccccacuccggcgaggaacaugcgguggggaacgacaccggaaaacacggcaaggagaucaaaaucacaccucagagcucuauuaccgaggccgaacuuacgggcuaugggaccgucacaauggaguguagcccccggaccggacuggauuuuaaugaaauggugcuccugcaaauggaggacaaggcuuggcuuguucaccgccagugguuccuggaucucccgcugccuuggcugcccggcgccgacacacaggggagcaacuggauccagaaggaaacccucgugacguuuaaaaauccucaugcuaagaaacaagacgucgugguucugggaucccaggagggcgccaugcacacagcccuuaccggggcuacagagauucagaugucuagcggcaacgugcuguucaccggacaucucaagugcagacugcggauggauaaacuucaacugaagggcauguccuacagcauguguaccgggaaguuuaaagucgugaaggaaaucgcggagacacagcacggaacgauugucaucagagugcaguaugaaggcgacgggucucccugcaaaauccccuucgagauuauggaucucgagaagcgccauguucugggacggcugaucaccgugaauccuauugucacaggcaaagacuccccggugaacaucgaagccgagcccccuuucggggauagcuacauuaucauuggcguugaacccggacagcucaagcugaacugguuuaagaaaggcucuagcaucgggcaaauguucgcuaccacaaugagaggagccaagcgcauggccauccuuggcgacaccgcuugggauuuugggucccugggaggcguguucacgucuauugggaaagcccuccaccaggucuuuggcgcgaucuacggagcugccuucagcggcguguccuggacaaugaagauucugaucggggugauuaucaccuggaucggaaugaauagccggucuaccucccugagcguuucucuuguccucgugggcguggucacacuguaucugggggugaugguucaggccgacuccggauguguggucagcuggaaaaacaaggagcucaagugcggcuccgggauuuuuaucaccgauaaugugcacacauggacggaacaguacaaauuccaaccugagucucccagcaagcuggcuuccgccauucagaaagcucaugaggaaggcaucuguggaauuagaucuguuacccgccuugagaaccugauguggaagcagaucacaccggaacucaaucacauccugagcgagaacgaagugaaacugaccauuaugacaggcgacaucaaggggauuaugcaggccggaaaacggucccuuagaccucaacccaccgagcucaaguauagcuggaagacguggggcaaagcgaagaugcugucuaccgagucccauaaucagacauuucugaucgaugggccugaaaccgccgagugccccaacacaaaucgcgcuuggaacagccucgaagucgaggacuacggauucggcguguuuaccacaaauauuuggcugaaacuucgggaagaacaggacguuuucugugauucuaagcugauguccgccgcuaucaaagacaacagagccgugcacgcggauaugggcuauuggaucgagagcgcccucaaugacaccuggaagauugaaaaggcuucuuuuaucgaggucaaaagcugccacuggccuaagucccauacgcuguggagcaacggggugcuggaaucugagaugauuauccccaaaaauuucgccggaccggugucccagcacaacuaccgcccuggcuaucauacacaaaccgcugggcccuggcaccuuggaaagcucgagauggauuucgacuuuugugaaggcaccacagucguugugaccgaggauugcgggaaccggggacccagccugagaacgacaaccgccuccggcaaacugauuacagaauggugcugucggucuugcacccucccuccgcugcgcuacagaggcgaggacggguguugguacggaauggaaauccggccccuuaaggagaaggaggaaaaucuggugaacagccucgucacagccggccaugggcagauugauaauuucucccugggagugcugggcauggcucuuuuucucgaggaaaugcugagaacccgcguugggacgaaacacgcgauccugcucguggccgucucuuucgugacccugaucacaggaaacaugagcuuucgggaccuuggcagaguuauggugauggucggcgcuaccaugacagaugacauugggaugggagugaccuaucuggcccuccuggccgcuuucaagguucgcccuacguuugccgcgggccugcuucugagaaaacucacauccaaggagcugaugaugaccacaaucgggauugugcuccugucucagagcaccauccccgaaaccauucuugagcugacagaugcucucgcccugggaaugaugguccugaaaauggugcggaagauggagaaguaccaacuugccgugacgaucauggcuauccugugcgucccuaaugccguuauucuccagaacaccuggaaaguguccuguacaauccuggcgguggucagcgugucuccccucuuccugaccuccagccagcagaaggcugacuggauuccucuugcccugacaaucaaaggccucaaucccaccgccauuuuucugacgacacugucucgcaccaacaagaaaagauccuggccgcuuaaugaagcuaucauggccguugggauggugagcauccuggcuucuucccuccugaagaacgacauuccuaugaccggaccccucgucgccggcggccugcuuacagugugcuauguucugaccgggcggagcgcggaucuggagcucgaacgcgccgcugacgugaaaugggaggaucaagccgaaaucuccggaagcucuccuauucugagcaucacaauuuccgaggacggcucuaugagcaucaagaaugaggaagaggaacagacgcuuaccauucugaucagaacagggcuccuggucaucuccggacucuuccccgugucuauuccgaucaccgcugccgccugguaccugugggaggucaagaaacagcgggcuggcgugcuuugggauguuccuucucccccucccguggggaaggcggagcuggaagacggagccuaucgcauuaaacagaagggcauccugggcuacucccaaauuggggcuggagucuauaaagagggcacauuucacaccauguggcaugugacgagaggggccguucucaugcacaagggaaagcggaucgaacccuccugggccgaugugaaaaaggaccugaucagcuacggcgggggauggaaacuugagggcgaauggaaggagggcgaggaaguccaggugcuggcucucgagccugggaaaaacccgcgcgccgugcagaccaagcccggacuguucaagacaaaugcgggcaccauuggggcuguuucccucgauuuuagcccuggaacaucuggcucccccaucauugacagaaaagggaaggucgugggacuguacggcaacggcguggucacccggagcggggccuaugugucugccaucgcucagacagaaaaauccauugaggauaauccugaaaucgaggacgauaucuucagaaagcgcaaacuuacgauuauggaccugcaucccggagccggcaagaccaagcgguaccugccugcgaucguuagagaggcuauuaaacgcgggcuccggacacugauccuugccccgaccagaguggucgccgcugaaauggaggaagcccugcgcggacuccccauucgguaucaaaccccugcuaucagagccgagcacacaggccgcgaaauuguggaccugaugugucaugcgacguucaccaugcggcuccugagccccguuagagugccuaacuacaaccuuaucaucauggaugaggcccacuuuacagaccccgcuuccauugccgcucggggguauaucucuacccgcgucgagaugggcgaagccgccggaauuuucaugacagcuaccccgccuggcagcagagaucccuuuccccaguccaaugcgccuaucauggacgaggaacgggagauucccgagcgcagcuggucuuccgggcacgaaugggugacggauuucaagggaaaaacaguuugguuugugccuagcaucagagccggcaacgacaucgcugccugccugcggaagaaugggaaaaaggucauucagcugucuagaaagaccuucgauagcgaguacgugaaaacccgcacaaacgacugggauuuuguggucaccacagacaucuccgaaaugggagccaauuucaaggcugagcggguuauugauccgagacgcuguaugaaacccgugauccucaccgacggcgaggaacgggugauucuggccgggccuaugcccgucacgcauucuagcgcggcucaaagacgcggccggaucggaagaaacccuaagaaugagaacgaccaguauaucuacaugggcgaaccccuugagaaugaugaagacugcgcccacuggaaagaggccaagaugcugcucgauaacauuaauacaccggaagggaucauuccuuccauguuugagcccgagcgcgaaaaaguggacgcuaucgauggagaguacagacugcggggcgaagcccgcaagaccuucguugaccugaugagaagaggggaucucccuguguggcuugcguaucgcgucgccgcugagggaauuaacuacgccgacagacggugguguuuugauggcaucaagaauaaccagauucuggaagagaauguggagguugaaaucuggacaaaagagggggaaagaaagaaacugaagccccgcuggcucgacgcucggaucuauucugauccucuggcccuuaaagaguucaaggaguucgcugccggcagaaagagccugacccucaaccugauuacggaaaugggacgccugcccaccuuuaugacacagaaagcgcgggacgcccucgauaaccuugcugugcugcauaccgccgaggcuggcgggagagccuacaaucacgcccuguccgaacucccggagacacuggaaacccuucugcuccugacacugcucgcuaccgucacgggaggcaucuuccuuuuucugaugagcgggcggggaauuggcaagaugacacugggcaugugcugcaucauuaccgcgucuauccuccugugguaugcccaaauccagccucacuggauugcugccuccaucauucuugaguucuuucugaucgugcuccugauucccgagcccgaaaaacagcgcaccccucaggacaaccaacugacauacgucgugaucgccauccucaccguuguggcugccacaauggcgaaugagaugggguuccuugaaaagacgaaaaaggaccugggacugggcagcauuaccacacagcagccggaguccaacauccucgauauugaccugagacccgccucugcuuggacccuuuaugccguggcuacaaccuuugucacgccuaugcugcggcauagcaucgaaaauuccucuguuaacgugagccucaccgccauugcgaaucaggccacagugcugauggggcugggaaagggcuggccccucuccaaaauggauaucggggucccucuucuggcuauuggauguuacagccaagugaaccccaucacccugacagccgcucucuuccugcuuguugcccacuacgcuaucauuggcccuggccugcaggccaaggcgacccgcgaggcccagaaaagagcugccgcugggaucaugaagaauccgacgguggacggaauuacagucaucgaucucgaccccauuccuuaugaucccaaauuugagaagcagcugggccaagugaugcugcucguccuuugcgugacccagguucugaugaugcggacaaccugggcccugugugaagcccucacccuggcgacagggccuaucucuacgcuuugggagggaaaccccggccgcuucuggaauaccacaaucgcuguguccauggccaacauuuuuagagggagcuaccuggcuggagccggccuccuguucucuaucaugaagaauaccacaaacacccggcgcggcacggggaauaugggagaaacacugggcgagaaauggaaguccagacucaacgcccuugggaaaagcgaauuucagauuuauaagaaaucuggaauccaagaggucgaccggacccuggcuaaggagggcauuaaaagaggggaaaccgaucaucacgccgugagccgcggauccgcgaagcugcggugguucguugagagaaauauggugacaccggaaggcaaggucguggaccucggcugcgggcgcggaggcuggucuuacuauugugggggacugaaaaacgugcgggagguuaagggccuuaccaaagggggaccuggccaugaggaacccauccccaugagcacauacggcuggaaccuggucagacuccaguccgggguggauguguucuuuacgccucccgagaagugcgacacccugcugugugauaucggagaaagcuccccuaauccgacagucgaggccggccgcacccuccggguucuuaaccugguggaaaauuggcugaacaauaacacacaguucugcauuaaagugcucaaucccuauaugccuucugucaucgagaagauggaggcucugcagagaaaguacgggggagcccuugugcgcaacccccugagcagaaauuccacccacgaaauguacuggguuucuaacgcuagcggcaauauuguguccucugucaacaugaucagcagaaugcucauuaaucgcuuuacgaugcggcacaaaaaggccaccuucgagccugacguggaccugggguccggaacaagaaacaucggcaucgaaagcgagauucccaaucuggauaucauuggcaaacgcaucgaaaagauuaaacaagaguaugagaccucuuggcauuacgaccaggaucacccguauaagacaugggcguaccauggguccuaugaaaccaagcagacaggaagcgccucuuccaugguuaacggcguggucagacuccuuaccaaaccuugggacguggugcccauggucacgcagauggcuaugacagauaccaccccuuuugggcaacagcggguuuucaaggagaaaguggacacacgcacgcaggaacccaaggagggaaccaaaaagcugaugaagaucacagccgaauggcuguggaaagagcucggcaagaaaaagaccccuagaauguguacacgggaggaauuuaccagaaaagugcggagcaacgcugcccugggggcuauuuucacagaugagaauaaguggaaaucugcccgcgaagcggucgaggacuccagauuuugggagcuuguggauaaggaacggaaccugcaccucgagggaaagugcgaaaccuguguuuacaauaugaugggcaaacgcgagaagaaacugggcgaguucgggaaggccaaaggaagcagagcuaucugguauauguggcugggcgcccgguuucucgaguucgaggcucugggguuucuuaacgaagaccacugguucucccgcgagaauagccugucuggaguggaaggcgaggggcuccauaagcugggcuacauccuuagagaugucagcaagaaagaaggaggcgccauguacgccgacgacacggcggggugggauacccggauuacacuggaggaccucaagaacgaggaaauggugaccaaucacauggagggagaacauaaaaagcuggcugaggccaucuucaaacugacauaucagaacaagguugugcgcguccaaagacccaccccgcggggcacggugauggauauuaucucccgcagagaccagcgggggucuggacagguuggcacauacgggcucaauaccuuuacaaacauggaagcccaacugauucgccagauggagggcgagggaguguucaagaauauccagcaccuuaccgucacggaagagaucgcugugcagaacuggcuggccagagucggccgggaaagacucagccgcauggcuauuuccggggaugacugcgugguuaaaccucuggaugaccgguuugccucugcgcuuaccgcccugaaugauaugggaaaggugagaaaagacauccaacagugggagcccagccgcggcuggaacgauuggacacagguccccuucugcucccaucacuuucacgagcucauuaugaaggacgggcgggugcuggugguuccuuguagaaaucaggaugaacugaucggacgcgcucggauuucucaaggcgccggguggagccucagagagaccgcuugccugggcaaauccuaugcccagauguggagccuuauguacuuccaucgccgggaccugagacucgcggccaacgcuaucuguucugccgugccgucccacuggguccccacaagccgcaccacauggucuauccaugcuaagcacgaauggaugaccacggaggacaugcugacaguguggaaccggguuuggauucaggaaaauccuuggauggaggauaagacccccguggaguccugggaagagaucccuuaucuuggaaaaagagaagaccaguggugcggcagccugauugggcucaccucccgggccacaugggcuaagaacauccaaaccgccauuaaucaggucagaucucugaucggaaacgaggaauacacagauuauaugcccagcaugaaacgcuuucggagagaggaggaagaggcgggcgugcugugguga

SEQ ID NO: 19571 - RNA, 9876 nt, Artificial Sequence
  derived and/or modified CDS sequence (opt5) from DENV-2__KF704358__SS-prME
acagccggaaugaucauuaugcugauccccacagugauggcuuuccaccucacgaccagaaacggggaaccucauaugauugucagccggcaggaaaagggaaagucccugcuuuuuaauacaggcgacgggguucacaugugcacccugauggccaugcaucucggagagcugugugaagauacaaucaccuacaagugcccgcuucugagacaaaacgagcccgaagacauugauuguuggugcaauucuacaagcaccugggugacguauggcaccuguacaaccacaggggagcacagacgggagaaacgcuccguggcgcucgucccucaugugggaaugggccuggaaaccagaacggagacauggaugucuagcgaaggcgcuuggaagcacgcccagcggaucgagaccuggauccugcgccaccccggguucacaauuauggccgcuauccucgccuacaccauuggaaccacacauuuucagagagcucugaucuucauucuucugacggccguugcgccuuccaugaccaugcggugcaucggcauuucuaaccgcgacuuuguggagggggucagcggaggcuccuggguggauaucguucucgaacacgggagcugugugacaaccauggccaaaaauaagcccacacuggaccuugagcugaucaagaccgaagcuaaacagccugccacgcucagaaaguauugcauugaggcuaaacugacaaacaccaccacagaaucucgguguccgacccaaggagagcccucccugaaugaggaacaggauaagcgcuucgucugcaaacauagcaugguggacagaggcuggggcaacggguguggacucuuuggcaaggggucuaucgugacaugcgccauguucacgugcaagaaaauuaugaagggaaaagucguucagccugagaaucuggaauacaccaucgugauuacaccccacuccggcgaggaacacgcgguggggaacgauaccggaaagcauggcaaagagaucaagaucacaccucagagcucuauuaccgaggccgaacuuacgggcuaugggaccgucacaauggaguguagcccccggaccggacuggacuuuaaugaaauggugcuccugcaaauggaggauaaggcuuggcuuguucaccgccagugguuccuggaccucccgcugccuuggcugcccggcgccgauacacaggggagcaacuggauccagaaggaaacccucgugacguuuaagaauccucaugcuaaaaagcaagacgucgugguucugggaucccaggagggcgccaugcacacagcccuuaccggggcuacagagauucagaugucuagcggcaacgugcuguucaccggacaucucaaaugcagacugcggauggacaaacuucaacugaaaggcauguccuacagcauguguaccgggaaguuuaaggucgugaaagaaaucgcggagacacagcacggaacgauugucaucagagugcaguaugaaggcgaugggucucccugcaagauccccuucgagauuauggaccucgagaaacgccacguucugggacggcugaucaccgugaauccuauugucacaggcaaggauuccccggugaacaucgaagccgagcccccuuucggggacagcuacauuaucauuggcguugaacccggacagcucaaacugaacugguuuaagaagggcucuagcaucgggcaaauguucgcuaccacaaugagaggagccaaacgcauggccauccuuggcgauaccgcuugggacuuugggucccugggaggcguguucacgucuauugggaaggcccuccaucaggucuuuggcgcgaucuacggagcugccuucagcggcguguccuggacaaugaaaauucugaccggggugaucauuaccuggaucggaaugaauagccggucuacaucccugagcguuucucuuguccucgugggcguggucacccuguaucugggggugaugguucaggccgauuccggauguguggucagcuggaagaacaaagagcucaagugcggcuccgggaucuuuauuacagacaaugugcacacguggaccgaacaguacaaguuccaaccugagucucccagcaaacuggcuuccgccauccagaaggcucaugaggaaggcauuuguggaaucagaucuguuacacgccuugagaaccugauguggaaacagauuaccccggaacucaaucacauccugagcgagaacgaagugaagcugacaaucaugaccggcgauauuaaagggaucaugcaggccggaaagcggucccuuagaccucaacccacggagcucaaauauagcuggaagaccuggggcaaggcgaaaaugcugucuacagagucccacaaucagaccuuucugauugacgggccugaaacagccgagugccccaacaccaaucgcgcuuggaacagccucgaagucgaggauuacggauucggcguguuuacaaccaauaucuggcugaaacuucgggaaaaacaggacguuuucugugacucuaagcugauguccgccgcuauuaaagauaacagagccgugcaugcggacaugggcuauuggaucgagagcgcccucaaugauacguggaagaucgagaaggcuucuuuuauugaagucaaaagcugccacuggccuaagucccauacacuguggagcaacggggugcuggagucugaaaugaucauucccaaaaauuucgccggaccggugucccagcacaacuaccgcccuggcuaucauacccaaaccgcugggcccuggcaccuuggaaagcucgagauggacuucgauuuuugugagggcacaaccgucguugugacggaagacugcgggaaccggggacccagccugagaacaaccacagccuccggcaaacugaucaccgaguggugcugucggucuugcacacucccuccgcugcgcuacagaggcgaagauggguguugguacggaauggagauucggccccuuaaggaaaaggaggagaaucuggugaacagccucgucaccgccggccacgggcagaucgacaauuucucccugggagugcugggcauggcucuuuuucucgaagagaugcugagaacgcgcguugggaccaaacaugcgauucugcucguggccgucucuuucgugacacugaucaccggaaacaugagcuuucgggaucuuggcagaguuauggugauggucggcgcuacaaugaccgacgauaucgggaugggagugacguaucuggcccuccuggccgcuuucaagguucgcccuacauuugccgcgggccugcuucugagaaaacucaccuccaaggaacugaugaugacaaccauugggaucgugcuccugucucagagcaccauucccgagacaauccuugaacugacggacgcucucgcccugggaaugaugguccugaaaauggugcggaagauggagaaguaccaacuugccgugaccauuauggcuauccugugcgucccuaaugccguuauccuccagaacacauggaaaguguccuguaccauucuggcgguggucagcgugucuccccucuuccugacauccagccagcagaaggcugauuggaucccucuugcccugaccauuaaaggccucaaucccacggccaucuuucugacaacccugucucgcaccaacaagaaaagauccuggccgcuuaaugaggcuauuauggccguugggauggugagcauccuggcuucuucccuccugaagaacgacaucccuaugacaggaccccucgucgccggcggccugcuuaccgugugcuauguucugacagggcggagcgcggaccuggaacucgagcgcgccgcugaugugaaaugggaagaccaagccgagauuuccggaagcucuccuauccugagcauuacgaucuccgaagauggcucuaugagcauuaagaaugaggaggaagaacagacccuuacaauccugauuagaaccgggcuccuggucaucuccggacucuuccccgugucuaucccgauuacagcugccgccugguaccugugggaagucaagaaacagcgggcuggcgugcuuugggacguuccuucucccccucccguggggaaggcggagcuggaggauggagccuaucgcaucaaacagaagggcauucugggcuacucccaaaucggggcuggagucuauaaagaaggcaccuuucacacgauguggcaugugaccagaggggccguucucaugcacaagggaaagcggauugagcccuccugggccgacgugaaaaaggaucugaucagcuacggcgggggauggaaacuugaaggcgaguggaaggaaggcgaggagguccaggugcuggcucucgaaccugggaaaaacccgcgcgccgugcagacaaagcccggacuguucaagaccaaugcgggcacaaucggggcuguuucccucgacuuuagcccuggaaccucuggcucccccauuaucgauaaaaaggggaaagucgugggacuguacggcaacggcguggucacaagaagcggggccuaugugucugccauugcucagacggagaaguccaucgaagacaauccugagauugaagaugacaucuuccggaaaagaaaacuuaccaucauggaucugcaucccggagccggcaagacaaaacgcuaccugccugcgauuguucgggaggcuaucaagagagggcuccgcacccugauucuugccccgacccggguggucgccgcugagauggaagaggcccugagaggacuccccauccgcuaucaaaccccugcuauucgggccgaacacacgggcagagagaucguggaccugaugugucacgcgaccuucacaaugcgccuccugagccccguucgggugccuaacuacaaccuuauuaucauggacgaagcccauuuuaccgaucccgcuuccaucgccgcuagaggguauauuucuacacgggucgagaugggcgaggccgccggaaucuucaugaccgcuacgccgccuggcagccgcgaccccuuuccccaguccaaugcgccuauuauggaugaagagagagaaauccccgagcggagcuggucuuccgggcacgagugggugacagacuucaaaggaaagaccguuugguuugugccuagcauucgcgccggcaacgauaucgcugccugccugcgcaagaaugggaagaaggucauccagcugucucggaaaaccuucgacagcgaauacgugaagacaagaaccaacgauugggacuuuguggucacaaccgauauuuccgagaugggagccaauuucaaagcugaacgcguuaucgacccgcggagauguaugaagcccgugauucucacggauggcgaggaacgcgugauccuggccgggccuaugcccgucacacauucuagcgcggcucaacggagaggccgcauuggacggaacccuaaaaaugagaacgaccaguauaucuacaugggcgagccccuugaaaaugacgaggauugcgcccacuggaaggaagccaaaaugcugcucgacaacaucaauaccccggaggggauuaucccuuccauguuugaacccgagagagagaagguggaugcuauugacggagaauaccgccugagaggcgaggcccggaagacauucguugaucugaugcgcagaggggaccucccuguguggcuugcguaucgggucgccgcugaaggaaucaacuacgccgaucgcagaugguguuuugacggcauuaaaaauaaccagauccuggaggaaaauguggagguugagauuuggaccaaggaaggggagcggaaaaagcugaaacccagauggcucgaugcucgcaucuauucugacccucuggcccuuaaggaguucaaggaguucgcugccggccggaaaagccugacgcucaaccugaucaccgagaugggaagacugcccacauuuaugacccagaaggcgcgcgaugcccucgacaaccuugcugugcugcacacagccgaagcuggcgggcgggccuacaaucaugcccuguccgagcucccggaaacccuggagacacuucugcuccugacccugcucgcuacggucacaggaggcauuuuccuuuuucugaugagcgggagaggaaucggcaaaaugacccugggcaugugcugcauuaucaccgcgucuauucuccugugguaugcccaaauccagccucacuggaucgcugccuccauuauccuugaguucuuucugauugugcuccugauccccgagcccgagaagcagcggacaccucaggauaaccaacugaccuacgucgugauugccauccucacaguuguggcugccacgauggcgaaugaaaugggguuccuugagaaaaccaagaaggaccugggacugggcagcaucacaacccagcagccggaauccaacauucucgacaucgaucugcgccccgccucugcuuggacacuuuaugccguggcuaccacguuugucaccccuaugcugagacauagcauugaaaauuccucuguuaacgugagccucacagccaucgcgaaucaggccaccgugcugauggggcugggaaaaggcuggccccucuccaagauggacauuggggucccucuucuggcuaucggauguuacagccaagugaaccccauuacacugaccgccgcucucuuccugcuuguugcccacuacgcuaucaucggcccuggccugcaggccaaagcgacgcgggaagcccagaagcgcgcugccgcugggauuaugaaaaauccgacaguggauggaaucaccgucauugaccucgaucccaucccuuaugaccccaaguuugagaagcagcugggccaagugaugcugcucguccuuugcgugacacagguucugaugaugagaaccaccugggcccugugugaggcccucacacuggcgacggggccuauuucuacccuuugggaaggaaaccccggccgguucuggaauacaaccaucgcuguguccauggccaacaucuuucgcgggagcuaccuggcuggagccggccuccuguucucuauuaugaaaaauacaaccaacacgagacggggcacagggaauaugggagagacccugggcgaaaaguggaaaucccgccucaacgcccuuggaaagagcgaguuucagaucuauaaaaagucuggcauucaagaagucgauagaacccuggcuaaagagggcaucaagagaggggaaacagaccaucacgccgugagcagaggauccgcgaagcugcgcugguucguugaacggaauauggugaccccggagggcaaagucguggaucucggcugcgggagaggaggcuggucuuacuauugugggggacugaagaacgugcgcgaaguuaaaggccuuacaaaaggcgggccugggcacgaggagcccauucccaugagcacguacggcuggaaccugguccggcuccaguccgggguggacguguucuuuaccccucccgaaaaaugcgauacacugcugugugacaucggagagagcuccccuaauccgaccgucgaagccggcagaacacuccgcguucuuaaccugguggagaauuggcugaacaauaacacccaguucugcaucaaggugcucaaucccuauaugccuucugucauugaaaagauggaggcucugcagcggaaauacgggggagcccuugugagaaacccccugagccgcaauuccacgcaugagauguacuggguuucuaacgcuagcggcaauaucguguccucugucaacaugauuagccggaugcucaucaauagauuuaccaugcgccacaagaaagccacauucgaaccugauguggaccugggguccggaacccggaacauuggcaucgagagcgaaauccccaaucuggacauuaucggcaagagaauugagaaaaucaagcaagaauaugagacaucuuggcauuacgaucaggaccacccguauaagaccugggcguaccacggguccuaugagacaaaacagaccggaagcgccucuuccaugguuaacggcgugguccgccuccuuacgaagccuugggauguggugcccauggucacacagauggcuaugaccgacaccacaccuuuugggcaacagagaguuuucaaagaaaagguggauacgcggacccaggagcccaaagaaggaacaaagaagcugaugaaaauuaccgccgaguggcuguggaaggaacucggcaaaaagaaaacaccucgcauguguaccagagaggaguuuacacggaaggugagaagcaacgcugcccugggggcuaucuucaccgacgaaaauaaauggaagucugcccgggaggcggucgaagauucccgcuuuugggagcuuguggacaaggagagaaaccugcaucucgaaggaaaaugcgagacguguguuuacaauaugaugggcaagcgggagaagaagcugggcgaguucgggaaagccaagggaagccgcgcuauuugguauauguggcugggcgccagauuucucgaguucgaggcucugggguuucuuaacgaggaucacugguucucccgggaaaauagccugucuggaguggagggcgaagggcuccauaagcugggcuacauccuucgcgacgucagcaaaaaggagggaggcgccauguacgccgaugacaccgcggggugggacacaagaaucacccuggaagaucucaaaaacgaggagauggugacaaaucacauggaaggagagcauaagaaacuggcugaagccauuuucaagcugaccuaucagaacaagguugugcggguccaacgccccacgccgagaggcacagugauggacaucauuucccggcgcgaucagagagggucuggacagguuggcaccuacgggcucaauacauuuaccaacauggaggcccaacugauccggcagauggaaggcgagggaguguucaaaaauauucagcaccuuacggucaccgaggaaaucgcugugcagaacuggcuggcccgcgucggcagagagcggcucagcagaauggcuaucuccggggacgauugcgugguuaagccucuggacgaucgcuuugccucugcgcuuacagcccugaaugacaugggaaaagugcggaaggauauucaacagugggaacccagcagaggcuggaacgacuggacccagguccccuucugcucccaccauuuucacgagcucaucaugaaagaugggcgcgugcuggugguuccuugucggaaucaggacgagcugauuggacgggcucgcaucucucaaggcgccggguggagccuccgggaaacagcuugccugggcaaguccuaugcccagauguggagccuuauguacuuccauagacgcgaucugcggcucgcggccaacgcuauuuguucugccgugccgucccacuggguccccaccagcagaacaaccuggucuauccacgcuaagcaugaguggaugacgacagaagacaugcugaccguguggaaccgcguuuggauccaggagaauccuuggauggaagacaaaacccccguggaguccugggaggaaauuccuuaucuuggaaagcgggaggaucaguggugcggcagccugaucgggcucacauccagagccaccugggcuaaaaacauucaaacagccaucaaucagguccggucucugauuggaaacgaagaguacacggacuauaugcccagcaugaagagauuucgccgggaagaggaggaagcgggcgugcugugguga

SEQ ID NO: 19572 - RNA, 9876 nt, Artificial Sequence
  derived and/or modified CDS sequence (opt5) from DENV-2__KF041232__SS-prME
accgccggagugaucauuaugcugauccccaccgcuauggccuuccaccucacgaccagaaauggggaaccucauaugauugucagcaagcaggaaaaaggaaagucccugcuuuuuaaaacagaagacggcguuaauaugugcacccugauggcgauggaucucggggaacugugugaagacacaaucaccuacaacugcccccuucugcggcaaaaugaacccgaagauauugacuguuggugcaacgcuacaucuaccugggugacguauggaaccuguacagccaccggcgagcaccgcagagaaaagcggagcguggcccucgucccucauguggggaugggacuggagacacgcaccgaaacguggauguccucugagggcgcuuggaaacacgcccagagaaucgagacauggauccugcggcaucccggcuucaccauuauggcugccauccucgcguacacaauugggaccaccuauuuucagcgcguucugaucuucauucuucugacagccguggcuccuagcaugacgaugagaugcaucggaauuuccaaucgggauuuugucgaaggcgugucugggggaagcuggguugacaucgugcucgagcacggcuccugugucaccacaauggccaagaacaagcccacccuggauuucgaacuuaucaaaacagaggcuaagcagccugccacccugcgcaaauacugcauugaagcgaagcucacgaauacaaccaccgccagcagauguccgacacaaggggagcccucucugaacgaggaacaggacaaacgguuugugugcaagcacuccaugguggaucgcggauggggcaauggcugugggcuguucggaaagggcgggaucgugaccugcgcuauguuuacaugcaaaaagaacauggagggaaaaauuguucagccugaaaaucucgaguauacgaucguggugacaccccauagcggcgaagagaacgccgucgggaaugacacaggaaagcacggcaaagagauuaaggugaccccucagucuuccaucacagaagcugagcugaccggcuacgggacgguuaccauggaauguagccccagaacaggacuugauuucaacgagauggugcugcuccaaauggaaaauaaagccuggcugguccaucggcagugguuucuugaccugccgcucccuuggcugcccggcgccgauauccaggggucuaacuggauucagaaggagacccuggugacauucaagaacccucacgcuaaaaagcaagacguugugguccucggaucccaggagggcgcgaugcacaccgcccugacgggggcuacagaaauccagaugagcuccggcaaucuucuguuuaccggacaucucaaaugccgccugagaauggacaaacuucaacugaaaggcaugucuuauagcauguguacagggaaguucaagguggucaaagagauugccgaaacccagcacggaaccaucgugguucgggugcaguacgagggcgaugggucccccugcaagauucccuucgagaucauggaccucgagaagcggcauguccugggacgccugaucacagugaacccuauuguuacggagaaggauagcccggugaauaucgaagccgagcccccuuuuggcgacucuuacauuaucauuggggucgaacccggccagcucaaacuguccugguucaagaagggaagcucuaucggccaaauguuugagaccacaaugagaggggcuaaaagaauggccauucuuggagauaccgcgugggacuucggcagccucgggggaguguuuacauccaucggcaaggcucuccaccagguguucggggccaucuauggcgccgcuuuuucuggaguuagcuggaccaugaaaauucugaucggcgucgugauuacguggaucgggaugaacucccgcagcacaucucuguccgugagccuuguccucgugggaguugugacccuguaccugggcgccaugguccaggcugauucugggugugugguuuccuggaagaauaaagagcucaagugcggaagcggcauuuucaucaccgacaacgugcauacauggaccgaacaguauaaguuucaaccugagucccccucuaaacuggccagcgcgauccagaaggcccacgaagaggggauuuguggcauccgguccgucacaagacuugaaaaucugauguggaaacagauuacgccggagcucaaccacauccugucugagaaugaagugaagcugagcauuaugaccggagauaucaaaggcaucaugcaggcugggaagcgcucccuucggccucaacccacagagcucaaauacagcuggaagaccuggggaaaggccaaaaugcugucuacagaaccucauaaccagaccuuccugauugacggccccgagacggcugaaugcccuaauaccaacagagccuggaacucccucgagguugaggauuauggguuuggaguguucacaaccaacaucuggcugaaacuuaaagaacgccaggacgucuuuugugacagcaagcugaugucugcggccauuaaagauaaucgggcugugcacgccgacaugggcuacuggaucgaguccgcucucaacgauacauggaagauugaaaaggccagcuucaucgaggugaaaucuugccauuggcccaagagccacacccugugguccaacggcguccuggagagcgaaaugaucauuccgaaaaauuucgccgggccuguuucucagcacaacuauagacccggauaccauacacaaaccgcuggccccuggcaccuugggaagcucgagauggacuuugauuucugugaaggaacgacagugguggucaccgaggacugcggcaaucgcgggccuucccugcggaccacaaccgcgagcggaaaacugaucacggaauggugcuguagauccugcacacucccgccccugcgguaccgcggcgaggauggcuguugguaugggauggagauuagaccucuuaaggaaaaggaggaaaaccuggucaauucucucguuaccgccggacauggccagaucgacaacuuuagccugggggugcugggaauggcucuuuuccucgaggaaaugcugcggacaagagucggcaccaaacacgccgugcugcucguugccguguccuuuaugacacugauuaccgggaauaugucuuuccgcgaucuuggacgggucauggugaugguuggcgcugccaugacggacgauaucggcaugggggugaccuaccuggcgcuccuggcugccuuuaaggucagacccacauucgccgcuggacugcuucugcgcaaacucaccagcaaggagcugaugaugacaaccauuggcaucgugcuccugucccagucuacgacaccugagaccauccuugaacugacagacgcccucgcgcuggggaugaugauucugaaaaucgugagaaacauggagaaguaucaacuugcugucaccauuauggccauccugugcguucccaaugccgugauucuccagaacgcuuggaaggugagcuguaccauccuggccgcugucuccgugagcccucuccugcuuacaucuucccagcagaaagccgauuggaucccccuggcgcucacgauuaagggacugaauccgaccgccaucuuucugacaacccuuagccggacaaacaaaaagcgcucuuggccucugaaugaagcuauuauggccguuggcaugguguccauccucgcuagcucucugcucaaaaacgacauucccaugaccgggccucuggucgccggaggccuucugacggugugcuacguucugacaggcagauccgccgaccucgagcuggaacgggcugcggaugugcgcugggaggaccaagccgagaucagcggguccagccccauccuuucuauuaccaucagcgaagauggauccaugucuauuaagaaugaggaagaggagcagacccugacaauccucauuagaaccggccugcucgucaucagcgggcuguucccgguguccauuccuaucacagcugccgccugguaucuuugggaagucaaaaagcagcgggcuggagugcugugggacguucccucuccuccgcccgugggcaaggccgagcuggaagauggggcguaccgcaucaaacagaagggcauucucggauauagccaaaucggcgcuggggucuacaaagagggaacguuucauaccauguggcacgugacaagaggcgccguucugaugcacaaggggaaacggauugaaccuuccugggccgacgugcgcaaggaucuuaucucuuacggaggcggguggaagcuggagggagaguggaaagaaggcgaggaaguccaggugcucgcucuggagccgggcaagaaccccagagccgugcagaccaaaccugggcuguucaagacaaacaccggaacgauuggcgcgguuagccuggacuuuucccccgggaccagcggaucuccuaucgucgauaaaaagggcaaggugguggggcuuuauggaaauggcgucgugacacgguccggcaccuacguuagcgcuaucgcccagacagaaaaaucuauugaggacaaccccgagaucgaagaugacauuuucagaaagaaacgccugaccaucauggaucugcauccuggggccggaaagacaaaacgguaucucccggcuauugugagagaggccaucaagcgcggccugcggacgcuuauccuggcucccaccagagucguggccgcggaaauggaggaagcccuccgcgggcugccuauucgguaccaaacacccgcuaucagagccgagcacaccggacgcgagauuguugaccucaugugucaugcuaccuucacaaugcggcugcuuuccccugugagaguccccaauuauaaccugaucauuauggacgaagcccacuuuacggauccggccagcaucgcugcgcggggcuacauuuccacccgcguggagaugggggaagccgcuggcaucuucaugacagccaccccucccggaucuagagaccccuuuccucagagcaaugcccccaucauggaugaggagcgggaaauuccugagcgcuccuggaacagcggccaugaauggguuacagacuucaaggggaaaaccgugugguuugucccgucuaucaaggcuggaaaugauauugccgcgugccugcgcaaaaacggcaagaaagugauccagcucucccggaagacguucgacagcgaguauauuaagacaagaaccaaugauugggacuuuguggucaccacagauaucucugaaaugggggcuaacuucaaagccgagcgcguuaucgacccccggagauguaugaagccugugauucugaccgauggagaggaacgcgugauccuugccggccccaugccugucacacacagcuccgcugcccaacggagagggcgcauuggccggaaucccaaaaacgagaaugaccaguacaucuacaugggagaaccgcuggagaacgacgaagauugcgcgcacuggaaggaggccaaaaugcuccuggacaauauuaacaccccugagggcaucauccccucuauguuugaaccugagagagaaaagguggaugcuauugacggggaguaucgccugagaggagaagcccggaaaacguucguugaucucaugcgcagaggcgaccuucccguguggcuggcuuaccgggucgccgcugaggggaucaacuaugccgaucgcagaugguguuuugacggaauuaagaauaaccagauccuggaggaaaauguggagguugaaauuuggacaaaggagggcgagcggaaaaagcucaaaccuagauggcuggaugcgcgcaucuacagcgacccccuugcccugaaggaguucaaagaguucgcugccgggcggaagucccucacccugaaccugauuacagaaaugggcagacucccgaccuuuaugacgcagaaggcucgcaaugcccuugauaaccuggccgugcugcauaccgcugaggcgggaggccgggccuauaaucacgcucucucugaacugccugagacacuugagacccugcuccugcugacacuccuugccaccgucacagggggaaucuuccuguuucugaugagcggcaaagggaucggaaagaugacccucggcaugugcugcauuaucacggccuccauucugcuuugguacgcucaaauccagccccauuggauugccgcgagcaucauccuggaguucuuucucauugugcugcugauccccgagccugaaaaacagagaacaccgcaggacaaccaacucaccuaugucgugauugccauccuuaccguuguggcugccacaauggcuaaugagaugggcuuccuggaaaagaccaaaaaggauuuugggcugggaucuauugccacacagcagcccgaguccaacauccucgacaucgaccugcggccugcgagcgccuggacgcuuuacgcuguggccaccacauucauuacccccaugcugcgccacuccaucgaaaauucuagcgucaacguuucccucacagcuauugccaaucaggcuaccgugcugaugggccuggggaagggauggccucucucuaaaauggauaucggcgugccccuucuggccauuggguguuacagccaagucaacccuaucacgcugaccgcggcccuccugcuucugguggcucacuaugccauuaucggaccgggccuccaggcuaaggccacaagagaagcccagaaacgggcggcugccggcaucaugaagaaucccaccguugacgggauuacagugaucgaucuggacccuauucccuacgauccuaaauuugagaagcagcugggacaagucaugcuccuugugcugugcgucacccaggugcugaugaugcgcacgacaugggcucucugugaagcccugacccuugccacaggccccaucuccacccugugggaggggaacccgggaagauucuggaauaccacaauugcuguuagcauggccaacaucuuucggggcucuuaucucgcgggggccggacugcuguucuccaucaugaagaacacgaccaauacacgcagaggcaccggcaacacaggggaaacccucggagagaaauggaagaaucggcuuaacagccugggcaaaucugaguuucagauuuacaagcgcuccgggauccaagaaguggacagaacgcuggcuaaagagggaauuaagcggggcgaaacagaucaucacgccgucagcagagggucugcuaaacuccgcugguucguggagcggaaucugguuaccccugagggaaagguggucgaccuuggcugcggcagagggggauggagcuauuacuguggcgggcugaagaacgugcgcgaagugaaaggacucaccaagggcgggcccggacaugaggaacccaucccuauguccacauauggcuggaaucugguucggcugcagucuggcgucgauguguucuuuacacccccugagaaaugcgacacccuccuuugugauauuggggaaagcuccccgaaccccacgguggaggccggaagaacccugcgcguccugaaucucguugagaacuggcugaauaacaauacacaguucugcaucaaggugcuuaacccuuacaugcccagcgugaucgagaagauggagacccugcagcggaaguacggcggggcgcucgucagaaauccucugucccgcaacucuacacacgaaauguauugggugagcaacgccuccggaaauauuguuucuagcgugaacaugaucucccggaugcugauuaauagauuuaccaugcgccauaagaaagcuacguacgagcccgacgucgaucucggcucugggacccggaacaucggaauugaaagcgagacaccgaaucuugacaucaucggcaagagaauugagaaaaucaagcaagaacacgagaccuccuggcacuaugaccaggaucauccuuacaaaacaugggccuaucacggcagcuacgaaaccaagcagacagggucugcuuccagcauggugaacggaguugugcgccugcugaccaagcccugggacgucauuccuauggugacgcagauggccaugacagauaccacccccuucggccaacagagaguguuuaaagagaaggucgacacacggacgcaggaaccuaaagaggggaccaagaaacucaugaagaucacagcugaguggcuguggaaggaacuuggcaaaaagaaaacccccagaauguguacaagagaggaguucgcccggaagguuagaucuaaugcggcccugggcgcuauuuuuaccgaugagaacaaauggaaguccgcccgggaggcuguggaagacagccgcuucugggagcucguggauaaagaaagaaaucugcaucuggaggggaagugcgaaacaugugucuauaacaugaugggaaagcgggagaaaaagaucggcgaguuuggcaaagccaaggggucucgcgccauuugguacauguggcucggagcgagauuccuggaauuugaggcucuuggcuuccugaaugaagaccacugguuuucccgggagaacagccucuccgggguggaaggagagggccugcacaaacuuggguacauccugcgcgagguuagcaagaaggaaggcggagccauguaugccgaugacaccgcuggcugggauacgagaaucacccucgaggaccugaaaaaugaagagauggugacaaaccauauggaaggggagcacaagaaacuggccgaggcuauuuucaagcucaccuaccagaauaaagucgugcggguucaacgcccgacaccuagaggaaccgugauggacaucauuucucggcgcgaucagagaggcagcgggcaggucggaacguauggccugaacacauucaccaacaugggggcccaacuuauccggcagauggaaggcgagggaguguuuaagggcauucagcaucugacagcgaccgaagagguugccgugcaggacuggcucgcucgcgucgggagagagcggcuguccagaauggccaucucuggagaugacugcguggucaagccccuugaugaccgcuucgcuaaugcccugacggcgcucaacgauaugggcaaagugcggaaggacauccaacagugggaacccagcagaggguggaaugauuggacccagguuccuuuuugcucccaccauuuccacgagcugauuaugaaagacggacgcgugcuggucgugccgugucggaaccaggaugaacucaucggcagagcccgcauuucucaaggggcuggcuggagccugcgggagacagccugccuuggaaaguccuacgcucagauguggucucugauguauuuucacagacgcgaccuccggcuggccgcuaaugccaucuguagcgcggugcccucccauuggguuccuaccagcagaacaaccuggucuauucacgcccgccaugaauggaugacaaccgaggauaugcuuacgguguggaaccgggucuggauccaggagaaucccuggauggaagacaaaacaccuguggaguccugggaagagauccccuaccugggcaagagagaagaccaguggugcgggagccucauuggacugaccucucgggcuaccugggccagaaacauccaaacagccauuaaucagguucgcucccugaucggcagcgaggaguauaccgauuacaugccuuccaugaagcgguucagacgcgaagaggaagaggcuggggugcucugguga

SEQ ID NO: 19573 - RNA, 9876 nt, Artificial Sequence
  derived and/or modified CDS sequence (opt5) from DENV-2__KF041233__SS-prME
accgccggcgucaucauuaugcugauccccaccgcuauggccuuccaccucacgaccagaaauggggaaccucauaugauugucagcaagcaggaaaaaggaaagucccugcuuuuuaaaaccgaagacggcguuaauaugugcacccugauggcgauggaucucggggaacugugugaagacacaaucaccuacaacugcccccuucugcggcaaaaugaacccgaagauauugacuguuggugcaacucuacaagcaccugggugacguauggaaccuguacagcuaccggcgagcaccgcagagaaaagcgguccguggcccucgucccucauguggggaugggacuggagacacgcaccgaaacguggaugucuagcgagggcgccuggaaacacgcucagagaaucgagacauggauccugcggcaucccggcuucaccauuauggccgcuauccucgccuacacaauugggaccaccuauuuucagcgcguucugaucuucauucuucugacagcgguggccccuuccaugacgaugagaugcaucggaauuucuaaucgggauuuugucgaaggcgugagcgggggauccuggguugacaucgugcucgagcacggcagcugugucaccacaauggcuaagaacaagcccacccuggauuucgaacuuaucaaaacagaggccaagcagccugcuacccugcgcaaauacugcauugaagccaagcucacgaauacaaccaccgcgucuagauguccgacacaaggggagcccucccugaacgaggaacaggacaaacgguuugugugcaagcacagcaugguggaucgcggauggggcaauggcugugggcuguucggaaagggcgggaucgugaccugcgccauguuuacaugcaaaaagaacauggagggaaaaauuguucagccugaaaaucucgaguauacgaucguggugacaccccauucuggcgaagagaacgcugucgggaaugacacaggaaagcacggcaaagagauuaaggugaccccucaguccagcaucacagaagccgagcugaccggcuacgggacgguuaccauggaauguucucccagaacaggacuugauuucaacgagauggugcugcuccaaauggaaaauaaggcuuggcugguccaucggcagugguuucuugaccugccgcucccuuggcugcccggcgccgauauccagggguccaacuggauucagaaggagacccuggugacauucaagaacccucacgccaaaaagcaagacguugugguccucggaagccaggagggcgcuaugcacaccgcgcugacgggggccacagaaauccagauguccucuggcaaucuucuguuuaccggacaucucaaaugccgccugagaauggacaaacuucaacugaaaggcaugagcuauuccauguguacagggaaguucaagguggucaaagagauugcugaaacccagcacggaaccaucgugguucgggugcaguacgagggcgaugggagccccugcaagauucccuucgagaucauggaccucgagaagcggcauguccugggacgccugaucacagugaacccuauuguuacggagaaggauucuccggugaauaucgaagccgagcccccuuuuggcgacuccuacauuaucauuggggucgaacccggccagcucaaacugagcugguucaagaagggaucuagcaucggccaaauguuugagaccacaaugagaggggccaaaagaauggcuauucuuggagauaccgccugggacuucggcucccucgggggaguguuuacaucuaucggcaaggcgcuccaccagguguucggggcuaucuauggcgccgccuuuagcggaguuuccuggaccaugaaaauucugaucggcgucgugauuacguggaucgggaugaacagccgcucuacaucccugagcgugucucuuguccucgugggaguugugacccuguaccugggcgucauggugcaggcugauuccggguguguugugagcuggaagaauaaagagcucaagugcggauccggcauuuucaucaccgacaacguccauacauggaccgaacaguauaaguuucaaccugagucucccagcaaacuggccgcugccauccagaaggcgcacgaagaggggauuuguggcauccgguccgugacaagacuugaaaaucugauguggaaacagauuacgccggagcucaaccacauccugucugagaaugaaguuaagcugagcauuaugaccggagauaucaaaggcaucaugcaggccgggaagcgcucccuucggccucaacccacagagcucaaauacagcuggaagaccuggggaaaggcuaaaaugcugucuacagaaccucauaaccagaccuuccugauugacggccccgagacggccgaaugcccuaauaccaacagagcuuggaacucccucgagguggaggauuauggguuuggagucuucacaaccaacaucuggcugaaacuuaaagaacgccaggacguguuuugugacagcaagcugaugucugccgcgauuaaagauaaucgggccgugcacgcugacaugggcuacuggaucgaguccgcccucaacgauacauggaagauugaaaaggcuagcuucaucgaggucaaaucuugccauuggcccaagagccacacccugugguccaacggcguucuggagagcgaaaugaucauuccgaaaaauuucgccgggccugugucucagcacaacuauagacccggauaccauacacaaaccgccggccccuggcaccuugggaagcucgagauggacuuugauuucugugaaggaacgacaguggucgugaccgaggacugcggcaaucgcgggccuucccugcggaccacaaccgcuagcggaaaacugaucacggaauggugcuguagauccugcacacucccgccccugcgguaccgcggcgaggauggcuguugguaugggauggagauuagaccucuuaaggaaaaggaggaaaaccugguuaauucucucgugaccgcgggacauggccagaucgacaacuuuagccuggggguccugggaauggcccuuuuccucgaggaaaugcugcggacaagagugggcaccaaacacgcuguucugcucauugccguguccuuuaugacacugaucaccgggaauaugucuuuccgcgaucuuggacgggucauggugaugguuggcgccgcuaugacggacgauauuggcaugggggugaccuaccuggcccuccuggcggcuuuuaaggucagacccacauucgccgccggacugcuucugcgcaaacucaccagcaaggagcugaugaugacaaccaucggcaucgugcuccugucccagucuacgacaccugagaccauucuugaacugacagacgcucucgcccuggggaugaugauccugaaaauugugagaaacauggagaaguaucaacuugcggucaccaucauggcuauucugugcguucccaaugccgugauccuccagaacgccuggaaggugagcuguaccauccuggcugccgucuccgugagcccucuccugcuuacaucuucccagcagaaagcugauuggauuccccuggcccucacgaucaagggacugaauccgaccgcgauuuuucugacaacccuuagccggacaaacaaaaagcgcucuuggccucugaaugaagccaucauggcuguuggcaugguguccauucucgccagcucucugcucaaaaacgacauccccaugaccgggccucuggucgcuggaggccuucugacggugugcuacguucugacaggcagauccgccgaccucgagcuggaacgggccgcugaugugcgcugggaggaccaagcggagaucagcggguccagccccauucuuucuaucaccauuagcgaagauggauccaugucuaucaagaaugaggaagaggagcagacccugacaauucucaucagaaccggccugcucgucauuagcgggcuguucccgguguccaucccuaucacagccgcugccugguaucuuugggaagucaaaaagcagcgggccggagugcugugggacguucccucuccuccgcccgugggcaaggcugagcuggaagauggggccuaccgcauuaaacagaagggaauccucggcuauagccaaauuggcgcgggggucuacaaagagggaacguuucauaccauguggcacgugacaagaggcgcuguucugaugcacaaggggaaacggaucgaaccuuccugggccgacgugcgcaaggaucuuauuucuuacggaggcggguggaagcuggagggagaguggaaagaaggcgaggaaguccaggugcucgcccuggagccgggcaagaaccccagagcugugcagaccaaaccugggcuguucaagacaaacaccggaacgaucggcgccguuagccuggacuuuucccccgggaccagcggaucuccuaucgucgauaaaaagggcaaggugguggggcuuuauggaaauggcgucgugacacgguccggcaccuacguuagcgcgauugcucagacagaaaaaucuaucgaggacaaccccgagauugaagaugacaucuucagaaagaaaaagcugaccauuauggaucugcauccuggggccggaaaaacaaagcgcuaucucccggccaucgugcgggaggcuaucaagagaggccugcgcacgcuuauucuggcccccacccgggucguggcugccgaaauggaggaagcgcucagagggcugccuauccgcuaccaaacacccgccauucgggcugagcacaccggaagagagaucguugaccucaugugucaugccaccuucacaaugcgccugcuuuccccugugcggguccccaauuauaaccugauuaucauggacgaagcucacuuuacggauccggccagcauugccgcuagaggcuacaucuccacccggguggagaugggggaagcggccggcaucuucaugacagcuaccccucccggaucucgcgaccccuuuccucagagcaaugcccccauuauggaugaggagagagaaaucccugagcgguccuggaacagcggccaugaauggguuacagacuucaaagggaagaccgugugguuugucccgucuauuaaagccggaaaugauaucgcugccugccugcgcaagaacggcaaaaaggugauucagcucuccagaaagacguucgacagcgaguauaucaaaacacggaccaaugauugggacuuuguggucaccacagauaucucugaaaugggggcgaacuucaaggcugagagaguuauugacccccgccgguguaugaaaccugugauccugaccgauggagaggaaagagugauucuugccggccccaugccugucacacacagcuccgccgcucaacgccgggggagaaucggccgcaaucccaagaacgagaaugaccaguacauuuacaugggagaaccgcuggagaacgacgaagauugcgcccacuggaaagaggcgaagaugcuccuggacaauaucaacaccccugagggcaucauucccucuauguuugaaccugagcgggaaaaaguggaugccaucgacggggaguauagacugcgcggagaagcuagaaagacguucguugaucucaugcggcgcggcgaccuucccguguggcuggccuacagagucgcugccgaggggauuaacuaugcugaucggcgcugguguuuugacggaaucaagaauaaccagauucuggaggaaaauguggagguugaaaucuggacaaaagagggcgagagaaagaaacucaagccucgguggcuggaugccagaauuuacagcgacccccuugcgcugaaagaguucaaggaguucgccgcugggcgcaagucccucacccugaaccugaucacagaaaugggccggcucccgaccuuuaugacgcagaaagccagaaaugcucuugauaaccuggccgugcugcauaccgccgaggcuggaggccgcgcguauaaucacgcccucucugaacugccugagacacuugagacccugcuccugcugacacuccuugcuaccgucacagggggaaucuuccuguuucugaugagcggcaaggggauuggaaaaaugacccucggcaugugcugcaucauuacggccuccauccugcuuugguacgcccaaauucagccccauuggaucgcugccagcaucauucuggaguucuuucucaucgugcugcugauucccgagccugaaaagcagcggacaccgcaggacaaccaacucaccuaugucgugaucgcgauucuuaccguuguggccgcuacaauggccaaugagaugggcuuccuggagaagaccaagaaggauuuugggcugggaucuaucgcuacacagcagcccgaguccaacauccucgacauugaccugagaccugccagcgcguggacgcuuuacgccguggcuaccacauucaucacccccaugcugcggcacuccauugaaaauucuagcgucaacguuucccucacagccaucgcuaaucaggccaccgugcugaugggccuggggaaaggauggccucucucuaagauggauauuggcgugccccuucuggcuaucggguguuacagccaagucaacccuauuacgcugaccgccgcgcuccugcuucugguggcccacuaugcuaucaucggaccgggccuccaggccaaagcuacacgcgaagcccagaagagagccgcggcuggcauuaugaaaaaucccaccguugacgggaucacagugauugaucuggacccuauccccuacgauccuaaguuugagaagcagcugggacaagucaugcuccuugugcugugcgucacccaggugcugaugaugcggacgacaugggcccucugugaagcucugacccuugccacaggccccauuuccacccugugggaggggaacccgggacgcuucuggaauaccacaaucgccguuagcauggcuaacaucuuuagaggcucuuaucucgccggggcgggacugcuguucuccauuaugaaaaacacgaccaauacacggcgcggcaccggcaacacaggggaaacccucggagagaaguggaaaaauagacuuaacagccugggcaagucugaguuucagaucuacaaacgguccgggauucaagaaguggaccgcacgcuggccaaggagggaaucaaaagaggcgaaacagaucaucacgcugucagccgggggucugccaagcucagaugguucguggagcgcaaucugguuaccccugagggaaagguggucgaccuuggcugcggcagagggggauggagcuauuacuguggcgggcugaaaaacgugcgggaagugaagggacucaccaaaggcgggcccggacaugaggaacccauuccuauguccacauauggcuggaaucugguucgccugcagucuggcgucgauguguucuuuacacccccugagaagugcgacacccuccuuugugauaucggggaaagcuccccgaaccccacgguggaggcuggacggacccugagaguccugaaucucguugagaacuggcugaauaacaauacacaguucugcaucaaagugcuuaacccuuacaugcccagcgugauugaaaagauggagacccugcagcgcaaguacggcggggcccucguccggaauccucuguccagaaacucuacacacgaaauguauugggugagcaacgcguccggaaauaucguuucuagcgugaacaugauuucccgcaugcugaucaaucgguuuaccaugagacauaaaaaggccacguacgagcccgacgucgaucucggcucugggacccgcaacauuggaaucgaaagcgagacaccgaaucuugacaucauuggcaaacggaucgagaagauuaaacaagaacacgagaccuccuggcacuaugaccaggaucauccuuacaagacaugggcuuaucacggcagcuacgaaaccaagcagacagggucugccuccagcauggugaacggaguugugagacugcugaccaaacccugggacgucaucccuauggugacgcagauggcuaugacagauaccacccccuucggccaacagcgcguguuuaaggagaaagucgacacaagaacgcaggaaccuaaggaggggaccaaaaagcucaugaagauuacagccgaguggcuguggaaagaacuuggaaagaaaaagacaccccggauguguacacgcgaggaguucgcuagaaaaguucggucuaaugccgcgcugggcgccaucuuuaccgaugagaacaaguggaaauccgcuagagaggccguggaagacagccgguucugggagcucguggauaaggaacgcaaucugcaucuggaggggaagugcgaaacaugugucuauaacaugaugggaaaaagagagaagaaaauuggcgaguuuggcaaggcuaaagggucucgggccaucugguacauguggcucggagcccgcuuccuggaauuugaggcgcuuggcuuccugaaugaagaccacugguuuuccagagagaacagccucuccgggguggaaggagagggccugcacaaacuuggguacauccugcgggagguuagcaagaaagaaggcggagcuauguaugccgaugacaccgccggcugggauacgcgcauuacccucgaggaccugaagaaugaagagauggugacaaaccauauggaaggggagcacaaaaagcuggcugaggccaucuucaaacucaccuaccagaauaaggucgugagaguucaacggccgacaccucgcggaaccgugauggacauuaucucuagacgggaucagcgcggcagcgggcaggucggaacguauggccugaacacauucaccaacaugggggcucaacuuauuagacagauggaaggcgagggaguguuuaagggcauccagcaucugacagccaccgaagagguugcggugcaggacuggcucgcccgggucgggcgcgagagacugucccggauggcuaucucuggagaugacugcguggucaaaccccuugaugacagauucgccagcgcucugacggcccucaaugauaugggcaaggugcgcaaagacauucaacagugggaacccucccggggguggaacgauuggacccagguuccuuuuugcucucaccauuuccacgagcugaucaugaaggacggaagagugcuggucgugccgugucgcaaucaggaugaacucauuggccgggcgagaaucagccaaggggccggcuggucccugcgcgagacagcuugccuuggaaaaucuuacgcccagauguggagccugauguauuuucaccggagagaccuccgccuggcugccaacgcuauuuguuccgccgugcccagccauuggguuccuaccucucggacaaccugguccauccacgcgagacaugaauggaugacaaccgaggauaugcuuacgguguggaaucgcgucuggauccaggagaaccccuggauggaagacaagacacugguggagagcugggaagagauuccuuaccucggcaagcgggaagaccaguggugcgggucucugaucggacugaccuccagagccaccugggcucggaauauucaaacagccaucaaccagguuagaagccucauuggcuccgaggaguauaccgauuacaugcccucuaugaaacgcuuccggagagaagaggaagaggccggggugcugugguga

SEQ ID NO: 19574 - RNA, 9876 nt, Artificial Sequence
  derived and/or modified CDS sequence (opt5) from DENV-2__KF041234__SS-prME
accgccggagugaucauuaugcugauccccaccgcuauggccuuccaccucacgaccagaaauggggaaccucauaugauugucagcaagcaggaaaaaggaaagucccugcuuuuuaaaacagaagacggcguuaauaugugcacccugauggcgauggaucucggggaacugugugaagacacaaucaccuacaacugcccccuucugcggcaaaaugaacccgaagauauugacuguuggugcaacgcuacaucuaccugggugacguauggaaccuguacagccaccggcgagcaccgcagagaaaagcggagcguggcccucgucccucauguggggaugggacuggagacacgcaccgaaacguggauguccucugagggcgcuuggaaacacgcccagagaaucgagacauggauccugcggcaucccggcuucaccauuauggcugccauccucgcguacacaauugggaccaccuauuuucagcgcguucugaucuucauucuucugacagccguggcuccuagcaugacgaugagaugcaucggaauuuccaaucgggauuuugucgaaggcgugucugggggaagcuggguugacaucgugcucgagcacggcuccugugucaccacaauggccaagaacaagcccacccuggauuucgaacuuaucaaaacagaggcuaagcagccugccacccugcgcaaauacugcauugaagcgaagcucacgaauacaaccaccgccagcagauguccgacacaaggggagcccucucugaacgaggaacaggacaaacgguuugugugcaagcacuccaugguggaucgcggauggggcaauggcugugggcuguucggaaagggcgggaucgugaccugcgcuauguuuacaugcaaaaagaacauggagggaaaaauuguucagccugaaaaucucgaguauacgaucguggugacaccccauagcggcgaagagaacgccgucgggaaugacacaggaaagcacggcaaagagauuaaggugaccccucagucuuccaucacagaagcugagcugaccggcuacgggacgguuaccauggaauguagccccagaacaggacuugauuucaacgagauggugcugcuccaaauggaaaauaaagccuggcugguccaucggcagugguuucuugaccugccgcucccuuggcugcccggcgccgauauccaggggucuaacuggauucagaaggagacccuggugacauucaagaacccucacgcuaaaaagcaagacguugugguccucggaucccaggagggcgcgaugcacaccgcccugacgggggcuacagaaauccagaugagcuccggcaaucuucuguuuaccggacaucucaaaugccgccugagaauggacaaacuucaacugaaaggcaugucuuauagcauguguacagggaaguucaaggugauuaaagagaucgccgaaacccagcacggaaccauugucgugcggguucaguacgagggcgaugggucccccugcaagauccccuucgagaucauggaccucgagaagcggcaugugcugggacgccugauuacagucaacccuaucgugacggagaaggauagcccgguuaauauugaagccgagcccccuuuuggcgacucuuacaucauuaucgggguggaacccggccagcucaaacuguccugguucaagaagggaagcucuauuggccaaauguuugagaccacaaugagaggggcuaaaagaauggccauccuuggagauaccgcgugggacuucggcagccucgggggagucuuuacauccaucggcaaggcucuccaccagguguucggggccauuuauggcgccgcuuuuucuggagugagcuggaccaugaaaauccugauuggcguugucaucacguggauugggaugaacucccgcagcacaucucuguccgugagccuugugcucgucggagugguuacccuguaccugggcgugaugguccaggccgauucugggugugugguuuccuggaagaauaaagagcucaagugcggaagcggcaucuucaucaccgacaacgugcauacauggaccgaacaguauaaguuucaaccugagucccccucuaaacuggcuagcgccauucagaaggcgcacgaagaggggaucuguggcauucgguccgucacaagacuugaaaaucugauguggaaacagaucacgccggagcucaaccacauucugucugagaaugaagugaagcugagcaucaugaccggagauaucaaaggcauuaugcaggccgggaagcgcucccuucggccucaacccacagagcucaaauacagcuggaagaccuggggaaaggcuaaaaugcugucuacagaaccucauaaccagaccuuccugaucgacggccccgagacggccgaaugcccuaauaccaacagagcuuggaacucccucgagguugaggauuauggguuuggaguguucacaaccaacauuuggcugaaacuuaaagaacgccaggacgucuuuugugacagcaagcugaugucugccgcgaucaaagauaaucgggccgugcacgcugacaugggcuacuggauugaguccgcccucaacgauacauggaagaucgaaaaggcuagcuucaucgaggugaaaucuugccauuggcccaagagccacacccugugguccaacggcguccuggagagcgaaaugauuaucccgaaaaauuucgccgggccuguuucucagcacaacuauagacccggauaccauacacaaaccgccggccccuggcaccuugggaagcucgagauggacuuugauuucugugaaggaacgacagugguggucaccgaggacugcggcaaucgcgggccuucccugcggaccacaaccgcuagcggaaaacugauuacggaauggugcuguagauccugcacacucccgccccugcgguaccgcggcgaggauggcuguugguaugggauggagaucagaccucuuaaggaaaaggaggaaaaccuggucaauucucucguuaccgcgggacauggccagauugacaacuuuagccugggggugcugggaauggcccuuuuccucgaggaaaugcugcggacaagagucggcaccaaacacgcugugcugcucguugccguguccuuuaugacacugaucaccgggaauaugucuuuccgcgaucuuggacgggucauggugaugguuggcgccgcuaugacggacgauauuggcaugggggugaccuaccuggcccuccuggcggcuuuuaaggucagacccacauucgccgccggacugcuucugcgcaaacucaccagcaaggagcugaugaugacaaccaucggcaucgugcuccugucccagucuacgacaccugagaccauucuugaacugacagacgcucucgcccuggggaugaugauccugaaaauugugagaaacauggagaaguaucaacuugcggucaccaucauggcuauucugugcguucccaaugccgugauccuccagaacgccuggaaggugagcuguaccauccuggcugccgucuccgugagcccucuccugcuuacaucuucccagcagaaagcugauuggauuccccuggcccucacgaucaagggacugaauccgaccgcgauuuuucugacaacccuuagccggacaaacaaaaagcgcucuuggccucugaaugaagccaucauggcuguuggcaugguguccauucucgccagcucucugcucaaaaacgacauccccaugaccgggccucuggucgcuggaggccuucugacggugugcuacguucugacaggcagauccgccgaccucgagcuggaacgggccgcugaugugcgcugggaggaccaagcggagaucagcggguccagccccauucuuucuaucaccauuagcgaagauggauccaugucuaucaagaaugaggaagaggagcagacccugacaauucucaucagaaccggccugcucgucauuagcgggcuguucccgguguccaucccuaucacagccgcugccugguaucuuugggaagucaaaaagcagcgggccggagugcugugggacguucccucuccuccgcccgugggcaaggcugagcuggaagauggggccuaccgcauuaaacagaagggaauccucggcuauagccaaauuggcgcgggggucuacaaagagggaacguuucauaccauguggcacgugacaagaggcgcuguucugaugcacaaggggaaacggaucgaaccuuccugggccgacgugcgcaaggaucuuauuucuuacggaggcggguggaagcuggagggagaguggaaagaaggcgaggaaguccaggugcucgcccuggagccgggcaagaaccccagagcugugcagaccaaaccugggcuguucaagacaaacaccggaacgaucggcgccguuagccuggacuuuucccccgggaccagcggaucuccuaucgucgauaaaaagggcaaggugguggggcuuuauggaaauggcgucgugacacgguccggcaccuacguuagcgcgauugcucagacagaaaaaucuaucgaggacaaccccgagauugaagaugacaucuucagaaagaaacgccugaccauuauggaucugcauccuggggccggaaagacaaaacgguaucucccggccaucgugagagaggcuaucaagcgcggccugcggacgcuuauucuggcccccaccagagucguggcugccgaaauggaggaagcgcuccgcgggcugccuauccgguaccaaacacccgccauuagagcugagcacaccggacgcgagaucguugaccucaugugucaugccaccuucacaaugcggcugcuuuccccugugagaguccccaauuauaaccugauuaucauggacgaagcucacuuuacggauccggccagcauugccgcucggggcuacaucuccacccgcguggagaugggggaagcggccggcaucuucaugacagcuaccccucccggaucuagagaccccuuuccucagagcaaugcccccauuauggaugaggagcgggaaaucccugagcgcuccuggaacagcggccaugaauggguuacagacuucaaggggaaaaccgugugguuugucccgucuauuaaggccggaaaugauaucgcugccugccugcgcaaaaacggcaagaaagugauucagcucucccggaagacguucgacagcgaguauaucaagacaagaaccaaugauugggacuuuguggucaccacagauaucucugaaaugggggcgaacuucaaagcugagcgcguuauugacccccggagauguaugaagccugugauccugaccgauggagaggaacgcgugauucuugccggccccaugccugucacacacagcuccgccgcucaacggagagggcgcaucggccggaaucccaaaaacgagaaugaccaguacauuuacaugggagaaccgcuggagaacgacgaagauugcgcccacuggaaggaggcgaaaaugcuccuggacaauaucaacaccccugagggcaucauucccucuauguuugaaccugagagagaaaagguggaugccaucgacggggaguaucgccugagaggagaagcucggaaaacguucguugaucucaugcgcagaggcgaccuucccguguggcuggccuaccgggucgcugccgaggggauuaacuaugcugaucgcagaugguguuuugacggaaucaagaauaaccagauucuggaggaaaauguggagguugaaaucuggacaaaggagggcgagcggaaaaagcucaaaccuagauggcuggaugcccgcauuuacagcgacccccuugcgcugaaggaguucaaagaguucgccgcugggcggaagucccucacccugaaccugaucacagaaaugggcagacucccgaccuuuaugacgcagaaggcccgcaaugcucuugauaaccuggccgugcugcauaccgccgaggcuggaggccgggcguauaaucacgcccucucugaacugccugagacacuugagacccugcuccugcugacacuccuugcuaccgucacagggggaaucuuccuguuucugaugagcggcaaagggauuggaaagaugacccucggcaugugcugcaucauuacggccuccauccugcuuugguacgcccaaauucagccccauuggaucgcugccagcaucauucuggaguucuuucucaucgugcugcugauucccgagccugaaaaacagagaacaccgcaggacaaccaacucaccuaugucgugaucgcgauucuuaccguuguggccgcuacaauggccaaugagaugggcuuccuggaaaagaccaaaaaggauuuugggcugggaucuaucgcuacacagcagcccgaguccaacauccucgacauugaccugcggccugccagcgcguggacgcuuuacgccguggcuaccacauucaucacccccaugcugcgccacuccauugaaaauucuagcgucaacguuucccucacagccaucgcuaaucaggccaccgugcugaugggccuggggaagggauggccucucucuaaaauggauauuggcgugccccuucuggcuaucggguguuacagccaagucaacccuauuacgcugaccgccgcgcuccugcuucugguggcccacuaugcuaucaucggaccgggccuccaggccaaggcuacaagagaagcccagaaacgggccgcggcuggcauuaugaagaaucccaccguugacgggaucacagugauugaucuggacccuauccccuacgauccuaaauuugagaagcagcugggacaagucaugcuccuugugcugugcgucacccaggugcugaugaugcgcacgacaugggcccucugugaagcucugacccuugccacaggccccauuuccacccugugggaggggaacccgggaagauucuggaauaccacaaucgccguuagcauggcuaacaucuuucggggcucuuaucucgccggggcgggacugcuguucuccauuaugaagaacacgaccaauacacgcagaggcaccggcaacacaggggaaacccucggagagaaauggaagaaucggcuuaacagccugggcaaaucugaguuucagaucuacaagcgcuccgggauucaagaaguggacagaacgcuggccaaagagggaaucaagcggggcgaaacagaucaucacgcugucagcagagggucugccaaacuccgcugguucguggagcggaaucugguuaccccugagggaaagguggucgaccuuggcugcggcagagggggauggagcuauuacuguggcgggcugaagaacgugcgcgaagugaaaggacucaccaagggcgggcccggacaugaggaacccauuccuauguccacauauggcuggaaucugguucggcugcagucuggcgucgauguguucuuuacacccccugagaaaugcgacacccuccuuugugauaucggggaaagcuccccgaaccccacgguggaggcuggaagaacccugcgcguccugaaucucguugagaacuggcugaauaacaauacacaguucugcaucaaggugcuuaacccuuacaugcccagcgugauugagaagauggagacccugcagcggaaguacggcggggcccucgucagaaauccucugucccgcaacucuacacacgaaauguauugggugagcaacgcguccggaaauaucguuucuagcgugaacaugauuucccggaugcugaucaauagauuuaccaugcgccauaagaaagccacguacgagcccgacgucgaucucggcucugggacccggaacauuggaaucgaaagcgagacaccgaaucuugacaucauuggcaagagaaucgagaaaauuaagcaagaacacgagaccuccuggcacuaugaccaggaucauccuuacaaaacaugggcuuaucacggcagcuacgaaaccaagcagacagggucugccuccagcauggugaacggaguugugcgccugcugaccaagcccugggacgucaucccuauggugacgcagauggcuaugacagauaccacccccuucggccaacagagaguguuuaaagagaaggucgacacacggacgcaggaaccuaaagaggggaccaagaaacucaugaagauuacagccgaguggcuguggaaggaacuuggcaaaaagaaaacccccagaauguguacaagagaggaguucgcucggaagguuagaucuaaugccgcgcugggcgccaucuuuaccgaugagaacaaauggaaguccgcucgggaggccguggaagacagccgcuucugggagcucguggauaaagaaagagaccugcaucuggaggggaagugcgaaacaugugucuauaauaugaugggaaagcgggagaaaaagauuggcgaguuuggcaaagcuaaggggucucgcgccaucugguacauguggcucggagccagauuccuggaauuugaggcgcuuggcuuccugaacgaagaucacugguuuucccgggagaauagccucuccgggguggaaggagagggccugcacaaacuuggguacauccugcgcgagguuagcaagaaggaaggcggagcuauguaugccgacgauaccgccggcugggacacgagaauuacccucgaggaccugaaaaacgaagagauggugacaaaucauauggaaggggagcacaagaaacuggcugaggccaucuucaagcucaccuaccagaacaaagucgugcggguucaacgcccgacaccuagaggaaccgugauggauauuaucucucggcgcgaccagagaggcagcgggcaggucggaacguauggccugaauacauucaccaacaugggggcucaacuuauucggcagauggaaggcgagggaguguuuaagggcauccagcaucugacagccaccgaagagguugcggugcaggauuggcucgcccgcgucgggagagagcggcuguccagaauggcuaucucuggagacgauugcguggucaagccccuugacgaucgcuucgccaacgcucugacggcccucaaugacaugggcaaagugcggaaggauauucaacagugggaacccagcagagggugguccgacuggacccagguuccuuuuugcucucaccauuuccacgagcugaucaugaaagauggacgcgugcuggucgugccgugucggaaccaggacgaacucauuggcagagcgcgcaucagccaaggggccggcuggucccugcgggagacagcuugccuuggaaagucuuacgcccagauguggagccugauguauuuucacagacgcgaucuccggcuggcugccaaugcuauuuguuccgccgugcccagccauuggguuccuaccucuagaacaaccugguccauccacgcgcgccaugaauggaugacaaccgaggacaugcuuacgguguggaaccgggucuggauccaggagaaucccuggauggaagacaaaacaccuguggagagcugggaagagauucccuaccugggcaagagagaagaucaguggugcgggucucucaucggacugaccucccgggccaccugggcuagaaacauucaaacagccaucaaucagguucgcagccugauuggcuccgaggaguauaccgacuacaugccuucuaugaagcgguucagacgcgaagaggaagaggccggggugcucugguga

SEQ ID NO: 19575 - RNA, 9876 nt, Artificial Sequence
  derived and/or modified CDS sequence (opt5) from DENV-2__KF041235__SS-prME
accgccggagugaucauuaugcugauccccaccgcuauggccuuccaccucacgaccagaaacggggaaccucauaugauugucagcaagcaggaaaaaggaaagucccugcuuuuuaaaacagaagacggcguuaauaugugcacccugauggcgauggaucucggggaacugugugaagacacaaucaccuacaacugcccccuucugcggcaaaaugaacccgaagauauugacuguuggugcaacucuacaagcaccugggugacguauggaaccuguacagcuaccggcgaacaccgcagagaaaagcgguccguggcccucgucccucauguggggaugggacuggagacacgcaccgaaacguggaugucuagcgagggcgccuggaaacacgcucagagaaucgagacauggauccugcggcaucccggcuucaccauuauggccgcuauccucgccuacacaauugggaccaccuauuuucagcgcguucugaucuucauucuucugacagcgguggccccuuccaugacgaugagaugcaucggaauuucuaaucgggauuuugucgaaggcgugagcgggggauccuggguugacaucgugcucgagcacggcagcugugucaccacaauggcuaagaacaagcccacccuggauuucgaacuuaucaaaacagaggccaagcagccugcuacccugcgcaaauacugcauugaagccaagcucacgaauacaaccaccgcgucuagauguccgacacaaggggagcccucccugaacgaggaacaggacaaacgguuugugugcaagcacagcaugguggaucgcggauggggcaauggcugugggcuguucggaaagggcgggaucgugaccugcgccauguuuacaugcaaaaagaacauggagggaaaaauuguucagccugaaaaucucgaguauacgaucguggugacaccccauucuggcgaagagaacgcugucgggaaugacacaggaaagcacggcaaagagauuaaggugaccccucaguccagcaucacagaagccgagcugaccggcuacgggacgguuaccauggaauguucucccagaacaggacuugauuucaacgagauggugcugcuccaaauggaaaauaaggcuuggcugguccaucggcagugguuucuugaccugccgcucccuuggcugcccggcgccgauauccagggguccaacuggauucagaaggagacccuggugacauucaagaacccucacgccaaaaagcaagacguugugguccucggaagccaggagggcgcuaugcacaccgcgcugacgggggccacagaaauccagauguccucuggcaaucuucuguuuaccggacaucucaaaugccgccugagaauggacaaacuucaacugaaaggcaugagcuauuccauguguacagggaaguucaagguggucaaagagauugcugaaacccagcacggaaccaucgugguucgggugcaguacgagggcgaugggagccccugcaagauucccuucgagaucauggaccucgagaagcggcauguccugggacgccugaucacagugaacccuauuguuacggagaaggauucuccggugaauaucgaagccgagcccccuuuuggcgacuccuacauuaucauuggggucgaacccggccagcucaaacugagcugguucaagaagggaucuagcaucggccaaauguuugagaccacaaugagaggggccaaaagaauggcuauucuuggagauaccgccugggacuucggcucccucggagggguguuuacaucuaucggcaaggcgcuccaccagguguucggggcuaucuauggcgccgccuuuagcggaguuuccuggaccaugaaaauucugaucggcgucgugauuacguggaucgggaugaacagccgcucuacaucccugagcgugucucuuguccucgugggaguugugacccuguaccugggcgucauggugcaggcugauuccggguguguugugagcuggaagaauaaagagcucaagugcggauccggcauuuucaucaccgacaacguccauacauggaccgaacaguauaaguuucaaccugagucucccagcaaacuggccuccgcuauccagaaggcccacgaagaggggauuuguggcauccggucugugacaagacuugaaaaucugauguggaaacagauuacgccggagcucaaccacauccugagcgagaaugaaguuaagcuguccauuaugaccggagauaucaaaggcaucaugcaggcggggaagcgcagccuucggccucaacccacagagcucaaauacucuuggaagaccuggggaaaggccaaaaugcuguccacagaaccucauaaccagaccuuccugauugacggccccgagacggcugaaugcccuaauaccaacagagccuggaauagccucgagguggaggauuauggguuuggagucuucacaaccaacaucuggcugaaacuuaaagaacgccaggacguguuuugugacucuaagcugauguccgcugccauuaaagauaaucgggcggugcacgccgacaugggcuacuggaucgagagcgcucucaacgauacauggaagauugaaaaggccucuuucaucgaggucaaaagcugccauuggcccaagucccacacccuguggagcaacggcguucuggagucugaaaugaucauuccgaaaaauuucgcugggccugugucccagcacaacuauagacccggauaccauacacaaaccgccggccccuggcaccuugggaagcucgagauggacuuugauuucugugaaggaacgacaguggucgugaccgaggacugcggcaaucgcgggccuagccugcggaccacaaccgccuccggaaaacugaucacggaauggugcuguagaucuugcacacucccgccccugcgguaccgcggcgaggauggcuguugguaugggauggagauuagaccucuuaaggaaaaggaggaaaaccugguuaauagccucgugaccgcuggacauggccagaucgacaacuuuucccuggggguccugggaauggcgcuuuuccucgaggaaaugcugcggacaagagugggcaccaaacacgccguucugcucguggcugucucuuuuaugacacugauuaccgggaauaugagcuuccgcgaucuuggacgggugaugguuauggugggcgccgccaugacggacgauaucggcaugggggucaccuaccuggcucuccuggccgcguuuaaggugagacccacauucgcugccggacugcuucugcgcaaacucaccuccaaggagcugaugaugacaaccauuggcaucgugcuccugucucagagcacgacaccugagaccauccuugaacugacagacgcccucgcucuggggaugaugauucugaaaaucgucagaaacauggagaaguaucaacuugccguuaccauuauggcgauccugugcgugcccaaugcugugauucuccagaacgccuggaaggucuccuguaccauccuggccgcugugagcguuucuccucuccugcuuacauccagccagcagaaagccgauuggaucccccuggcucucacgauuaagggacugaauccgaccgccaucuuucugacaacccuuucucggacaaacaaaaagcgcuccuggccucugaaugaagcgauuauggccgugggcauggucagcauccucgcuucuucccugcucaaaaacgacauucccaugaccgggccucugguggccggaggccuucugacgguuugcuacgugcugacaggcagaagcgcugaccucgagcuggaacgggccgccgauguccgcugggaggaccaagcugagaucuccgggagcucucccauccuuagcauuaccaucuccgaagauggaucuaugagcauuaagaaugaggaagaggagcagacccugacaauccucauuagaaccggccugcucgugaucuccgggcuguucccggucucuauuccuaucacagcggccgcuugguaucuuugggaagugaaaaagcagcgggccggaguucugugggacgugcccagcccuccgcccgucggcaaggccgagcuggaagauggggcuuaccgcaucaaacagaaggggauucucggcuauucccaaaucggcgccgggguguacaaagagggaacguuucauaccauguggcacguuacaagaggcgcggugcugaugcacaaggggaaacggauugaaccuucuugggcugacguccgcaaggaucuuaucagcuacggaggcggguggaagcuggagggagaguggaaagaaggcgaggaaguccaggugcucgcccuggagccgggcaagaaccccagagccguucagaccaaaccugggcuguucaagacaaacaccggaacgauuggcgcugucucccuggacuuuagccccgggaccucuggauccccuaucguggauaaaaagggcaagguggucgggcuuuauggaaauggcgugguuacacggagcggcaccuacgugucugccaucgcgcagacagaaaaauccauugaggacaaccccgagaucgaagaugacauuuucagaaagaaacgccugaccaucauggaucugcauccuggggcuggaaagacaaaacgguaucucccggccauugucagagaggccaucaagcgcggccugcggacgcuuauccuggcucccaccagagugguugccgcugaaauggaggaagcccuccgcgggcugccuauucgguaccaaacacccgcgaucagagccgagcacaccggacgcgagauuguggaccucaugugucaugcuaccuucacaaugcggcugcuuagcccugucagagugcccaauuauaaccugaucauuauggacgaagcccacuuuacggauccggcuuccaucgccgcccggggcuacauuucuacccgcguugagaugggggaagcugcgggcaucuucaugacagccaccccucccggaagcagagaccccuuuccucaguccaaugcucccaucauggaugaggagcgggaaauuccugagcgcagcuggaacucuggccaugaaugggugacagacuucaaggggaaaaccgucugguuugugccguccaucaaggccggaaaugauauugccgcuugccugcgcaaaaacggcaagaaagugauccagcucagccggaagacguucgacucugaguauauuaagacaagaaccaaugauugggacuuugucguuaccacagauaucagcgaaaugggggccaacuucaaagcggagcgcgugaucgacccccggagauguaugaagccugugauucugaccgauggagaggaacgcgucauccuugcuggccccaugccugugacacacuccucugccgcccaacggagagggcgcauuggccggaaucccaaaaacgagaaugaccaguacaucuacaugggagaaccgcuggagaacgacgaagauugcgcucacuggaaggaggccaaaaugcuccuggacaauauuaacaccccugagggcaucauccccagcauguuugaaccugagagagaaaagguugaugcgauugacggggaguaucgccugagaggagaagcccggaaaacguucguggaucucaugcgcagaggcgaccuucccgucuggcuggcuuaccggguggccgcugaggggaucaacuaugccgaucgcagaugguguuuugacggaauuaagaauaaccagauccuggaggaaaauguugagguggaaauuuggacaaaggagggcgagcggaaaaagcucaaaccuagauggcuggaugcucgcaucuacuccgacccccuugcccugaaggaguucaaagaguucgcggccgggcggaagucucucacccugaaccugauuacagaaaugggcagacucccgaccuuuaugacgcagaaggcucgcaaugcccuugauaaccuggcuguccugcauaccgccgaggccggaggccgggcuuauaaucacgcgcucagcgaacugccugagacacuugagacccugcuccugcugacacuccuugccaccgugacagggggaaucuuccuguuucugauguccggcaaagggaucggaaagaugacccucggcaugugcugcauuaucacggcuagcauucugcuuugguacgcccaaauccagccccauuggauugccgcuucuaucauccuggaguucuuucucauuguccugcugauccccgagccugaaaaacagagaacaccgcaggacaaccaacucaccuaugugguuauugccauccuuaccgugguggcggccacaauggcuaaugagaugggcuuccuggaaaagaccaaaaaggauuuugggcugggauccauugccacacagcagcccgagagcaacauccucgacaucgaccugcggccugcuuccgccuggacgcuuuacgcggucgccaccacauucauuacccccaugcugcgccacucuaucgagaauagcuccguuaacgugucucucacagcuauugccaaucaggcuaccgugcugaugggccuggggaagggauggccucucagcaaaauggauaucggcgucccccuucuggccauuggguguuacucccaagugaacccuaucacgcugaccgcugcccuccugcuucugguugcgcacuaugccauuaucggaccgggccuccaggcuaaggccacaagagaagcucagaaacgggccgccgcgggcaucaugaagaaucccaccguggacgggauuacagucaucgaucuggacccuauucccuacgauccuaaauuugagaagcagcugggacaagugaugcuccuuguccugugcgugacccagguucugaugaugcgcacgacaugggcucucugugaagcccugacccuugcuacaggccccaucagcacccugugggaggggaacccgggaagauucuggaauaccacaauugccgugucuauggccaacaucuuucggggcuccuaucucgcuggggccggacugcuguucagcaucaugaagaacacgaccaauacacgcagaggcaccggcaacacaggggaaacccucggagagaaauggaagaaucggcuuaacucucugggcaaauccgaguuucagauuuacaagcgcagcgggauccaagaagucgacagaacgcuggcgaaagagggaauuaagcggggcgaaacagaucaucacgccgugucuagagggagcgcuaaacuccgcugguucguugagcggaaucuggugaccccugagggaaaggucguggaccuuggcugcggcagagggggaugguccuauuacuguggcgggcugaagaacgugcgcgaaguuaaaggacucaccaagggcgggcccggacaugaggaacccaucccuaugucuacauauggcuggaaucugguccggcugcagagcggcguggauguguucuuuacacccccugagaaaugcgacacccuccuuugugauauuggggaauccagcccgaaccccacggucgaggccggaagaacccugcgcguucugaaucucguggagaacuggcugaauaacaauacacaguucugcaucaaggugcuuaacccuuacaugcccuccgucaucgagaagauggagacccugcagcggaaguacggcggggcucucgugagaaauccucugucucgcaacagcacacacgaaauguauuggguuuccaacgccucuggaaauauugugagcuccgucaacaugaucucucggaugcugauuaauagauuuaccaugcgccauaagaaagcgacguacgagcccgacguggaucucggcagcgggacccggaacaucggaauugaauccgagacaccgaaucuugacaucaucggcaagagaauugagaaaaucaagcaagaacacgagaccagcuggcacuaugaccaggaucauccuuacaaaacaugggccuaucacggcucuuacgaaaccaagcagacaggguccgcuagcucuaugguuaacggagugguccgccugcugaccaagcccugggacgugauuccuauggugacgcagauggccaugacagauaccacccccuucggccaacagagagucuuuaaagagaagguugacacacggacgcaggaaccuaaagaggggaccaagaaacucaugaagaucacagcugaguggcuguggaaggaacuuggcaaaaagaaaacccccagaauguguacaagagaggaguucgcccggaaggugagauccaaugcugcccugggcgcgauuuuuaccgaugagaacaaauggaaaagcgcccgggaggcuguggaagacucucgcuucugggagcucgucgauaaagaaagaaaucugcaucuggaggggaagugcgaaacauguguguauaacaugaugggaaagcgggagaaaaagaucggcgaguuuggcaaagccaaggggucccgcgcuauuugguacauguggcucggagccagauuccuggaauuugaggcccuuggcuuccugaaugaagaccacugguuuagccgggagaacucccucagcgggguugaaggagagggccugcacaaacuuggguacauccugcgcgaggugucuaagaaggaaggcggagcgauguaugcugaugacaccgccggcugggauacgagaaucacccucgaggaccugaaaaaugaagagauggucacaaaccauauggaaggggagcacaagaaacuggccgaggcuauuuucaagcucaccuaccagaauaaagugguucgggugcaacgcccgacaccuagaggaaccgucauggacaucauuagccggcgcgaucagagaggcuccggacaggugggaacguauggccugaacacauucaccaacaugggggcccaacuuauccggcagauggaaggcgagggaguuuuuaagggcauucagcaucugacagcuaccgaagagguggccguccaggacuggcucgcgcgcguggggagagagcggcugucuagaauggccaucagcggagaugacugcgucgugaagccccuugaugaccgcuucgcuuccgcccugacggcucucaaugauaugggcaaaguucggaaggacauccaacagugggaacccucuagaggguggaacgauuggacccaggugccuuuuugcagccaccauuuccacgagcugauuaugaaagacggacgcguccugguggugccgugucggaaucaggaugaacucaucggcagagcccgcauuucccaaggggcgggcuggucucugcgggagacagccugccuuggaaagagcuacgcucagauguggucccugauguauuuucacagacgcgaccuccggcuggccgcuaacgccaucuguagcgcuguucccucucauugggugccuaccuccagaacaaccuggagcauucacgcccgccaugaauggaugacaaccgaggauaugcuuacggucuggaaucggguguggauccaggagaaccccuggauggaagacaaaacaccuguugagucuugggaagagauccccuaccugggcaagagagaagaccaguggugcgggucccucauuggacugaccagccgggcgaccugggccagaaauauccaaacagcuauuaaccaggugcgcucccugaucggcucugaggaguauaccgauuacaugccuagcaugaagcgguucagacgcgaagaggaagaggccgggguccucugguga

SEQ ID NO: 19576 - RNA, 9876 nt, Artificial Sequence
  derived and/or modified CDS sequence (opt5) from DENV-2__KF041237__SS-prME
accgccggagugaucauuaugcugauccccaccgcuauggccuuccaccucacgaccagaaacggggaaccucauaugauugucagcaagcaggaaaaaggaaagucccugcuuuuuaaaacagaagacggcguuaauaugugcacccugauggcgauggaucucggggaacugugugaagacacaaucaccuacaacugcccccuucugcggcaaaaugaacccgaagauauugacuguuggugcaacucuacaagcaccugggugacguauggaaccuguacagcuaccggcgaacaccgcagagaaaagcgguccguggcccucgucccucauguggggaugggacuggagacacgcaccgaaacguggaugucuagcgagggcgccuggaaacacgcucagagaaucgagacauggauccugcggcaucccggcuucaccauuauggccgcuauccucgccuacacaauugggaccaccuauuuucagcgcguucugaucuucauucuucugacagcgguggccccuuccaugacgaugagaugcaucggaauuucuaaucgggauuuugucgaaggcgugagcgggggauccuggguugacaucgugcucgagcacggcagcugugucaccacaauggcuaagaacaagcccacccuggauuucgaacuuaucaaaacagaggccaagcagccugcuacccugcgcaaauacugcauugaagccaagcucacgaauacaaccaccgcgucuagauguccgacacaaggggagcccucccugaacgaggaacaggacaaacgguuugugugcaagcacagcaugguggaucgcggauggggcaauggcugugggcuguucggaaagggcgggaucgugaccugcgccauguuuacaugcaaaaagaacauggagggaaaaauuguucagccugaaaaucucgaguauacgaucguggugacaccccauucuggcgaagagaacgcugucgggaaugacacaggaaagcacggcaaagagauuaaggugaccccucaguccagcaucacagaagccgagcugaccggcuacgggacgguuaccauggaauguucucccagaacaggacuugauuucaacgagauggugcugcuccaaauggaaaauaaggcuuggcugguccaucggcagugguuucuugaccugccgcucccuuggcugcccggcgccgauauccagggguccaacuggauucagaaggagacccuggugacauucaagaacccucacgccaaaaagcaagacguugugguccucggaagccaggagggcgcuaugcacaccgcgcugacgggggccacagaaauccagauguccucuggcaaucuucuguuuaccggacaucucaaaugccgccugagaauggacaaacuucaacugaaaggcaugagcuauuccauguguacagggaaguucaagguggucaaagagauugcugaaacccagcacggaaccaucgugguucgggugcaguacgagggcgaugggagccccugcaagauucccuucgagaucauggaccucgagaagcggcauguccugggacgccugaucacagugaacccuauuguuacggagaaggauucuccggugaauaucgaagccgagcccccuuuuggcgacuccuacauuaucauuggggucgaacccggccagcucaaacugagcugguucaagaagggaucuagcaucggccaaauguuugagaccacaaugagaggggccaaaagaauggcuauucuuggagauaccgccugggacuucggcucccucggagggguguuuacaucuaucggcaaggcgcuccaccagguguucggggcuaucuauggcgccgccuuuagcggaguuuccuggaccaugaaaauucugaucggcgucgugauuacguggaucgggaugaacagccgcucuacaucccugagcgugucucuuguccucgugggaguugugacccuguaccugggcgucauggugcaggcugauuccggguguguugugagcuggaagaauaaagagcucaagugcggauccggcauuuucaucaccgacaacguccauacauggaccgaacaguauaaguuucaaccugagucucccagcaaacuggccuccgcuauccagaaggcccacgaagaggggauuuguggcauccggucugugacaagacuugaaaaucugauguggaaacagauuacgccggagcucaaccacauccugagcgagaaugaaguuaagcuguccauuaugaccggagauaucaaaggcaucaugcaggcggggaagcgcagccuucggccucaacccacagagcucaaauacucuuggaagaccuggggaaaggccaaaaugcuguccacagaaccucauaaccagaccuuccugauugacggccccgagacggcugaaugcccuaauaccaacagagccuggaauagccucgagguggaggauuauggguuuggagucuucacaaccaacaucuggcugaaacuuaaagaacgccaggacguguuuugugacucuaagcugauguccgcugccauuaaagauaaucgggcggugcacgccgacaugggcuacuggaucgagagcgcucucaacgauacauggaagauugaaaaggccucuuucaucgaggucaaaagcugccauuggcccaagucccacacccuguggagcaacggcguucuggagucugaaaugaucauuccgaaaaauuucgcugggccugugucccagcacaacuauagacccggauaccauacacaaaccgccggccccuggcaccuugggaagcucgagauggacuuugauuucugugaaggaacgacaguggucgugaccgaggacugcggcaaucgcgggccuagccugcggaccacaaccgccuccggaaaacugaucacggaauggugcuguagaucuugcacacucccgccccugcgguaccgcggcgaggauggcuguugguaugggauggagauuagaccucuuaaggaaaaggaggaaaaccugguuaauagccucgugaccgcuggacauggccagaucgacaacuuuucccuggggguccugggaauggcgcuuuuccucgaggaaaugcugcggacaagagugggcaccaaacacgccguucugcucguggcugucucuuuuaugacacugauuaccgggaauaugagcuuccgcgaucuuggacgggugaugguuauggugggcgccgccaugacggacgauaucggcaugggggucaccuaccuggcucuccuggccgcguuuaaggugagacccacauucgcugccggacugcuucugcgcaaacucaccuccaaggagcugaugaugacaaccauuggcaucgugcuccugucucagagcacgacaccugagaccauccuugaacugacagacgcccucgcucuggggaugaugauucugaaaaucgucagaaacauggagaaguaucaacuugccguuaccauuauggcgauccugugcgugcccaaugcugugauucuccagaacgccuggaaggucuccuguaccauccuggccgcugugagcguuucuccucuccugcuuacauccagccagcagaaagccgauuggaucccccuggcucucacgauuaagggacugaauccgaccgccaucuuucugacaacccuuucucggacaaacaaaaagcgcuccuggccucugaaugaagcgauuauggccgugggcauggucagcauccucgcuucuucccugcucaaaaacgacauucccaugaccgggccucugguggccggaggccuucugacgguuugcuacgugcugacaggcagaagcgcugaccucgagcuggaacgggccgccgauguccgcugggaggaccaagcugagaucuccgggagcucucccauccuuagcauuaccaucuccgaagauggaucuaugagcauuaagaaugaggaagaggagcagacccugacaauccucauuagaaccggccugcucgugaucuccgggcuguucccggucucuauuccuaucacagcggccgcuugguaucuuugggaagugaaaaagcagcgggccggaguucugugggacgugcccagcccuccgcccgucggcaaggccgagcuggaagauggggcuuaccgcaucaaacagaaggggauucucggcuauucccaaaucggcgccgggguguacaaagagggaacguuucauaccauguggcacguuacaagaggcgcggugcugaugcacaaggggaaacggauugaaccuucuugggcugacguccgcaaggaucuuaucagcuacggaggcggguggaagcuggagggagaguggaaagaaggcgaggaaguccaggugcucgcccuggagccgggcaagaaccccagagccguucagaccaaaccugggcuguucaagacaaacaccggaacgauuggcgcugucucccuggacuuuagccccgggaccucuggauccccuaucguggauaaaaagggcaagguggucgggcuuuauggaaauggcgugguuacacggagcggcaccuacgugucugccaucgcgcagacagaaaaauccauugaggacaaccccgagaucgaagaugacauuuucagaaagaaacgccugaccaucauggaucugcauccuggggcuggaaagacaaaacgguaucucccggccauugucagagaggccaucaagcgcggccugcggacgcuuauccuggcucccaccagagugguugccgcugaaauggaggaagcccuccgcgggcugccuauucgguaccaaacacccgcgaucagagccgagcacaccggacgcgagauuguggaccucaugugucaugcuaccuucacaaugcggcugcuuagcccugucagagugcccaauuauaaccugaucauuauggacgaagcccacuuuacggauccggcuuccaucgccgcccggggcuacauuucuacccgcguugagaugggggaagcugcgggcaucuucaugacagccaccccucccggaagcagagaccccuuuccucaguccaaugcucccaucauggaugaggagcgggaaauuccugagcgcagcuggaacucuggccaugaaugggugacagacuucaaggggaaaaccgucugguuugugccguccaucaaggccggaaaugauauugccgcuugccugcgcaaaaacggcaagaaagugauccagcucagccggaagacguucgacucugaguauauuaagacaagaaccaaugauugggacuuugucguuaccacagauaucagcgaaaugggggccaacuucaaagcggagcgcgugaucgacccccggagauguaugaagccugugauucugaccgauggagaggaacgcgucauccuugcuggccccaugccugugacacacuccucugccgcccaacggagagggcgcauuggccggaaucccaaaaacgagaaugaccaguacaucuacaugggagaaccgcuggagaacgacgaagauugcgcucacuggaaggaggccaaaaugcuccuggacaauauuaacaccccugagggcaucauccccagcauguuugaaccugagagagaaaagguugaugcgauugacggggaguaucgccugagaggagaagcccggaaaacguucguggaucucaugcgcagaggcgaccuucccgucuggcuggcuuaccggguggccgcugaggggaucaacuaugccgaucgcagaugguguuuugacggaauuaagaauaaccagauccuggaggaaaauguugagguggaaauuuggacaaaggagggcgagcggaaaaagcucaaaccuagauggcuggaugcucgcaucuacuccgacccccuugcccugaaggaguucaaagaguucgcggccgggcggaagucucucacccugaaccugauuacagaaaugggcagacucccgaccuuuaugacgcagaaggcucgcaaugcccuugauaaccuggcuguccugcauaccgccgaggccggaggccgggcuuauaaucacgcgcucagcgaacugccugagacacuugagacccugcuccugcugacacuccuugccaccgugacagggggaaucuuccuguuucugauguccggcaaagggaucggaaagaugacccucggcaugugcugcauuaucacggcuagcauucugcuuugguacgcccaaauccagccccauuggauugccgcuucuaucauccuggaguucuuucucauuguccugcugauccccgagccugaaaaacagagaacaccgcaggacaaccaacucaccuaugugguuauugccauccuuaccgugguggcggccacaauggcuaaugagaugggcuuccuggaaaagaccaaaaaggauuuugggcugggauccauugccacacagcagcccgagagcaacauccucgacaucgaccugcggccugcuuccgccuggacgcuuuacgcggucgccaccacauucauuacccccaugcugcgccacucuaucgagaauagcuccguuaacgugucucucacagcuauugccaaucaggcuaccgugcugaugggccuggggaagggauggccucucagcaaaauggauaucggcgucccccuucuggccauuggguguuacucccaagugaacccuaucacgcugaccgcugcccuccugcuucugguugcgcacuaugccauuaucggaccgggccuccaggcuaaggccacaagagaagcucagaaacgggccgccgcgggcaucaugaagaaucccaccguggacgggauuacagucaucgaucuggacccuauucccuacgauccuaaauuugagaagcagcugggacaagugaugcuccuuguccugugcgugacccagguucugaugaugcgcacgacaugggcucucugugaagcccugacccuugcuacaggccccaucagcacccugugggaggggaacccgggaagauucuggaauaccacaauugccgugucuauggccaacaucuuucggggcuccuaucucgcuggggccggacugcuguucagcaucaugaagaacacgaccaauacacgcagaggcaccggcaacacaggggaaacccucggagagaaauggaagaaucggcuuaacucucugggcaaauccgaguuucagauuuacaagcgcagcgggauccaagaagucgacagaacgcuggcgaaagagggaauuaagcggggcgaaacagaucaucacgccgugucuagagggagcgcuaaacuccgcugguucguugagcggaaucuggugaccccugagggaaaggucguggaccuuggcugcggcagagggggaugguccuauuacuguggcgggcugaagaacgugcgcgaaguuaaaggacucaccaagggcgggcccggacaugaggaacccaucccuaugucuacauauggcuggaaucugguccggcugcagagcggcguggauguguucuuuacacccccugagaaaugcgacacccuccuuugugauauuggggaauccagcccgaaccccacggucgaggccggaagaacccugcgcguucugaaucucguggagaacuggcugaauaacaauacacaguucugcaucaaggugcuuaacccuuacaugcccuccgucaucgagaagauggagacccugcagcggaaguacggcggggcucucgugagaaauccucugucucgcaacagcacacacgaaauguauuggguuuccaacgccucuggaaauauugugagcuccgucaacaugaucucucggaugcugauuaauagauuuaccaugcgccauaagaaagcgacguacgagcccgacguggaucucggcagcgggacccggaacaucggaauugaauccgagacaccgaaucuugacaucaucggcaagagaauugagaaaaucaagcaagaacacgagaccagcuggcacuaugaccaggaucauccuuacaaaacaugggccuaucacggcucuuacgaaaccaagcagacaggguccgcuagcucuaugguuaacggagugguccgccugcugaccaagcccugggacgugauuccuauggugacgcagauggccaugacagauaccacccccuucggccaacagagagucuuuaaagagaagguugacacacggacgcaggaaccuaaagaggggaccaagaaacucaugaagaucacagcugaguggcuguggaaggaacuuggcaaaaagaaaacccccagaauguguacaagagaggaguucgcccggaaggugagauccaaugcugcccugggcgcgauuuuuaccgaugagaacaaauggaaaagcgcccgggaggcuguggaagacucucgcuucugggagcucgucgauaaagaaagaaaucugcaucuggaggggaagugcgaaacauguguguauaacaugaugggaaagcgggagaaaaagaucggcgaguuuggcaaagccaaggggucccgcgcuauuugguacauguggcucggagccagauuccuggaauuugaggcccuuggcuuccugaaugaagaccacugguuuagccgggagaacucccucagcgggguugaaggagagggccugcacaaacuuggguacauccugcgcgaggugucuaagaaggaaggcggagcgauguaugcugaugacaccgccggcugggauacgagaaucacccucgaggaccugaaaaaugaagagauggucacaaaccauauggaaggggagcacaagaaacuggccgaggcuauuuucaagcucaccuaccagaauaaagugguucgggugcaacgcccgacaccuagaggaaccgucauggacaucauuagccggcgcgaucagagaggcuccggacaggugggaacguauggccugaacacauucaccaacaugggggcccaacuuauccggcagauggaaggcgagggaguuuuuaagggcauucagcaucugacagcuaccgaagagguggccguccaggacuggcucgcgcgcguggggagagagcggcugucuagaauggccaucagcggagaugacugcgucgugaagccccuugaugaccgcuucgcuuccgcccugacggcucucaaugauaugggcaaaguucggaaggacauccaacagugggaacccucuagaggguggaacgauuggacccaggugccuuuuugcagccaccauuuccacgagcugauuaugaaagacggacgcguccugguggugccgugucggaaucaggaugaacucaucggcagagcccgcauuucccaaggggcgggcuggucucugcgggagacagccugccuuggaaagagcuacgcucagauguggucccugauguauuuucacagacgcgaccuccggcuggccgcuaacgccaucuguagcgcuguucccucucauugggugccuaccuccagaacaaccuggagcauucacgccggccaugaauggaugacaaccgaggauaugcuuacggucuggaaucgcguguggauccaggagaaccccuggauggaagacaaaacaccuguugagucuugggaagagauccccuaccuggggaagcgggaagaccaguggugcggaucccucauuggccugaccagcagagcgaccugggcccggaauauccaaacagcuauuaaccaggugagaucccugaucgggucugaggaguauaccgauuacaugccuagcaugaagcgcuuccggagagaagaggaagaggccggaguccucugguga

SEQ ID NO: 19577 - RNA, 9876 nt, Artificial Sequence
  derived and/or modified CDS sequence (opt5) from DENV-2__KM217156__SS-prME
accgccggcgugaucauuaugcugauccccaccgcuauggccuuccaccucacgaccagaaauggggaaccucauaugauuguuagcaagcaggaaaaggggaagucccugcuuuuuaaaaccgaagacggcguuaauaugugcacccugauggcgauggaucucggggaacugugugaagacacaaucaccuacaacugcccccuucugcggcaaaaugaacccgaggauauugacuguuggugcaacgcuacaucuaccugggugacguauggaaccuguacagccaccggcgagcaccgcagagaaaagcggagcguggcccucgucccucauguggggaugggacuggagacacgcaccgaaacguggauguccucugagggcgcuuggaaacacgcccagagaaucgagacauggauccugcggcaucccggcuucaccauuauggcugccauccucgcguacacaauugggaccaccuauuuucagcgcguucugaucuucauucuucugacagccguggcuccuagcaugacgaugagaugcaucggaauuuccaaucgggauuuugucgaaggcgugucugggggaagcuggguugacaucgugcucgagcacggcuccugugucaccacaauggccaagaacaagcccacccuggauuucgaacuuaucaaaacagaggcuaagcagccugccacccugcgcaaauacugcauugaagcgaagcucacgaauacaaccaccgccagcagauguccgacacaaggggagcccucucugaacgaggaacaggacaaacgguuugugugcaagcacuccaugguggaucgcggauggggcaauggcugugggcuguucggaaagggcgggaucguuaccugcgcuauguuuacaugcaaaaagaacauggagggaaaaauuguccagccugaaaaucucgaguauacgaucguggugacaccccauagcggcgaagagaacgccgucgggaaugacacaggaaagcacggcaaagagauuaaggugaccccucagucuuccaucacagaagcugagcugaccggcuacgggacgguuaccauggaauguagccccagaacaggacuugauuucaacgagauggugcugcuccaaauggaaaauaaagccuggcugguccaucggcagugguuucuugaccugccgcucccuuggcugcccggcgccgauauccaggggucuaacuggauucagaaggagacccuggugacauucaagaacccucacgcuaaaaagcaagacguugugguccucggaucccaggagggcgcgaugcacaccgcccugacgggggcuacagaaauccagaugagcuccggcaauccccuuuuuaccggacaucugaaaugccgccucagaauggacaagcugcaacuuaaaggcaugucuuauagcauguguacagggaaguucaagguggucaaagagauugccgaaacccagcacggaaccaucgugguucggauucaguacgagggcgaugggucccccugcaagaucccuuucgagaucauggaccuggagaagcggcaugugcucggacgccugauuacagucaacccgaucgugacggagaaggauagccccguuaauauugaagccgagccucccuuuggcgacucuuacaucauuaucgggguggaaccuggccagcugaaacucuccugguucaagaagggaagcucuauuggccaaauguuugagaccacaaugagaggggcuaaaagaauggccauccugggagauaccgcgugggacuucggcagccuugggggagucuuuacauccaucggcaaggcucugcaccagguguucggggccauuuauggcgccgcuuuuucuggagugagcuggaccaugaaaauccucauuggcguugucaucacguggauugggaugaacucccgcagcacaucucuguccgugagccuggugcuugucggagugguuacccucuaccugggcgugaugguccaggccgauucugggugugugguuuccuggaagaauaaagagcugaagugcggaagcggcaucuucuuuaccgacaacgugcauacauggaccgaacaguauaaguuccaacccgaguccccgucuaaacucgcuagcgccauccagaaggcgcacgaagaggggauuuguggcauccgguccauuacaagacuggauaaucuuauguggaaacagaucacgccugaacugaaccacauucucucugagaaugaggucaagcugagcaucaugaccggagacaucaaaggcauuaugcaggccgggaagcgcucccugcggccccaaccuacagaacuuaaauacagcuggaagaccuggggaaaggcuaaaaugcucucuacagagccccauaaccagaccuuucugaucgauggcccugaaacggcccagugccccaauaccaacagagcuuggaacucccuggagguggaagacuauggguucggaguuuuuacaaccaacauuuggcucaagcugaaagagcgccaggacguguucugugauagcaaacuuaugucugccgcgaucaaagacaaucgggccguccacgcugauaugggcuacuggauugaguccgcccugaacgacacauggaagaucgaaaaggcuagcuucaucgaggugaaaucuugccauuggcccaagagccacacccucugguccaacggcgugcuggaaagcgagaugauuaucccuaaaaauuuugccgggcccgucucucaacacaacuauagacccggauaccauacacagaccgccggcccuuggcaccuggggaaacuugagauggauuucgacuuuugugaaggaacgacaguuguggugaccgaggauugcggcaaucgcgggccgucccuccggaccacaaccgcuagcggaaaacugauuacggaauggugcuguagauccugcacacugcccccucuccgguaccgcggcgaggacggcuguugguaugggauggaaaucagaccccugaaggagaaggaggaaaaccuugucaauucucuggugaccgcgggacauggccagauugauaacuucagccucgggguucugggaauggcccuguuucuugaggaaaugcuccggacaagagugggcaccaaacacgcuguccugcugguggccguuuccuucaugacacucaucaccgggaauaugucuuuucgcgaccugggacgggugauggucauggugggcgccgcuaugacggaugacauuggcauggggguuaccuaccuugcccugcucgcggcuuucaaggugagaccuacauuugccgccggacugcugcuucgcaaacugaccagcaaggagcucaugaugacaaccaucggcaucguccugcucucccaaucuacgacacccgaaaccauucuggagcuuacagaugcucuggcccucgggaugaugauccugaaaauugugagaaacauggagaaguaucagcuggcggugaccaucauggcuauucuuugcgucccuaaugccguuauccugcagaacgccuggaaggugagcuguaccauccucgcugccguguccgucagcccccugcuccugacaucuucccagcaaaaagcugacuggauuccgcuugcccugacgaucaagggacucaauccuaccgcgauuuuccugacaacccugagccggacaaacaaaaagcgcucuuggccccuuaaugaagccaucauggcugugggcaugguuuccauucuggccagcucucuccugaaaaacgacaucccuaugaccgggccccucguggcuggaggccugcuuacggucugcuacgugcugacaggcagauccgccgaucuggagcucgaacgggccgcugacguucgcugggaggaucaggcggaaaucagcggguccagcccgauucugucuaucaccauuagcgaggacggauccaugucuaucaagaaugaggaagaggaacagacccuuacaauucugaucagaaccggccuccuggugauuagcgggcucuuuccugucuccauccccaucacagccgcugccugguaucugugggaggugaaaaagcagcgggccggaguccuuugggaugugccuucuccgcccccuguuggcaaggcugagcuggaagacggggccuaccgcauuaaacaaaagggaauccugggcuauagccagauuggcgcggggguguacaaagagggaacguuccauaccauguggcacgucacaagaggcgcugugcucaugcacaaggggaaacggaucgaaccguccugggccgauguucgcaaggaccugauuucuuacggaggcggguggaaacuugagggagaauggaaagagggcgaggaagugcagguccuggcccucgagcccggcaagaacccuagagcugugcagaccaaacccgggcuguuuaagacaaacaccggaacgaucggcgccgugagccucgauuucuccccugggaccagcggaucucccaucguugacaaaaagggcaaggucguggggcuguauggaaauggcguggucacacgguccggcaccuacgugagcgcgauugcucaaacagaaaaaucuaucgaggauaacccugaaauugaggacgauaucuucagaaagaaacgccuuaccauuauggaccugcauccgggggccggaaagacaaaacgguaucugcccgccaucguuagagaggcuaucaagcgcggccuccggacgcugauucuugccccuaccagaguggucgcugccgaaauggaggaagcgcugcgcgggcuccccauccgguaccagaccccugccauuagagcugagcacaccggacgcgaaaucguggaccugaugugucaugccaccuuuacaaugcggcuccugucccccguuagagugccgaauuauaaccuuauuaucauggaugaggcucacuucacggacccugccagcauugccgcucggggcuacaucuccacccgcgucgagaugggggaagcggccggcaucuuuaugacagcuacaccgcccggaucuagagauccuuucccccagagcaaugccccuauuauggacgaggaacgggagaucccggagcgcuccuggaacagcggccaugaaugggugacagauuuuaaggggaaaaccguuugguucgugcccucuauuaaggccggaaaugacaucgcugccugccugcgcaaaaacggcaagaaagucauucaacugucccggaagacguuugauagcgaguauaucaagacaagaaccaaugacugggauuucguggugaccacagacaucucugaaaugggggcgaacuuuaaagcugagcgcgucauugauccucggagauguaugaagcccguuauccucaccgacggagaagaaagagugauucuggccggcccuaugcccgugacacacagcuccgccgcucagcggagagggcgcaucggccggaauccgaaaaacgagaaugaccaguacauuuacaugggagaaccucuugagaacgaugaagacugcgcccacuggaaggaggcgaaaaugcugcucgauaauaucaacacccccgaaggcaucauuccuucuauguucgagcccgagagagaaaaggucgacgccaucgauggggaguaucgccugagaggagaagcucggaaaacguuuguggaccugaugcgcagaggcgaucucccuguuuggcuugccuaccggguggcugccgaggggauuaacuaugcugaccgcagaugguguuucgauggaaucaagaauaaccagauucuggaagagaaugucgagguggaaaucuggacaaaggagggcgaacggaaaaagcugaaacccagauggcucgacgcccgcauuuacagcgauccgcuggcgcuuaaggaguucaaagaguuugccgcugcccggaagucccugacccucaaccugaucacagaaauggggagacugccuaccuucaugacgcaaaaggcucgcaaugcccucgacaaccuugccguucugcauaccgcugaggcgggcggacgggccuauaaucacgcucugucugaacuccccgagacacuggaaacccuucugcuccugacacugcucgccaccgugacaggcgggaucuuucuuuuccugaugagcggaaaaggcauugggaagaugacccugggaaugugcugcaucauuacggccuccauccuccugugguacgcucagauucagccccauuggaucgccgcgagcaucauucuugaguuuuuccugaucguccuccugauuccugagccggaaaaacagagaacaccccaagauaaccagcugaccuauguggucaucgccauucucaccgugguugcugccacaauggcuaaugagaugggcuuucuugaaaagaccaaaaaggacuucggccuggggucuaucgccacacagcagccugaguccaacauccuggacauugaucuccggcccgcgagcgccuggacgcuguacgcuguggccaccacauuuaucaccccuaugcuucgccacuccauugaaaauucuagcgugaacgucucccugacagcuaucgccaaucaagcuaccguucucaugggacugggcaagggguggccccugucuaaaauggacauuggagugccucuccuugccaucggcuguuacagccaggugaacccgauuacgcugaccgcggcccugcuccugcuugucgcucacuaugccaucaucgggcccggacugcaggcuaaggccuccagagaggcccagaaacgggcggcugccggcauuaugaagaauccuacaguggauggcaucaccguuauugaccucgaucccaucccuuacgaccccaaauucgagaagcaacugggacaggugaugcugcucauucuuugcgucacacaggugcugaugaugcgcaccacgugggcucugugugaagcccucacacuggccaccggaccgaucagcacacuuugggagggcaacccugggagauuuuggaauaccaccaucgcugucucuauggccaacauuuuccggggauccuaucuggcgggcgccgggcuccuguuuagcaucaugaagaacacaacgaauacccgcagaggaacaggcaacaccggcgaaacacugggggagaaauggaagaaucgggugucucuccuuggaaaauccgaguuccaaauuuacaagcgcagcggcauccaggagguugauagaacccuggcuaaagaggggauuaagcggggagaaacggaccaucacgccgugucuagaggcagcgcuaaacugcgcugguucgucgagcggaaccucgugacacccgaagggaagguuguggaucugggaugcggcagaggcgggugguccuauuacuguggaggccuuaagaauguccgcgaggugaaagggcugaccaagggaggccccgggcaugaggaaccuauccccaugucuaccuauggauggaaccucgugcggcugcugacaggcgccgacgucuuuuucaccccuccggagaaaugcgauacacuccuuugugacaucggcgaaagcucccccaauccuacggucgaggcggggagaacccugcgcgugcugaaccucguggaaaauuggcugaacaauaacacacaguuuugcauuaagguccuuaaucccuacaugccuagcguuaucgagaaaauggagacccugcagcggaaguacggaggcgcccucgugagaaacccccugucccgcaauucuacacacgaaauguauugggugagcaacgcuuccgggaacauugucucuagcgugaauaugaucucccggaugcugauuaacagauucaccaugcgccauaagaaagccacguacgauccggacguugaccucggaucuggcacccggaauaucgggaucgagagcgaaacaccuaaccuugauauuaucggaaagagaauugagaaaaucaagcaagaacacgagaccucccgccacuaugaccaggaucaucccuacaaaacaugggcuuaucacggcagcuacgagaccaagcagacaggcucugccuccagcaccgugaauggggucgugagacugcugacgaagccuugggacguuauucccauggugacacagauggcuaugaccgauaccacaccuuuuggacaacagcgggucuucaaagaaaagguggacacgcgcacccaggagcccaaagaaggcacaaagaaacucaugaagaucaccgccgaguggcuguggaaggaacuugggaaaaagaaaacaccgagaauguguacccgggaggaguuugcgagaaaggugcggucuaacgccgcucugggagccauuuucacagaugaaaauaaauggaaguccgcucgcgaggccgucgaagacagcagauuuugggagcucguugauaaagagcggaaccugcaucuggaaggcaagugcgagaccuguguguauaauaugauggggaagcgcgagaagaagaucggagaguucggcaaagccaagggcucuagagcgaucugguacauguggcucggggcucgguuucuggaguucgaggcccuuggauuucugaacgaggaccacugguucucccgcgaaaauagccucuccggcguggagggggaaggacugcacaaacuuggcuacauucugagagaggucagcaagaaggaagggggcgccauguaugcugaugacacggccggaugggacacccggaucacacucgaggaucugaaaaacgaggaaauggugaccaaucauauggagggcgaacacaagaaacuggcugaggccauuuucaagcucacauaccagaacaaaguugugcgcguccaaagaccuacaccccgggggacggugauggacaucauuucucgcagagaucagcggggaagcguucaggugggcacauaugggcugggaaccuuuacaaauaugggcgcgcaacuuauccgccagauggaaggggagggcgucuucaagggaauccagcaucugaccgccacggaggaaguggcuguucaggacuggcucgccagagugggccgggagagacugucccgcauggcuauuucuggggaugacugcgucgugaagccccuugaugaccgguuugccagcgcgcugaccgcccucaacgauaugggaaaagucagaaaggacauccaacagugggaaccuucccgcggcuggaacgauuggacacaggugccguucugcucucaccauuuucacgagcugauuaugaaagacgggcggguucugguggucgcuuguagaaaucaggaugagcucaucggacgcgcccggauuagccaaggcgcuggguggucccugagagaaaccgccugccuuggcaagucuuacgcucagauguggagccugauguauuuccaccgccgggaccucagacuggccgcgaacgccaucuguuccgcugugcccagccauugggugccuacaucucgcaccacaugguccauccacgccggacaugaguggaugaccacggaagacaugcuuacaguuuggaaucggguguggauucaggagaaccccuggauggaagauaaaaccccugucgagagcugggaggaaauccccuaccugggcaagagagaggaccaguggugcgggucucucauuggacugaccucccgggccacaugggcuagaaauauccaaaccgccauuaaccaggugcgcagccugaucggcuccgaagaguauacagauuacaugccuucuaugaagcgguuugggagagaagaggaggaagcgggaguucucugguga

SEQ ID NO: 19578 - RNA, 9876 nt, Artificial Sequence
  derived and/or modified CDS sequence (opt5) from DENV-2__KX380809__SS-prME
accgccggaaucauuaucaugaugauucccaccgugauggcuuuccaccugacgaccagaaacggggaaccucauaugaucgugagccggcaggaaaaggggaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuauggcgauccugugcguuccuaacgcugugauccuccagaaugccuggaaagugagcuguacaauucuggccgucguguccguuagcccccuccugcuuacgucuucccaacagaaggcugacuggaucccucuggcccucaccauuaagggacugaaccccacagcuaucuuucugaccacacuuagcagaaccucuaaaaagcgguccuggccgcugaaugaagccauuauggcggugggcauggucagcauccucgccucuucccugcucaaaaacgauaucccuaugacggggccccugguggcuggaggccuucugacaguuugcuacgugcugaccggccgcagcgccgaccucgagcuggaaagagcugccgacguccggugggaggagcaggccgaaauuuccgggagcucuccuauccuuagcauuaccaucuccgaggauggaucuaugagcauuaagaaugaagaggaggaacagacacugaccauccucauucgcacaggccugcucgugaucuccgggcuguuccccgucucuaucccgauuacggcugcggccugguaucuuugggaggugaaaaagcaaagagcuggaguucugugggacgugccuucucccccucccgucggcaaagccgaacuggaggauggggccuaccggaucaagcagaagggcauucucggcuauucccagaucggcgcugggguguacaaagaaggaaccuuucacacaauguggcauguuacccgcggcgccgugcugaugcacaaggggaaaagaauugagcccuccugggcggacgucaagaaagaucuuaucagcuacggaggcggguggaagcuggagggagaauggaaggagggcgaagagguccaggugcucgcucuggaaccuggcaaaaacccgcgggccguucaaacaaagcccggacucuucaaaaccaacacgggaaccaucggcgccgucucccuggacuuuagcccugggacaucuggaucccccauuguggauaagaaaggcaagguggucgggcuuuauggaaauggcgugguuaccagaagcggcacauacgugucugcuaucgcccagaccgagaaguccauugaggacaacccugaaaucgaggaugacauuuuccgcaaaaagcggcugacaaucauggaucugcaucccggggcgggaaaaacgaagagauaucucccugcuaucguccgcgaagccauuaaacggggccugagaacccuuauccuggccccgacacgcgugguugcugccgagauggaagaggcucuccgggggcugcccauuagauaccagaccccugccauccgcgcggagcacaccggacgggaaauuguggaccucaugugucaugccacauucacgaugagacugcuuagccccauccgggucccuaauuauaaccugauuaucauggaugaggcucacuuuaccgaccccgccuccaucgcugcccgcggcuacauuucuacaagaguggaaaugggggaggccgcuggcaucuucaugaccgcgacaccgccuggaagccgggaccccuuuccccaguccaaugccccuauuauggaugaggaacgcgagauccccgaaagaagcuggaacucuggccacgaguggguuaccgacuucaaggggaagacggugugguuugucccuuccauuaaagcuggaaaugauaucgccgccugccugcggaagaacggcaaaaaggugauccaacucagcagaaaaacauucgacucugaauauauuaagacccgcaccaaugauugggacuuuguggucacaaccgauaucagcgagaugggggcuaacuucaaggccgagcggguuauugacccgagacgcuguaugaaacccgugauccugacagauggagaagaacgggugauucuugcgggcccuaugcccgucacccauuccucugcugcccagagacgcgggcgggugggcagaaauccuaagaacgaaaaugaccaguacaucuacaugggagagccccuggaaaacgaugaggacugcgcccacuggaaagaggcuaagaugcuccuggacaauaucaacacgccggaaggcauuaucccuagcauguuugagcccgaacgcgagaaaguugaugccauugacggggaauauagacugcggggagaggcgcgcaagacauucguggaucucaugagacggggcgaccuuccugucuggcuggccuaccgcguggcugccgaggggaucaacuaugcugauagacggugguguuuugacggaguuaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcggggagaaaaucucucacacugaaccugaucaccgagaugggccgccuccccacguuuaugacccagaaggcccggaaugcucuugauaaccuggccgugcugcauacagcugaagccggaggcagagccuauaaucacgcucucagcgagcugccggagacccuugaaacacugcuccugcugacccuccuugcgacagucaccgggggaaucuuccuguuucugauguccggcaaggggauuggaaaaaugacgcucggcaugugcugcaucauuacagccagcauccugcuuugguacgcucagauucagccucacuggaucgccgccucuaucauucuggaguucuuucucaucgugcugcugauucccgaacccgagaagcaacggaccccucaggacaaccagcucaccuauguugugaucgcuauucuuacaguggucgccgcgaccauggccaaugaaaugggcuuccuggagaaaacaaagaaagauuuugggcugggauccaucacgacccagcaaccggacagcaacauccucgauauugaccugcgccccgcuuccgccuggacacuuuacgcuguugccaccacauucaucaccccuaugcugagacauucuauugagaauagcuccgugaacgugucucucacggcgaucgccaaucaggcuaccguccugaugggccuggggaagggauggccccucagcaagauggacauuggcgugccucuucuggccaucggguguuacucccagguuaaccccauuacacugaccgcugcccuccugcuucugguggcucacuaugccaucaucggaccuggccuccaggcgaaagccacacgggaagcucaaaagcgcgccgcugccggcauuaugaaaaucccgaccgucgaugggauuacggugaucgaccuggaucccauuccuuacgaccccaaguuugagaaacagcugggacaggucaugcuccuugugcugugcguuacacaggugcugaugaugagaaccacaugggcccucugugaagcgcugacccuugcuaccggcccuaucagcacacugugggaggggaaucccggacgguucuggaacacgaccaucgccgucucuauggcuaauauuuuucgcggcuccuaucucgccggggccggacugcuguucagcaucaugaagaacacagcuaacaccagacggggcacaggcaauaccggggaaacgcucggagagaaguggaaaaaccgccuuaaugcccugggcaagucugaguuucaaauuuacaaaaaguccgggauccaggaaguggauagaacacuggcgaaagagggaauuaagcggggcgaaaccgaccaucacgccguuagcagagggucugcuaaacuccgcugguucguggagcggaaccuggucaccccggagggaaaggugguggaucuuggcugcggcagagggggauggagcuauuacuguggcgggcugaagaauguuaaagaagucaagggacucacaaaaggcgggccuggacaugaggaacccauccccauguccaccuauggcuggaaccuggugcgccugcagucuggcguggacgucuucuuuacaccucccgagaagugcgauacgcuccuuugugacaucggggaaagcuccccuaauccgaccguugaggccggacggacacugagagugcugaaccucguggagaauuggcugaacaauaacacccaauucugcauuaaaguccuuaaucccuacaugccuagcgugaucgaaaagauggaggcucugcagcgcaaguacggcggggcccucguucggaacccccuguccagaaauucuacacacgaaauguauugggugagcaacgcguccggaaacauugucucuagcgugaauaugaucucccgcaugcugauuaaccgguuuaccaugaaacacaagaaagccacguacgagccugauguugaccucggcucugggaccagaaauaucggaaucgaaagcgagacacccaaccuugauauuaucggcaagcgcauugagaaaaucaagcaggaacaugagaccuccuggcacuaugaccaggaccauccguacaagacaugggcuuaucacggcagcuacgaaaccaaacaaacagggucugccuccagcauggugaauggagucgugcggcugcugaccaagccuugggaugugauucccauggucacgcagauggcuaugacagacaccaccccuuucggccagcagagaguuuuuaaagagaagguggauacacgcacgcaagaacccaaagaggggaccaagaagcucaugaaaaucacagccgaguggcuguggaaggaacuuggcaaaaagaaaaccccuagaauguguacacgggaggaguucacccgcaaggugagaucuaacgcugcccugggcgcgauuuuuacagacgagaauaaauggaaguccgcccgggaggcugucgaagauagcggguucugggagcucguggacaaggaaagaaaccugcaccuggagggaaaaugcgaaaccuguguuuauaauaugaugggcaagcgggagaaaaagcucggcgaguuugggaaagccaagggaucucgcgcuaucugguacauguggcugggcgccagauuccuugaauuugaggcccugggguuccucaacgaagaucauugguuuucccgggagaauagccuguccggaguggaaggcgaggggcuucacaagcugggcuacauccuccgcgacgucagcaaaaaggagggaggcgcgauguaugcugaugacacggccgggugggauaccagaauuacacuggaagaccugaaaaacgaggaaauggugaccaaucauauggagggagaacaccggaagcucgccgaggcuaucuuccgccugacauaccagaacaaaguugugagaguccagcggcccaccccgcgcggcacggugauggacauuaucucuagacgggaucagcgcgggagcggacaaguugugacauauggccuuaauaccuucacaaacauggaggcccagcugauuagacagauggaaggggagggcgucuuuaaguccauccaacaucucaccgugacggaagagaucgcugucaagaacuggcuggagcgggugggacgcgaaagacuuucucggauggccauuagcggcgacgauugcguugugaaaccucuggacgauagauucgcguccgcccucaccgcucugaaugacauggggaagguccgcaaagauauccagcagugggagcccucucggggauggaacgacuggacacaggugcccuuuugcagccaccacuuccaugaacugauuaugaaggauggcagagugcucguugugccuugucgcaaucaagacgagcugaucgggcgggccagaauuucccagggagcuggcuggucucuucgcgaaaccgccugccuggggaaaagcuacgcgcagauguggucccucauguauuuucaccggagagaucugcgccuugccgcuaacgccaucuguagcgcugucccgucucauugggugcccacaucccggaccacauggagcauccacgccacccacgaguggaugacgacagaggacaugcugaccguuuggaauagaguguggauucaggaaaacccuuggauggaggauaagacccccgucgaaucuugggaggaaaucccuuaccucggcaagcgcgaggaccaauggugcggaucccugauuggccugacaagccgggcuaccugggccaaaaauauccagacagcgauuaaccaggugagaucccucaucgggaaugaggaauauacggacuacaugcccucuaugaagcgguucagacgcgaggaagaggaagccggaguccugugguga

SEQ ID NO: 19579 - RNA, 9876 nt, Artificial Sequence
  derived and/or modified CDS sequence (opt5) from DENV-2__KX380810__SS-prME
accgccggcaucauuaucaugaugauucccacggugauggcuuuccaccugacgacccggaacggggaaccucauaugaucgugagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccggcaaagacucuccgguuaacaucgaggccgaacccccuuuuggggauuccuacauuaucauuggcguggagcccggacagcugaagcucagcugguucaaaaagggcucuagcaucgggcagauguuugaaacaaccaugagaggagccaagcgcauggcuauucugggcgacacagccugggauuucgggucccuuggaggcgucuuuaccucuaucgggaaagcgcugcaucaaguguucggcgcuaucuauggagccgccuuuagcggcguguccuggacgaugaagauucucaucgggguugucauuacauggaucggaaugaauagccggucuaccucccugagcgugucucuggugcuugucggcauugugacccucuaccuggggguuauggugcaggcugacuccggaugugucgugagcuggaaaaacaaggagcugaaaugcggcuccgggaucuucaucacagauaauguucacaccuggacagagcaguauaaguuucagccugaaucucccagcaagcucgccuccgcuauucaaaaagcccacgaggaaggcaucuguggaauuagaucugugacgcgccuggagaaccuuauguggaagcagaucaccccggaacugaaucauauucucagcgagaacgaggucaaacugacaaucaugaccggcgacaucaaggggauuaugcaggcgggaaaacggucccugagaccucagcccacagaacuuaaguacagcuggaaagccuggggcaaggcuaagaugcucucuaccgagcugcacaaucauacguuccugaucgaugggccugaaaccgccgagugccccaacacaaaucgcgcuuggaacucccucgaaguggaggacuauggauuuggcguuuucaccacaaauauuuggcugaaacuuaaggagcggcaagauguguuuugugacagcaaacugaugucugccgcgaucaaggacaacagagccguccacgcugauaugggcuacuggauugaauccgcccucaacgacaccuggaaaaucgagaaggcuagcuucaucgaagugaagucuugccacuggccuaaaagccauacacugugguccaauggggugcuggagagcgagaugauuauccccaagaacuucgccggaccggucucucagcacaauuaucgcccuggcuaccauacccagacggccgggcccuggcaccuuggacggcucgaaauggauuuugacuucugugagggcacaaccguuguggugaccgaagauugcgggaacagaggacccucccugcggacaaccacggcuagcggcaaacugauuacagaguggugcugucgcuccugcacccucccuccgcugagauaccggggcgaagacggguguugguauggaauggagaucagaccccuuaaggagaaagaagagaaucuggucaacucucucgugacagcgggccaugggcagauugauaauuuuagccugggaguucugggcauggcccuuuuccucgaagagaugcugcgcacccggguggggacaaagcacgcuauccugcucgucgccguguccuuuguuacccugauuacgggaaacaugucuuucagagaccuuggccgcgugauggucauggugggcgccaccaugacagaugacaucgggaugggaguuaccuaccuggcucuccuggccgcguuuaaggugagaccuacauucgcugccggccugcuucugcggaaacucaccagcaaggaacugaugaugacgacaaucgggauuguccuccugucccaaucuaccauccccgagacaauucuugagcugaccgaugcccucgcucugggaaugauggugcugaaaaucgugcgcaauauggaaaaguaucagcuugccgucaccauuauggcgauccugugcguuccuaacgcugugauccuccagaaugccuggaaagugagcuguacaauucuggccgucguguccguuagcccccuccugcuuacgucuucccaacagaaggcugacuggaucccucuggcccucaccauuaagggccugaaccccacagcuaucuuucugaccacacuuagcagaaccucuaaaaagcgguccuggccgcugaaugaggccauuauggcgguggggauggucagcauccucgccucuucccugcucaaaaacgauaucccuaugacgggaccccugguggcuggcggccuucugacaguuugcuacgugcugaccgggcgcagcgccgaccucgaacuggagagagcugccgacguccggugggaagaacaggccgagauuuccggaagcucuccuauccuuagcauuaccaucuccgaagauggcucuaugagcauuaagaaugaggaagaggagcagacacugaccauccucauucgcacagggcugcucgugaucuccggacuguuccccgucucuaucccgauuacggcugcggccugguaucuuugggaagugaaaaagcaaagagcuggcguucugugggacgugccuucucccccucccgucgggaaagccgagcuggaagauggagccuaccggaucaagcagaagggcauucucggcuauucccagaucggggcuggaguguacaaagagggcaccuuucacacaauguggcauguuacccgcggggccgugcugaugcacaagggaaaaagaauugaacccuccugggcggacgucaagaaagaucuuaucagcuacggcgggggauggaagcuggagggcgaguggaaggaaggcgaggaaguccaggugcucgcucuggagccugggaaaaacccgcgggccguucaaacaaagcccggacucuucaaaaccaacacgggcaccaucggggccgucucccuggacuuuagcccuggaacaucuggcucccccauuguggauaagaaagggaagguggucggacuuuauggcaauggcgugguuaccagaagcgggacauacgugucugcuaucgcccagaccgaaaaguccauugaggacaacccugagaucgaagaugacauuuuccgcaaaaagcggcugacaaucauggaucugcaucccggagcgggcaaaacgaagagauaucucccugcuaucguccgcgaggccauuaaacgggggcugagaacccuuauccuggccccgacacgcgugguugcugccgaaauggaggaagcucuccggggacugcccauuagauaccagaccccugccauccgcgcggagcacaccggccgggagauuguggaccucaugugucaugccacauucacgaugagacugcuuagccccauccgggucccuaauuauaaccugauuaucauggaugaagcucacuuuaccgaccccgccuccaucgcugcccgcggguacauuucuacaagaguggagaugggcgaagccgcuggaaucuucaugaccgcgacaccgccuggcagccgggaccccuuuccccaguccaaugccccuauuauggaugaggagcgcgaaauccccgagagaagcuggaacucugggcacgaauggguuaccgacuucaagggaaagacggugugguuugucccuuccauuaaagcuggcaaugauaucgccgccugccugcggaagaacgggaaaaaggugauccaacucagcagaaaaacauucgacucugaguauauuaagacccgcaccaaugauugggacuuuguggucacaaccgauaucagcgaaaugggagcuaacuucaaggccgagcggguuauugacccgagacgcuguaugaaacccgugauccugacagauggcgaggaacgggugauucuugcggggccuaugcccgucacccauuccucugcugcccagagacgcggccgggugggaagaaauccuaagaacgagaaugaccaguacaucuacaugggcgaaccccuggagaacgaugaagacugcgcccacuggaaagaggcuaagaugcuccuggacaauaucaacacgccggaggggauuaucccuagcauguuugaacccgagcgcgaaaaaguugaugccauugacggagaguauagacugcggggcgaagcgcgcaagacauucguggaucucaugagaagaggggaccuuccugucuggcuggccuaccgcguggcugccgagggaaucaacuaugcugauagacggugguguuuugacggcguuaaaaauaaccaaauucuggaggaaaauguggaggucgaaaucuggaccaaggagggggagagaaagaaacucaagccccgcuggcuggaugcccggauuuacuccgacccucuugcucugaaagaguucaaggaguucgccgcgggcagaaaaucucucacacugaaccugaucaccgaaaugggacgccuccccacguuuaugacccagaaggcccggaaugcucuugauaaccuggccgugcugcauacagcugaggccggcgggagagccuauaaucacgcucucagcgaacugccggagacccuugagacacugcuccugcugacccuccuugcgacagucaccggaggcaucuuccuguuucugauguccgggaagggaauuggcaaaaugacgcucggcaugugcugcaucauuacagccagcauccugcuuugguacgcucagauucagccucacuggaucgccgccucuaucauucuggaguucuuucucaucgugcugcugauucccgagcccgaaaagcaacggaccccucaggacaaccagcucaccuauguugugaucgcuauucuuacaguggucgccgcgaccauggccaaugagaugggguuccuggagaagaccaagaaagauuuuggacugggcuccaucacgacccagcaaccggacagcaacauccucgauauugaccugcgccccgcuuccgccuggacacuuuacgcuguugccaccacauucaucaccccuaugcugagacauucuauugagaauagcuccgugaacgugucucucacggcgaucgccaaucaggcuaccguccugauggggcugggaaagggcuggccccucagcaagauggacauuggggugccucuucuggccaucggauguuacucccagguuaaccccauuacacugaccgcugcccuccugcuucugguggcucacuaugccaucaucggcccuggccuccaggcgaaagccacacgggaggcucaaaagcgcgccgcugccgggauuaugaaaaucccggccgcggauauuggaaccgucaucgaccuggaucccauuccuuacgaccccaaguuugaaaaacagcugggccaggugaugcuccuuguccugugcagcacacaggugcugaugaugagaacaaccugggcucucugugaggcccugacacuugcuaccgggccuaucucuacccugugggaaggaaaucccggccgguucuggaacacaacgaucgccguuuccauggccaauauuuuucgcgggagcuaucucgcuggagccggccugcuguucucuaucaugaagaacaccgcgaacacaagacggggcaccgggaauacaggagagacccucggcgaaaaguggaaaaaccgccuuaaugcccuggggaaguccgaguuucaaauuuacaaaaagagcggaauccaggagguggauagaacgcuggcuaaagaaggcauuaagagaggggaaacagaccaucacgccgucucucggggaagcgcuaaacuccgcugguucguggaacggaaccugguuaccccggagggcaagguggucgaucuuggcugcgggagaggaggcugguccuauuacugugggggacugaagaaugugaaagaggugaagggccucaccaaagggggaccuggccaugaagaacccauccccaugucuacauauggcuggaaccugguucgccugcagagcggggucgacguguucuuuaccccucccgaaaagugcgauacacuccuuugugacaucggagaguccagcccuaauccgacgguggaagccggccggacccugagaguccugaaccucguugagaauuggcugaacaauaacacacaauucugcauuaaagugcuuaaucccuacaugccuuccgugaucgagaagauggaagcgcugcagcgcaaguacgggggagcccucguccggaacccccugucuagaaauagcacccacgagauguauuggguguccaacgcuucuggcaacauuguuagcuccgugaauaugaucucucgcaugcugauuaaccgguuuacaaugaaacacaagaaagccaccuacgaaccugaugucgaccucgggagcggaacgagaaauaucggcaucgaguccgaaacccccaaccuugauauuaucggcaagcgcauugagaaaaucaagcaggagcaugaaacaagcuggcacuaugaccaggaccauccguacaagaccugggcuuaucacgggucuuacgagacaaaacaaaccggauccgccagcucuauggugaauggcguugugcggcugcugacaaagccuugggaugucauucccauggugacccagauggcuaugacggacacaaccccuuucgggcagcagagaguguuuaaagaaaaggucgauacccgcacacaagagcccaaagaaggaacgaagaagcucaugaaaaucaccgccgaguggcuguggaaggagcuuggcaaaaagaaaacaccuagaauguguacccgggaagaguucacacgcaagguuagauccaacgcggcccugggggcuauuuuuaccgacgaaaauaaauggaaaagcgcccgggaggcuguggaggauucuggauucugggaacucguggacaaggagagaaaccugcaccuggaaggcaaaugcgagacaugugucuauaauaugaugggcaagcgggagaaaaagcucggggaguuuggaaaagccaagggcucccgcgccaucugguacauguggcugggggcgagauuccuugaguuugaagcucugggauuccucaacgaggaucauugguuuagccgggaaaauucccugagcggcguggagggggaaggccuucacaagcugggauacauccuccgcgacguuucuaaaaaggagggcggggccauguaugccgaugacaccgcuggaugggauacgagaauuacccuggaggaccugaaaaacgaagagauggugacaaaucauauggaaggcgagcaccggaagcucgccgaagcuaucuuccgccugaccuaccagaacaaagucgugagaguucagcggcccacaccgcgcgggaccgugauggacauuaucagcagacgggaucagcgcggauccggccaagucgugacguaugggcuuaauacauucaccaacauggaggcccagcugauuagacagauggagggcgaaggaguuuuuaagucuauccaacaucucacagugaccgaggaaaucgcggucaagaacuggcuggagcgggugggccgcgagagacuuagccggauggccauuuccggggacgauugcgucgugaaaccucuggacgauagauucgcuucugcccucacggcucugaaugacaugggaaagguucgcaaagauauccagcagugggaacccagccggggcuggaacgacuggacccaggugcccuuuugcucccaccacuuccaugagcugauuaugaaggaugggagaguccucguggugccuugucgcaaucaagacgaacugaucggacgggccagaauuucucagggcgcgggguggagccuucgcgagacagccugccugggcaaauccuacgcucagauguggagccucauguauuuucaccggagagaucugcgccuugccgcuaacgccaucuguucugcuguuccgucccauugggugcccaucagccggaccacauggucuauucacgccacccacgaauggaugacaaccgaggacaugcugacggucuggaauagaguguggauccaggagaacccuuggauggaagauaagacacccguugaguccugggaagagauuccuuaccucggaaagcgcgaagaccaauggugcggcagccugaucgggcugaccucccgggcgaccugggccaaaaauauucagacagcuaucaaccaggugagaucucucauuggaaaugaggaguauaccgacuacaugcccagcaugaagcgguucagacgcgaagaggaagaggccggcguccugugguga

SEQ ID NO: 19580 - RNA, 9876 nt, Artificial Sequence
  derived and/or modified CDS sequence (opt5) from DENV-2__KX380811__SS-prME
accgccggaaucauuaucaugaugauucccaccgugauggcuuuccaccugacgaccagaaauggggagccucauaugaucgucagccggcaggaaaagggaaaaucccuccuguuuaagaccgagaauggcguuaacaugugcacccuuauggccauggaccugggggaacucugugaggauacgauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaccucaugagcgcugccauuaaagacaacagagcggugcacgccgauaugggcuacuggaucgagucugcucugaaugacacauggaagauugaaaaagccuccuucaucgaggucaagagcugccacuggcccaagucucauacccuguggagcaacggcguucuugaguccgaaaugaucauuccuaaaaauuucgcugggcccgugagccagcacaacuaucgcccgggauaccauacgcagacagccggcccuuggcaccucgggcggcuggagauggauuuugacuucugugaaggaaccaccguggucgugacagaggauugcggcaauagagggcccucucugcggaccacgacagccuccggaaagcucaucaccgaauggugcugucgcagcugcacacugcccccucuuagauaccggggcgaggacggcuguugguaugggauggagauuagaccgcugaaagaaaaggaggaaaaccucguuaauucccuggugaccgcuggacauggccagaucgauaacuuuucucuggggguccuuggaauggcgcuguuccuggaggaaaugcugcgcacacgggugggcaccaaacacgccauucuccugguugcugugagcuuugucacgcuuaucaccgggaauauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaagcugacgucuaaagagcucaugaugacaaccaucggcaucgugcugcuuagccaauccacaauuccugagucuauccuggaacucaccgaugcccuggcccuggggaugaugguccuuaagauuguucgcaacauggagaaauaucagcuggcugugaccaucauggccauucucugcgugcccaaugcggucauccugcagaacgcuuggaaggugagcuguacaacgcucgccguuguguccgucagcccucugcuucugaccucuucccaacagaaagccgacuggaucccccucgcucugacaauuaagggacugaauccuaccgccaucuuucuuacaacccugagcagaacgucuaagaaacgguccuggccccucaacgaagcuauuauggccgugggcaugguuagcauccuggcgucuucccuccugaagaaugauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaaaaacgaagaggaggaacagacccucacaauccugauucgcacgggccuccuggugaucuccgggcuuuucccuguuucuauucccaucaccgccgcugcgugguaucugugggaggugaagaaacaaagagccggaguccugugggacgugccgagcccucccccuguuggcaaggcugaacucgaggauggggccuaccggaucaaacagaagggcauucugggcuauucccagaucggcgccgggguguacaaggaaggaacauuucacaccauguggcaugucacacgcggcgcugugcuuaugcacaaagggaagagaauugagcccucuugggccgacgugaaaaaggaucugaucagcuacggaggcggguggaaacucgagggagaauggaaggagggcgaagagguucagguccuggcgcucgaacccggcaagaacccucgggcugugcaaaccaaaccggggcuguucaagacgaauaccggaacaauuggcgccgugucccuugacuuuagccccgggaccucuggauccccuaucgucgauaaaaagggcaaagugguugggcuguauggaaacggcguggucacaagaagcggcaccuacgugucugccaucgcucagacagagaaguccauugaggacaaucccgaaaucgaggaugacauuuuccgcaagaaacggcugacgaucauggaucuccauccuggggccggaaagaccaaaagauaucugcccgcgauuguucgcgaagcuaucaagcggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaacuauaaucugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaacgcgcccauuauggaugaggaacgcgagaucccugaaagaagcuggaacucuggccacgagugggucacggacuucaaagggaagacagugugguuugugcccuccauuaaggccggaaacgauaucgcugccugccuccggaaaaauggcaagaaagucauucaacugagcagaaagaccuucgacucugaauauaucaaaacccgcacaaacgauugggacuuuguugugaccacagauaucagcgagaugggggccaauuucaaggcugagcgggugauugacccuagacgcuguaugaagccggucauccuuaccgauggagaggaacgggugauucuggccggccccaugccuguuacgcauuccucugcggcucagagacgcgggcgggugggcagaaaccccaaaaaugaaaacgaccaguacaucuacaugggagagccucucgaaaaugaugaggacugcgcccacuggaaggaggccaaaaugcugcuggacaacauuaacacacccgaaggcaucaucccgagcauguuugagccugaacgcgagaaggucgaugcuauugacggggaauauagacuccggggagaggcccgcaaaaccuucguggaucuuaugagacggggcgaccugcccguuuggcuggcguaccgcguggccgcugaggggaucaauuaugccgauagacggugguguuuugacggagucaagaacaaucaaauucucgaagagaacguggaagucgagaucuggacaaaagagggcgaaagaaagaagcugaaaccucgcuggcuugaugcucggauuuacuccgacccccuggcccucaaggaguucaaagaguucgcugccgggagaaagucucugacccugaaucucaucacggagaugggccgccuuccuaccuuuaugacacagaaagcgaagaacgcccuggauaaucuggcugugcuccauaccgccgaagcuggaggccgggccuauaaccacgcccugagcgagcuucccgagacacuggaaacccuccugcugcucacacuucuggcuaccguuacagggggaauuuuccuguuucucauguccggcaaggggaucggaaaaaugacacugggcaugugcugcaucauuaccgcgagcauccuucugugguacgcccagauucagccgcacuggaucgcugccucuauuauccucgaguucuuucugaucgugcugcucauuccugaacccgagaagcaaagaacaccccaggacaaucagcuuacauauguggucaucgccauucugaccguuguggcugccacaauggcgaacgaaaugggcuuccuggagaaaacgaagaaagauuuugggcucggauccaucaccacacagcaaccugagagcaauauucuggacaucgaucuucggccggccuccgcuuggacccuguacgccguggcuacaaccuucaucacgcccaugcuccgccauucuauugaaaacagcuccgucaaugugucucugaccgccaucgcgaaccaggccacaguucugaugggccucgggaagggauggccucuuagcaagauggacauuggcgugccccugcuggcuaucggguguuacucccaggucaauccuauuacccucacagccgcucugcuucugcucguggcccacuaugcuaucauuggacccggccugcaggccaaagcgaccagagaggcccaaaagcgggcugccgcuggcaucaugaaaaucccuacggucgacgggaugacagugauugaucuggacccgauccccuacgauccuaaguuugaaaaacagcucggacagguuaugcuucuggugcugugcgucacccaggugcucaugaugcgcacaaccugggcccugugugaggcccuuacccuggcgacaggccccauuagcacgcucugggaagggaacccuggaagauucuggaauaccacaaucgcuguuucuauggccaacauuuuucggggcuccuaucuggcuggggccggacuccuguucagcaucaugaagaacaccgccaauacacgcagaggcaccggcaacacgggggagacacuuggagagaaguggaaaaaucggcugaacgcucugggcaagucugaauuucaaaucuacaaaaaguccgggauucaggagguggaccgcacccucgccaaagaaggaaucaagagaggcgagaccgaucaucacgcggucagccgggggucugccaaacugagaugguucguggagcgcaaucuugugacacccgaaggaaagguugucgaccugggcugcggcagagggggauggagcuauuacuguggcgggcucaagaacgugaaagaggugaagggacugaccaaaggcgggccgggacaugaagaaccuauucccauguccacauauggcuggaaucuggucagacuccagucuggcguugauguguucuuuacgcccccugaaaagugcgacacccuucugugugauaucggggagagcucccccaacccuacaguggaggcuggacgcacccugcggguccucaaucugguggaaaacuggcuuaauaacaauacacaauucugcauuaaaguucugaacccguacaugcccagcgugaucgagaagauggaagcccuccagagaaaguacggcggggcucugguccgcaauccucugucccggaacucuacccacgagauguauugggugagcaacgccuccggaaauaucguuucuagcgugaacaugauuuccagaaugcucaucaaucgcuuuacgaugcggcacaaaaaggcgaccuacgaacccgacgucgaucuuggcucugggacaagaaacauuggaaucgagagcgagaccccuaaucuggacauuaucggcaaacgcaucgaaaagauuaaacaggagcaugaaacauccuggcacuaugaucaggaccaucccuacaagaccugggccuaucacggcagcuacgagacaaagcaaaccgggucugcuuccagcauggugaacggagugguccggcugcucacgaaaccgugggacguuaucccuauggugacacagauggccaugaccgauaccacacccuucggccagcagagaguguuuaaggaaaaagucgacacgcgcacccaagagccuaaggaggggaccaaaaagcugaugaagauuaccgcugaauggcuuuggaaagagcugggaaagaaaaagacacccagaauguguacccgggaagaguucacacgcaaagugagaucuaaugccgcucucggcgccaucuuuaccgaugagaacaaguggaaauccgcgcgggaagccguugaggacagcggguucugggaacugguggauaaggagagaaaucugcaccucgaaggaaagugcgagacgugugucuauaacaugaugggcaaacgggagaagaaacugggcgaauuugggaaggcuaaaggaucucgcgccauuugguacauguggcuuggcgcuagauuccuggaguuugaagcccucggguuccugaaugaggaccauugguuuucccgggaaaacagccuuuccggaguggagggcgaggggcugcacaagcucggcuacauccugcgcgauguuagcaagaaagaaggaggcgccauguaugcggacgauaccgcugggugggacacaagaauuacccuggaggaucucaagaaugaagagauggugacaaaccauauggaaggagagcacaaaaagcuggccgaggccaucuucaaacuuaccuaccagaauaaggucgugcggguucagcgcccuacgcccagaggcacagugauggacaucauuucucggcgcgaccagagagggagcggacaagucgugaccuauggccugaacacauucaccaacauggaagcucagcucauccggcagauggagggggaaggcgucuuuaaguccauucaacagcugacggugaaagaggagaucgccguuaagaauuggcuuauucgcgugggaagagaacggcugucucgcauggcuaucagcggcgaugacugcgucgugaaaccgcucgaugacagauucgccuccgcgcugaccgcccugaacgauauggggaaggugcggaaagacauccagcagugggagccuucuagaggauggaaugauuggacacaaguucccuuuugcagccaucacuuccacgaacucauuaugaaggacggccgcgugcuggucgugcccugucggaaccaggaugagcuuaucgggagagcucgcauuucccagggagccggcuggucucugcgggaaaccgcuugccucggaaagagcuacgcccagauguggucccugauguauuuucauagacgcgaccuucggcuggcggccaaugcuaucuguagcgccguuccuucucacuggauuccgacauccagaaccacauggagcauccaugcuacccacgaguggaugacgacagaggauaugcucaccguguggaaccgcgucuggauccaagaaaaucccuggauggaggacaaaaccccuguggaaucuugggaggaaauucccuaccugggcaagcgggaggaucaguggugcggaucccugaucggccucacaagcagagccaccugggcuaaaaacauucagacagccaucaaucagguccgcucccugauugggaacgaggaauauacggacuacaugccuucuaugaagcgguucagacgggaggaagaggaagcgggagugcuuugguga

SEQ ID NO: 19581 - RNA, 9876 nt, Artificial Sequence
  derived and/or modified CDS sequence (opt5) from DENV-2__KX380813__SS-prME
accgccggaaucauuaucaugaugauucccaccgugauggcuuuccaccugacgaccagaaacggggagccucauaugaucgucagccggcaggaaaagggaaagucccuccuguuuaagacagagaauggcguuaacaugugcacccuuauggccauggaccugggggaacucugugaggauacaauuaccuacaauugcccgcugcuuagacaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagagcgccgaaacccaacauggaacaaucguuauuagagugcaguacgagggcgacgggucuccuugcaaaauccccuucgagauuauggaucucgaaaagcgccacguccugggacggcugaucacggugaaucccaucguuaccgagaaagacuccccugugaacauugaagcugagccgcccuuuggcgauagcuacaucauuaucggggucgaaccuggccagcucaagcugucuugguucaaaaagggaagcuccauuggccagauguuugagacaaccaugagaggggccaagcgcauggccauccuuggagacacagcuugggauuucggcucucucgggggaguguuuaccagcauuggcaaagcccuccaucaaguguucggggcgaucuauggcgcugccuuuuccggaguuagcuggacgaugaagauccugauuggcgucgugaucacauggauugggaugaacucucgguccaccagccugucugugucccuuguccucgugggaguugugacccuguaccugggcgucauggugcaggccgacagcggguguguuguguccuggaaaaacaaggagcucaaaugcggaucuggcaucuucauuacagauaauguccacaccuggacagaacaguauaaguuucagcccgagagcccuuccaagcuggcuucugccauccaaaaagcucacgaagaggggaucuguggcauuagaagcgugacgcgccuugaaaaccugauguggaagcagaucacccccgagcucaaucauauucugacagagaacgaaguuaaacugaccaucaugacaggagacauuaagggcaucaugcaggccgggaaacggacccuuagaccgcagccuacggagcucaaguacuccuggaaagcguggggaaaggccaagaugcugagcaccgaacugcacaaucauacauuccucaucgauggccccgagaccgcugaaugcccuaacacaaaucgcgccuggaacucucuggagguggaggacuauggguuuggagucuucaccacaaauauuuggcuuaaacugaaggaacggcaagauguguuuugugacuccaaacucaugagcgcugccaucaaggacaacagagcggugcacgccgauaugggcuacuggauugagucugcucugaacgacaccuggaaaaucgaaaaggccuccuucauugaggucaagagcugccacuggcccaaaucucauacgcuguggagcaauggcguucuugaguccgaaaugaucaucccuaagaacuucgcugggcccgugagccagcacaauuaucgcccgggauaccauacacagaccgccggcccuuggcaccucgggcggcuggagauggauuuugacuucugugaaggaaccacaguggucgugaccgaggauugcggcaacagagggcccucucugcggacgacaaccgccuccggaaaacucauuacagaauggugcugucgcagcugcacccugcccccucuuagauaccggggcgaggacggcuguugguaugggauggagaucagaccgcugaaggaaaaagaggaaaaucucguuaacucccuggugacagcuggacauggccagauugauaauuuuucucuggggguccuuggaauggcgcuguuccuggaggaaaugcugcgcacccgggugggcacgaagcacgccauccuccugguugcugugagcuuugucacccuuauuacagggaacauguccuucagagaccugggacgcgugaugguuauggugggcgccaccaugacagaugacaucggcaugggggucaccuaccucgcccugcuggcugccuuuaagauuagacccacguucgcggcuggacuucugcuccggaaacugacaucuaaggagcucaugaugaccacaaucggcaucgugcugcuuagccaauccaccauuccugagucuauccuggaacucaccgaugcccuggcccuggggaugauggugcuuaaaauuguccgcaauauggagaaguaucagcuggcuguuacaaucauggccauucucugcgugcccaacgcggugauccugcagaaugcuuggaaagucagcuguacgacccucgccgugguuuccgugagcccucugcuucugacaucuucccaacagaaggccgacuggaucccccucgcucugaccauuaagggacugaacccuacagccaucuuucuuaccacgcugagcagaacaucuaaaaagcgguccuggccccucaaugaagcuauuauggccgucggcauggugagcauccuggcgucuucccuccugaaaaacgauauuccgaugaccgggccucuuguugccggaggccugcugaccgugugcuacguccucacaggccgcagcgcugaccuggagcuugaaagagccgcugacgugcggugggaggagcaggccgaaaucuccgggagcucucccauccugagcauuaccaucuccgaggauggaucuaugagcauuaagaaugaagaggaggaacagacacucacgauccugauucgcaccggccuccuggucaucuccgggcuuuucccugugucuauucccaucacagccgcugcgugguaucugugggagguuaaaaagcaaagagccggagugcugugggacgucccgagcccucccccugugggcaaagcugaacucgaggauggggccuaccggaucaagcagaagggcauucugggcuauucccagaucggcgccgggguuuacaaagaaggaaccuuucacacaauguggcaugugacccgcggcgcuguccuuaugcacaaggggaaaagaauugagcccucuugggccgacgugaagaaagaucugaucagcuacggaggcggguggaagcucgagggagaauggaaggagggcgaagaggugcagguucuggcgcucgaacccggcaaaaacccucgggcuguccaaacgaagccggggcuguucaaaaccaacacaggaaccauuggcgccgugucccuugacuuuagccccgggacaucuggauccccuaucguggauaagaaaggcaaggucguggggcuguauggaaauggcguugugaccagaagcggcacauacgucucugccaucgcucagacggagaaguccauugaggacaaccccgaaaucgaggaugacauuuuccgcaaaaagcggcugaccaucauggaucuccauccuggggccggaaaaacaaagagauaucugcccgcgauugugcgcgaagcuaucaaacggggccuuagaacccugauccucgccccuacccgcguuguggccgcugagauggaagaggcccugcgggggcucccgauuagauaccagacacccgcuauccgcgccgagcacacgggacgggaaauugucgaccugaugugucaugcgaccuucacaaugagacuucugagcccuauccgggugcccaauuauaaccugauuaucauggaugaggcccacuuuaccgacccugcuuccauugccgcucgcggcuacaucucuacaagaguugaaaugggggaggccgccggcaucuucaugaccgcuacgcccccgggaagccgggacccuuuuccccaguccaaugcgcccauuauggaugaggaaaaggagaucccugaacgcagcuggaacucuggccacgagugggugacagacuucaaggggaaaaccgucugguuugugcccuccauuaaggccggaaaugauaucgcugccugccuccgcaagaauggcaagaaagugauucaacugagccggaagaccuucgacucugaauauaucaagacaagaaccaaugauugggacuuugucguuacaaccgauaucagcgagaugggggccaacuucaaagcugagcgcgugauugacccucggagauguaugaagccggugauccuuacggauggagaggaacgcgucauucuggccggccccaugccugugacacauuccucugcggcucagcggagagggcgcguuggccggaaucccaaaaacgaaaaugaccaguacaucuacaugggagagccucucgaaaacgaugaggacugcgcccacuggaaggaggccaaaaugcugcuggacaauauuaacacccccgaaggcaucaucccgagcauguuugagccugaaagagagaagguggaugcuauugacggggaauaucgccucagaggagaggcccggaaaacauucgucgaucuuaugcgcagaggcgaccugcccguguggcuggcguaccggguugccgcugaggggaucaacuaugccgaucgcagaugguguuuugacggagugaagaauaaccaaauucucgaagagaaugucgaaguggagaucuggaccaaggagggcgaacggaaaaagcugaaaccuagauggcuugaugcucgcauuuacuccgacccccuggcccucaaggaguucaaagaguucgcugccgggcggaagucucugacgcugaaccucaucaccgagaugggcagacuuccuacauuuaugacccagaaggcgaaaaaugcccuggauaaccuggcuguccuccauacagccgaagcuggaggccgcgccuauaaucacgcccugagcgagcuucccgagacccuggaaacacuccugcugcucacccuucuggcuacggugacagggggaauuuuccuguuucucauguccggcaaggggaucggaaaaaugacccugggcaugugcugcaucauuaccgcgagcauccuucugugguacgcccagauucagccgcacuggaucgcugccucuauuauccucgaguucuuucugaucguucugcucauuccugaacccgagaagcaacggacaccccaggacaaccagcuuaccuauguggugaucgccauucugacagucguugcugccacgauggcgaaugaaaugggcuuccuggagaaaaccaagaaggauuuugggcucggauccaucacaacccagcaaccugagagcaacauucuggacaucgaucuuagaccggccuccgcuuggacacuguacgccguggcuaccacguucaucacccccaugcuccggcauucuauugaaaauagcuccgugaacgucucucugacagccaucgcgaaucaggccaccgugcugaugggccucgggaaaggauggccucuuagcaagauggacauuggcguuccccugcuggcuaucggguguuacucccaggugaacccuauuacacucaccgccgcucugcuucugcucgucgcccacuaugcuaucauuggacccggccugcaggccaaagcgacgcgcgaggcccaaaagagagcugccgcuggcaucaugaaaaauccuacaguggacgggaugaccgucaucgaucuggacccgauucccuacgauccuaaguuugaaaagcagcucggacaggugaugcuucugguucugugcgugacacagguccucaugaugcggaccaccugggcccugugugaggcccuuacacuggcgacgggccccaucagcacccucugggaagggaacccuggacgcuucuggaauacaaccauugcugugucuauggccaacaucuuuagaggcuccuaucuggcuggggccggacuccuguucagcauuaugaaaaacacagccaauacccggcgcggcacgggcaacacaggggagacccuuggagagaaguggaaaaauagacugaacgcucugggcaagucugaauuucaaaucuacaaaaaguccgggauccaggagguugaccggacccucgccaaagaaggaauuaagcgcggcgagacagaucaucacgcggugagcagagggucugccaagcugcggugguucgucgagagaaaucuugugacccccgaaggaaaagugguugaccugggcugcggccgcgggggauggagcuauuacuguggcgggcucaagaacgucaaagaggugaagggacugacaaaaggcgggccgggacaugaagaaccuauccccauguccacguauggcuggaaucuggugcggcuccagucuggcgucgauguuuucuuuaccagccccgaaaagugcgacacacuucugugugauauuggggaguccagcccuaaccccaccguggaggcuggaagaacacugcgcgugcucaaucuggucgaaaacuggcuuaauaacaauacccaauucugcaucaaggugcugaacccuuacaugccguccguuauugagaaaauggaagcccuccagcggaaguacggcggggcucuggugagaaauccccugucucgcaacagcacgcacgagauguauugggucuccaacgccucuggaaauaucgugagcuccguuaacaugaucucucggaugcucauuaauagauuuaccaugcgccacaaaaaggcgacauacgaaccugacguggaucuuggcagcgggacccggaacaucggaauugaguccgagacacccaaucuggacaucauuggcaaaagaaucgaaaagaucaagcaggagcaugaaaccagcuggcacuaugaucaggaccauccuuacaaaacaugggccuaucacggcucuuacgagaccaagcaaacgggguccgcuagcucuauggucaacggaguggugcgccugcucacaaaacccugggacgucauuccgaugguuacccagauggccaugaccgauacaacgccuuucggccagcagcggguguuuaaggaaaaaguggacaccagaacacaagagcccaaggaggggaccaagaaacugaugaagaucacagcugaauggcuuuggaaagagcugggaaagaaaaagaccccucgcauguguacaagagaagaguucacccggaaaguccgcuccaaugccgcucucggcgccauuuuuacggaugagaacaaguggaaaagcgcgagagaagccguggaggacucuggguucugggaacugguugauaaagagcggaaucugcaccucgaaggaaagugcgagaccuguguguauaacaugaugggcaaaagagagaagaaacugggcgaauuugggaaggcuaagggaucccgggccaucugguacauguggcuuggcgcucgcuuccuggaguuugaagcccucggguuccugaaugaggaccauugguuuagcagagaaaacucccuuagcggagucgagggcgaggggcugcacaaacucggcuacauucugcgggaugugucuaagaaagaaggaggcgccauguaugcggacgauacagcugggugggacacccgcaucacacuggaggaucucaagaaugaagagaugguuaccaaccauauggaaggagagcacaaaaagcuggccgaggccauuuucaaacuuacguaccagaauaaaguggucagagugcagcggcccacaccucgcggcaccguuauggacaucaucagcagacgggaccagcgcggguccggacaaguggucacauauggccugaacaccuucacgaacauggaagcucagcucauuagacagauggagggggaaggcguguuuaagucuauccaacagcugaccgucaaagaggagauugccgugaagaauuggcuuauccggguuggacgcgaaagacugagccggauggcuauuuccggcgaugacugcguggucaaaccccucgaugaccgcuucgccucugcgcugacagcccugaacgauauggggaaggugagaaaggacauccagcagugggagccgagccggggauggaaugauuggacccaagugccuuuuugcucccaucacuuccacgaacucaucaugaaagacggcagaguucuggugguccccugucgcaaccaggaugagcuuauugggcgggcuagaaucucucagggagccggcuggagccugcgcgaaacagcuugccucgggaaguccuacgcccagauguggagccugauguauuuucaucggagagaccuucgccuggcggccaaugcuauuuguucugccgugcccucccacuggaucccuaccagccggacaaccuggucuauucaugcuacgcacgaguggaugacaaccgaggauaugcucaccguuuggaacagaguguggauccaagaaaauccguggauggaggacaaaacacccgucgaauccugggaggaaaucccuuaccugggcaagcgcgaggaucaguggugcggaagccugauuggccucaccucccgggccacaugggcuaaaaacauccagacggccauuaaucaggugagaucucugaucgggaacgaggaauauaccgacuacaugcccagcaugaagcgcuuccggagagaggaagaggaagcgggaguccuuugguga

SEQ ID NO: 19582 - RNA, 9876 nt, Artificial Sequence
  derived and/or modified CDS sequence (opt5) from DENV-2__KX380814__SS-prME
accgccggcaucauuaucaugaugauucccaccgugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuuagacaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaagaucagacccacguucgcggcuggacuucugcuccggaaacugacauccaaggagcucaugaugaccacaaucggcauugugcugcuuucucaaagcaccaucccugaguccauucuggaacucaccgaugcccuggcccuggggaugauggugcuuaaaaucguccgcaauauggagaaguaucagcuggcuguuacaauuauggccauccucugcgugcccaacgcggugauccugcagaaugcuuggaaagucucuuguacgacccucgccgugguuagcguguccccucugcuucugacaagcucucaacagaaggccgacuggauuccccucgcucugaccaucaagggacugaacccuacagccauuuuucuuaccacgcuguccagaacaagcaaaaagcggucuuggccccucaaugaagcuaucauggccgucggcaugguguccauucuggcgagcucucuccugaaaaacgauaucccgaugaccgggccucuuguugccggaggccugcugaccgugugcuacguccucacaggccgcuccgcugaccuggagcuugaaagagccgcugacgugcggugggaggagcaggccgaaaucagcggguccagccccauucugucuaucaccauuagcgaggauggauccaugucuaucaagaaugaagaggaggaacagacacucacgauucugauccgcaccggccuccuggucauuagcgggcuuuucccuguguccauccccaucacagccgcugcgugguaucugugggagguuaaaaagcaaagagccggagugcugugggacgucccgucuccucccccugugggcaaagcugaacucgaggauggggccuaccggauuaagcagaagggaauccugggcuauagccagauuggcgccgggguuuacaaagaaggaaccuuucacacaauguggcaugugacccgcggcgcuguccuuaugcacaaggggaaaagaaucgagcccuccugggccgacgugaagaaagaucugauuucuuacggaggcggguggaagcucgagggagaauggaaggagggcgaagaggugcagguucuggcgcucgaacccggcaaaaacccucgggcuguccaaacgaagccggggcuguucaaaaccaacacaggaaccaucggcgccgugagccuugacuuuucccccgggacaagcggaucuccuaucguggauaagaaaggcaaggucguggggcuguauggaaauggcguugugaccagauccggcacauacgucagcgccauugcucagacggagaagucuaucgaggacaaccccgaaauugaggaugacaucuuccgcaaaaagcggcugaccauuauggaucuccauccuggggccggaaaaacaaagagauaucugcccgcgaucgugcgcgaagcuaucaaacggggccuuagaacccugauucucgccccuacccgcguuguggccgcugagauggaagaggcccugcgggggcucccgaucagauaccagacacccgcuauucgcgccgagcacacgggacgggaaaucgucgaccugaugugucaugcgaccuucacaaugagacuucuguccccuauucgggugcccaauuauaaccugaucauuauggaugaggcccacuuuaccgacccugcuagcaucgccgcucgcggcuacaucuccacaagaguugaaaugggggaggccgccggcauuuucaugaccgcuacgcccccgggaucucgggacccuuuuccccagagcaaugcgcccaucauggaugaggaaaaggagauuccugaacgcuccuggaacagcggccacgagugggugacagacuucaaggggaaaaccgucugguuugugcccucuaucaaggccggaaaugauauugcugccugccuccgcaagaacggcaagaaagugauccaacugucccggaagaccuucgacagcgaauauaucaagacaagaaccaaugauugggacuuugucguuacaaccgauauuucugagaugggggccaacuucaaagcugagcgcgugaucgacccucggagauguaugaagccggugauucuuacggauggagaggaacgcgucauccuggccggccccaugccugugacacauagcuccgcggcucagcggagagggcgcguuggccggaaucccaaaaacgaaaaugaccaguacauuuacaugggagagccucucgaaaacgaugaggacugcgcccacuggaaggaggccaaaaugcugcuggacaauaucaacacccccgaaggcaucauuccgucuauguuugagccugaaagagagaagguggaugcuaucgacggggaauaucgccucagaggagaggcccggaaaacauucgucgaucuuaugcgcagaggcgaccugcccguguggcuggcguaccggguugccgcugaggggauuaacuaugccgaucgcagaugguguuuugacggagugaagaauaaccaaauccucgaagagaaugucgaaguggagauuuggaccaaggagggcgaacggaaaaagcugaaaccuagauggcuugaugcucgcaucuacagcgacccccuggcccucaaggaguucaaagaguucgcugccgggcggaagucccugacgcugaaccucauuaccgagaugggcagacuuccuacauuuaugacccagaaggcgaaaaaugcccuggauaaccuggcuguccuccauacagccgaagcuggaggccgcgccuauaaucacgcccugucugagcuucccgagacccuggaaacacuccugcugcucacccuucuggcuacggugacagggggaaucuuccuguuucucaugagcggcaaggggaucggaaaaaugacccugggcaugugcugcauuaucaccgcguccauucuucugugguacgcccagauccagccgcacuggauugcugccagcaucauccucgaguucuuucugauuguucugcucaucccugaacccgagaagcaacggacaccccaggacaaccagcuuaccuauguggugauugccauccugacagucguugcugccacgauggcgaaugaaaugggcuuccuggagaaaaccaagaaggauuuugggcucggaucuauuacaacccagcaaccugaguccaacauccuggacaucgaucuuagaccggccagcgcuuggacacuguacgccguggcuaccacguucauuacccccaugcuccggcauuccaucgaaaauucuagcgugaacgucucccugacagccauugcgaaucaggccaccgugcugaugggccucgggaaaggauggccucuuucuaagauggacaucggcguuccccugcuggcuauuggguguuacagccaggugaacccuaucacacucaccgccgcucugcuucugcucgucgcccacuaugcuauuaucggacccggccugcaggccaaagcgacgcgcgaggcccaaaagagagcugccgcuggcaucaugaaaaauccuacaguggacgggaugaccgucauugaucuggacccgauccccuacgauccuaaguuugaaaagcagcucggacaggugaugcuucugguucugugcgugacacagguccucaugaugcggaccaccugggcccugugugaggcccuuacacuggcgacgggccccauuuccacccucugggaagggaacccuggacgcuucuggaauacaaccaucgcugugagcauggccaacauuuuuagaggcucuuaucuggcuggggccggacuccuguucuccaucaugaaaaacacagccaauacccggcgcggcacgggcaacacaggggagacccuuggagagaaguggaaaaauagacugaacgcucugggcaagagcgaauuucaaaucuacaaaaagucugggauucaggagguugaccggacccucgccaaagaaggaaucaagcgcggcgagacagaucaucacgcgguguccagagggagcgccaagcugcggugguucgucgagagaaaucuugugacccccgaaggaaaagugguugaccugggcugcggccgcgggggauggucuuauuacuguggcgggcucaagaacgucaaagaggugaagggacugacaaaaggcgggccgggacaugaagaaccuauucccaugagcacguauggcuggaaucuggugcggcuccaguccggcgucgauguuuucuuuaccucucccgaaaagugcgacacacuucugugugauaucggggagagcuccccuaaccccaccguggaggcuggaagaacacugcgcgugcucaaucuggucgaaaacuggcuuaauaacaauacccaauucugcauuaaggugcugaacccuuacaugccgagcguuaucgagaaaauggaagcccuccagcggaaguacggcggggcucuggugagaaauccccugucccgcaacucuacgcacgagauguauugggucagcaacgccuccggaaauaucgugucuagcguuaacaugauuucccggaugcucaucaauagauuuaccaugcgccacaaaaaggcgacauacgaaccugacguggaucuuggcucugggacccggaacauuggaaucgagagcgagacacccaaucuggacauuaucggcaaaagaaucgaaaagauuaagcaggagcaugaaaccuccuggcacuaugaucaggaccauccuuacaaaacaugggccuaucacggcagcuacgagaccaagcaaacggggucugcuuccagcauggucaacggaguggugcgccugcucacaaaacccugggacgucaucccgaugguuacccagauggccaugaccgauacaacgccuuucggccagcagcggguguuuaaggaaaaaguggacaccagaacacaagagcccaaggaggggaccaagaaacugaugaagauuacagcugaauggcuuuggaaagagcugggaaagaaaaagaccccucgcauguguacaagagaagaguucacccggaaaguccgcucuaaugccgcucucggcgccaucuuuacggaugagaacaaguggaaguccgcgagagaagccguggaggacagcggguucugggaacugguugauaaagagcggaaucugcaccucgaaggaaagugcgagaccuguguguauaacaugaugggcaaaagagagaagaaacugggcgaauuugggaaggcuaagggaucucgggccauuugguacauguggcuuggcgcucgcuuccuggaguuugaagcccucggguuccugaaugaggaccauugguuuuccagagaaaacagccuuuccggagucgagggcgaggggcugcacaaacucggcuacauccugcgggaugugagcaagaaagaaggaggcgccauguaugcggacgauacagcugggugggacacccgcauuacacuggaggaucucaagaaugaagagaugguuaccaaccauauggaaggagagcacaaaaagcuggccgaggccaucuucaaacuuacguaccagaauaaaguggucagagugcagcggcccacaccucgcggcaccguuauggacaucauuucuagacgggaccagcgcgggagcggacaaguggucacauauggccugaacaccuucacgaacauggaagcucagcucaucagacagauggagggggaaggcguguuuaaguccauucaacagcugaccgucaaagaggagaucgccgugaagaauuggcuuauucggguuggacgcgaaagacugucucggauggcuaucagcggcgaugacugcguggucaaaccccucgaugaccgcuucgccuccgcgcugacagcccugaacgauauggggaaggugagaaaggacauccagcagugggagccgucucggggauggaaugauuggacccaagugccuuuuugcagccaucacuuccacgaacucauuaugaaagacggcagaguucuggugguccccugucgcaaccaggaugagcuuaucgggcgggcuagaauuucccagggagccggcuggucucugcgcgaaacagcuugccucggaaagagcuacgcccagauguggucccugauguauuuucaucggagagaccuucgccuggcggccaaugcuaucuguagcgccgugcccucucacuggauuccuaccucccggacaaccuggagcauccaugcuacgcacgaguggaugacaaccgaggauaugcucaccguuuggaacagaguguggauccaagaaaauccguggauggaggacaaaacacccgucgaaucuugggaggaaauuccuuaccugggcaagcgcgaggaucaguggugcggaucccugaucggccucaccagccgggccacaugggcuaaaaacauucagacggccaucaaucaggugagaucccugauugggaacgaggaauauaccgacuacaugcccucuaugaagcgcuuccggagagaggaagaggaagcgggaguccuuugguga

SEQ ID NO: 19583 - RNA, 9876 nt, Artificial Sequence
  derived and/or modified CDS sequence (opt5) from DENV-2__KX380807__SS-prME
acagccggcaucauuaucaugaugauucccacggugauggcuuuccaccugacgaccagaaauggggagccucauaugaucgugagccggcaggaaaagggcaagagccuccuguuuaagacagagaaugggguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggccccucaugucgggaugggacucgagacaagaaccgaaacguggaugucuagcgagggcgccuggaagcacgcucagcggaucgagauuugggugcugcgccaucccggcuucacaaucauggccgcuauucuggccuacaccaucgggacaaccuauuuucagagaguucucauuuucauccugcuuaccgcgguggccccuuccaugacaaugcggugcauuggaaucucuaaccgcgacuuugucgaaggcgugagcgggggauccuggguugauaucgugcuggagcacggcagcugugucacgaccauggcuaaaaauaagcccacacucgacuucgaacugauuaagaccgaggccaaacacccugcuacacuuagaaaguacugcaucgaagccaaacugaccaacacgacaaccgcgucucgguguccgacccagggggagcccucccucaaugaggaacaagauaagcgcuuugugugcaaacauagcaugguggacagaggauggggcaacggcugugggcuguucggaaagggcgggauugucacaugcgccauguuuaccugcaagaaaaauauggagggaaagaucguucagccugaaaaccuggaguauacaauugugaucacgccccacucuggcgaagagaaugcuguggggaacgauaccggaaaacauggcaaggagaucaaagucacaccucaguccagcauuaccgaagccgagcucacaggcuacgggaccgugacgauggaauguucuccccggaccggacuggacuucaaugagaugguucuucugcagauggaaaacaaggcuuggcucgugcaccgccaaugguuucuggaucuuccgcugccuuggcuccccggcgccgacacacagggguccaacuggauccagaaagagacccuggucacauucaagaauccucacgccaagaaacaggaugugguugugcugggaagccaagagggcgcuaugcauaccgcgcucacgggggccacagaaauucagauguccucuggcaaccugcuuuuuaccggacaccugaagugcagacuccggauggacaaacugcagcuuaagggcaugagcuauuccauguguacagggaaauucaaggucgugaaggagaucgcugaaacccaacauggaaccauugucaucagagugcaguacgagggcgacgggagccccugcaaaauccccuucgagauuauggaucuggaaaagcgccacguucucggacggcugaucacagugaauccuauugucacggagaaagacucuccggugaacaucgaagccgagcccccuuuuggcgauuccuacauuaucauugggguugaacccggccagcugaagcucagcugguucaaaaagggaucuagcaucggccagauguuugagaccacaaugagaggggccaagcgcauggcuauccugggagacaccgccugggauuucggcucccuugggggaguguuuacaucuauuggcaaagcgcugcaucaagucuucggggcuaucuauggcgccgccuuuagcggaguguccuggaccaugaagauucucaucggcgugguuauuacguggaucgggaugaauagccggucuacaucccugagcgucucucuggugcuugugggagucgugacccucuaccugggcguuauggugcaggcugacuccgggugugucgugagcuggaaaaacaaggagcugaaaugcggauccggcaucuucauuaccgauaauguucacacauggaccgaacaguauaaguuucagccugagucucccagcaagcucgccuccgcuauccaaaaagcccacgaagaggggauuuguggcaucagaucugugacacgccuggaaaaccuuauguggaagcagauuacgccggagcugaaucauauccucagcgagaacgaagucaaacugaccaucaugacaggagacauuaagggcaucaugcaggcggggaaacggucccugagaccucagcccaccgagcuuaaguacagcuggaaagccuggggaaaggcuaagaugcucucuacagaacugcacaaucauaccuuccugauugauggcccugagacggccgaaugccccaacaccaaucgcgcuuggaacucccucgagguggaggacuauggguuuggaguuuucacaaccaauaucuggcugaaacuuaaggaacggcaagauguguuuugugacagcaaacugaugucugccgcgauuaaggacaacagagccguccacgcugauaugggcuacuggaucgaguccgcccucaacgacacauggaaaaucgaaaaggcuagcuucauugaggugaagucuugccacuggccuaaaagccauacccugugguccaauggcgugcuggagagcgaaaugaucauucccaagaacuucgccgggccggucucucagcacaauuaucgcccuggauaccauacacagaccgccggccccuggcaccuugggcggcucgagauggauuuugacuucugugaaggaacgacaguuguggugaccgaggauugcggcaacagagggcccucccugcggaccacaaccgcuagcggaaaacugaucacggaauggugcugucgcuccugcacacucccuccgcugagauaccggggcgaggacggcuguugguaugggauggagauuagaccccuuaaggaaaaagaggaaaaucuggucaacucucucgugaccgcgggacauggccagaucgauaauuuuagccuggggguucugggaauggcccuuuuccucgaggaaaugcugcgcacacgggugggcaccaagcacgcuauucugcucgucgccguguccuuuguuacacugaucaccgggaacaugucuuucagagaccuuggacgcgugauggucauggugggcgccacgaugaccgauaauaucggcauggggguuacauaccuggcucuccuggccgcguuuaaggugagaccuaccuucgcugccggacugcuucugcggaaacucacaagcaaggagcugaugaugaccacgauuggcaucguccuccugucccaaucuacaauucccgagaccauccuugaacugacagacgcccucgcucuggggaugauggugcugaaaauugugcgcaacauggagaaguaucagcuugccgucaccaucauggcgauccugugcguuccuaaugcugugauucuccagaacgccuggaaagugagcuguaccauccuggccgucguguccguuagcccccuccugcuuacaucuucccaacagaaggcugauuggauuccucuggcccucacgaucaagggacugaaucccaccgcuauuuuucugacaacccuuagcagaacaucuaaaaagcgguccuggccgcugaacgaagccaucauggcggugggcauggucagcauccucgccucuucccugcucaaaaaugacauuccuaugaccgggccccugguggcuggaggccuucugacgguuugcuacgugcugacaggccgcagcgccgaucucgagcuggaaagagcugccgacguccggugggaggagcaggccgaaaucuccgggagcucuccuauucuuagcaucaccauuuccgaggacggaucuaugagcaucaagaacgaagaggaggaacagacccugacaauucucauccgcaccggccugcucgugaucuccgggcuguuccccgucucuauuccgaucacagcugcggccugguaucuuugggaggugaaaaagcaaagagcuggaguucugugggaugugccuucucccccucccgucggcaaagccgaacuggaggacggggccuaccggauuaagcagaagggaauccucggcuauucccagauuggcgcugggguguacaaagaaggaacguuucacaccauguggcauguuacacgcggcgccgugcugaugcacaaggggaaaagaaucgagcccuccugggcggaugucaagaaagaccuuaucagcuacggaggcggguggaagcuggagggagaauggaaggagggcgaagagguccaggugcucgcucuggaaccuggcaaaaacccgcgggccguucaaaccaagcccggacuguucaaaacaaauaccggaacgauuggcgccgucucccuggauuuuagcccugggaccucuggaucccccaucguggacaagaaaggcaagguggucgggcuuuauggaaacggcgugguuacaagaagcggcaccuacgugucugcuauugcccagacagagaaguccaucgaggauaauccugaaauugaggacgauaucuuccgcaaaaagcggcugaccaucauggaccugcaucccggggcgggaaaaacaaagagauaucucccugcuauuguccgcgaagccaucaaacggggccugagaacgcuuauucuggccccgacccgcgugguugcugccgagauggaagaggcucuccgggggcugcccaucagauaccagaccccugccauucgcgcggagcacaccggacgggaaaucguggaucucaugugucaugccaccuucacaaugagacugcuuagccccauucgggucccuaacuauaaucugaucaucauggacgaggcucacuuuacggaucccgccuccauugcugcccgcggcuacaucucuaccagaguggaaaugggggaggccgcuggcauuuucaugacagcgaccccgccuggaagccgggaccccuuuccccaguccaacgccccuaucauggacgaggaacgcgagauucccgaaagaagcuggaacucuggccacgaguggguuacagauuucaaggggaagaccgugugguuugucccuuccaucaaagcuggaaacgacaucgccgccugccugcggaagaauggcaaaaaggugauucaacucagcagaaaaacguucgauucugaauauaucaagacacgcaccaacgacugggauuuuguggucaccacagacauuagcgagaugggggcuaauuucaaggccgagcggguuaucgauccgagacgcuguaugaaacccgugauucugaccgacggagaagaacgggugauccuugcgggcccuaugcccgucacacauuccucugcugcccagagacgcgggcgggugggcagaaacccuaagaaugaaaacgaucaguacaucuacaugggagagccccuggaaaaugacgaggauugcgcccacuggaaagaggcuaagaugcuccuggacaacauuaacaccccggaaggcaucauuccuagcauguuugagcccgaacgcgagaaaguugacgccguggauggggaauauagacugcggggagaggcgcgcaagacguucgucgaccucaugagacggggcgaucuuccuguguggcuggccuacaaaguugcugccgaggggaucaauuaugcugaccgcagaugguguuuugauggagugaagaacaaucaaauucuggaagagaacgucgaaguggagaucuggacaaaggagggcgaacggaaaaagcucaaacccagauggcuggacgcccgcauuuacuccgauccucuugcucugaaggaguucaaagaguucgccgcggggcggaagucucucacccugaaucugaucacagagaugggcagacuccccaccuuuaugacgcagaaggcccgcaacgcucuugacaaucuggccguccugcauaccgcugaagccggaggccgggccuauaaccacgcucucagcgagcugccggagacacuugaaacccugcuccugcugacacuccuugcgaccgugacagggggaaucuuccuguuucugauguccggcaaagggauuggaaagaugacccucggcaugugcugcaucauuacggccagcauccugcuuugguacgcucagauucagccucacuggaucgccgccucuaucauucuggaguucuuucucaucguucugcugauucccgaacccgagaaacaaagaacaccucaggauaaucagcucaccuauguggugaucgcuauucuuaccgucguugccgcgacaauggccaacgaaaugggcuuccuggagaagaccaaaaaggacuuugggcugggauccaucacaacgcagcaaccggagagcaauauccucgauauugaccugcggcccgcuuccgccuggacccuuuacgcuguggccacaaccuucaucacaccuaugcugcgccauucuauugaaaacagcuccgugaaugucucucucaccgcgaucgccaaccaggcuacggugcugaugggccuggggaagggauggccccucagcaaaauggauauuggcguuccucuucuggccaucggguguuacucccaggugaaucccauuacccugacagcugcccuccugcuucuggucgcucacuaugccaucaucggaccuggccuccaggcgaaggccaccagagaggcucaaaaacggacagccgcuggcauuaugaagaucccggccgcccugauugugaccgucaucgaccuggaccccauuccuuacgaucccaaauuugaaaagcagcucggacaggugaugcuucugguucugugcagcacacaggugcucaugaugcgcacaaccugggcgcugugugaggcucuuacacuggccaccggaccuaucucuacccucugggaaggcaaccccgggagauucuggaauacaacgaucgcugucuccauggccaacauuuuucggggaagcuaucuggccggcgcugggcuccucuucucuaucaugaagaacaccgccaauacacgcagaggaaccggcaacacaggcgagacccuuggggagaaauggaagaaucggcugaacgcgcugggaaaauccgaauuucaaauuuacaagaaaagcggcauccaggagguggaccgcacgcucgccaaggaagggauuaaaagaggagagacagaucaucacgcuguuucucggggcagcgccaagcugagaugguucguggagcgcaaucuugucaccccggaagggaaggugguggaccugggaugcggccggggcgggugguccuauuacuguggaggccucaaaaacguuaaggaggucaaagggcugaccaagggaggcccugggcaugaagaacccauccccaugucuacauauggauggaaucuggugagacuccagagcggcguggaugucuucuuuaccccucccgaaaaaugcgacacacuucugugugauaucggcgaguccagcccuaacccgacgguugaggcugggcgcacccugcgggugcucacacugguggaaaauuggcuuaacaauaacacccaauucugcauuaagguccugaaucccuacaugccuuccgugaucgagaagauggaagcccuccagagaaaauacggaggcgcgcugguucgcaacccccugucucggaauagcacacacgagauguauuggguguccaacgccucugggaacauugucagcuccgugaauaugaucucuagaaugcucauuaaccgcuuuaccaugcggcacaagaaagcuacguacgaaccugacguugaucuuggaagcggcaccagaaauaucgggaucgaguccgagacacccaaccuggacauuaucggaaagcgcauugagaagaucaagcaggagcaugaaaccagcuggcacuaugaucaggaccauccguacaagacaugggccuaucacggcucuuacgagaccaaacaaacaggcuccgcuagcucuauggugaauggggucgugcggcugcucaccaagccuugggaugugauucccauggucacgcagauggccaugacagacaccaccccuuucggacagcagagaguuuuuaaagaaaagguggacacacgcacgcaagagcccaaagagggcaccaagaagcugaugaaaaucacagcugaauggcuuuggaaggagcuggggaaaaagaaaaccccuagaauguguacacgggaagaguucacccgcaaggugagauccaacgccgcgcucggagccauuuuuacagaugagaauaaauggaaaagcgcucgggaagccgucgaggacucuggcuucugggaacugguggauaaggagagaaaccugcaccucgaagggaaaugcgagaccuguguuuauaauaugaugggaaagcgggagaaaaagcugggcgaauuuggcaaagcuaaggggucccgcgccaucugguacauguggcuuggagccagauuccuggaguuugaagcgcucggcuuccugaacgaggaccauugguuuagccgggaaaauucccuuagcgggguggagggagagggccugcacaagcucggguacauccugcgcgaugucucuaaaaaggaaggcggagcuauguaugccgacgauacggccggcugggacaccagaauuacacuggaggaucucaaaaacgaagagauggugaccaaucauauggaaggggagcacaagaaacuggcugaggccaucuucaaacuuacauaccagaacaagguugugcggguccagcgccccaccccgagaggaacggugauggacauuaucagccggcgcgaucagagaggcuccgggcaaguugugacauauggacugaauaccuucacaaacauggaagcucagcucauucggcagauggagggcgaaggggucuuuaaaucuauccaacagcugaccgccacggaggagaucgcggugaagaacuggcuuguccgcgugggcagagaacggcugagccgcauggccauuuccggagacgacugcguugugaaaccucucgaugacagauucgcuucugcccugaccgcucugaaugauaugggcaagguccggaaagacauccagcagugggagcccagcagaggguggaacgauuggacacaagugcccuuuugcucccaucacuuccacgaacucauuaugaaggacggacgcgugcugguugugccuugucggaaucaggaugagcuuaucggcagagcccgcauuucucagggggcgggauggagccugcgggaaaccgccugccucggcaaguccuacgcucagauguggagccugauguauuuucauagacgcgaccuucggcuggccgcuaacgccaucuguucugcugucccgucccacugggugcccacaagcagaaccacauggucuauccaugccacccacgaguggaugacgacagaggauaugcucaccguuuggaaucgcguguggauucaagaaaacccuuggauggaggacaaaacccccgucgaauccugggaggaaaucccuuaccuggggaagcgggaggaucaguggugcggcagccugauuggacucacauccagagcgaccugggccaaaaauauccagacagcuauuaaccaggugcgcucucugaucggcaaugaggaauauacggacuacaugcccagcaugaagcgguucagacgggaggaagaggaagccgggguccuuugguga

SEQ ID NO: 19584 - RNA, 9876 nt, Artificial Sequence
  derived and/or modified CDS sequence (opt5) from DENV-2__KX380815__SS-prME
accgccggaaucauuaucaugaugauucccacagugauggcuuuccaccugacgaccagaaacggggagccucauaugaucgugagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguaugggaccuguacagcgaccggcgagcacagacgggaaaaacgcuccguggcucuggucccucauguggggauggggcucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucacagagaacgaagugaaacugaccaucaugacaggagacaucaagggcauuaugcaggccgggaaacggagccugagaccucagcccaccgagcuuaaguacuccuggaaagcguggggaaaggccaagaugcucagcacggaacugcacaaucauaccuuccugaucgauggcccugagacagcugaaugccccaacaccaaucgcgccuggaacucucucgagguugaggacuauggguuuggaguguucacaaccaauauuuggcugaaacuuaaggaacggcaagaugucuccugugacagcaaacugaugucugcugccaucaaggacaacagagcggugcacgccgauaugggcuacuggauugaguccgcucucaacgacacauggaaaaucgaaaaggccagcuuuaucgaggugaagucuugccacuggccuaaaagccauacccugugguccaauggcguccuggagagcgaaaugauuauccccaagaacuucgcugggccgguuucucagcacaauuaucgcccuggauaccauacgcagacagccggccccuggcaccuugggcggcucgagauggauuucgacuuuugugaaggaaccaccgugguggucacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggugaacucucucguuaccgcuggacauggccagauugauaauuucagccugggggugcugggaauggcgcuuuuucucgaggaaaugcugcgcacacgggucggcaccaagcacgccauccugcucguggcuguuuccuucgugacgcugauuaccgggaacaugucuuuuagagaccuuggacgcgucauggugaugguuggcgccacaaugaccgaugacaucggcaugggggugacauaccuggcccuccuggcugccuucaaggucagaccuaccuuugcggcuggacugcuucugcggaaacucacgagcaaggagcugaugaugacaaccaucggcauugugcuccugucccaaucuacaauccccgagaccauucuugaacugaccgaugcccucgcccuggggaugauggugcugaaaaucguccgcaauauggagaaguaucagcuugcuguuacaauuauggccauccugugcgugccuaacgcggugauccuccagaaugcuuggaaagucagcuguacgacccuggccgugguuuccgugagcccccuccugcuuacaucuucccaacagaagaccgacuggauuccucuggcccucacaaucaagggacugaaccccaccgcuauuuuccugacgacacuuagcagaaccucuaaaaagcgguccuggccgcugaaugaagccaucauggcugucggcauggugagcauucucgccucuuccuuucugaaaaacgauaucccuaugaccgggccccucguugcgggaggccugcuuacagugugcuacguccugaccggccgcagcgccgaccuggagcucgaaagagcugccgacauccggugggaggagcaggcugaaauuuccgggagcucuccuauccugagcauuacaaucuccgaggauggaucuaugagcauuaagaaugaagaggaggaacagacgcuuaccauccugauucgcacaggccuccuggugaucuccggacucuuccccgucucuaucccgauuaccgccgccgcuugguaucugugggaggugaaaaagcaaagagcgggaguucuuugggacgugccuucucccccucccgucggcaaagccgaacuggaggauggggcuuaccggaucaagcagaagggcauucugggcuauucccagaucggcgccgggguguacaaagaaggaacauuucacaccauguggcauguuacgcgcggcgccgugcucaugcacaaggggaaaagaauugagcccuccugggcugacgucaagaaagaucugaucagcuacggaggcggguggaaacuugagggagaauggaaggagggcgaagagguccaggugcuggcccucgaaccuggcaaaaacccgcgggcgguucaaaccaagcccgggcuguucaaaacaaacaccggaacaaucggcgcugucucccucgacuuuagcccugggaccucuggaucccccauuguggauaagaaaggcaagguggucgggcuguauggaaauggcgugguuacaagaagcggcacguacgugucugccaucgcccagaccgagaagaacauugaggacaauccugaaaucgaggaugacauuuuccgcaaaaagcggcuuacaaucauggaucugcaucccggggcuggaaaaaccaagagauaucugccugccaucguccgcgaagcgauuaaacggggccucagaacccugauccuugcuccgacacgcgugguugccgccgagauggaagaggcucugcgggggcuccccauuagauaccagacgccugccauccgcgcugagcacaccggacgggaaauuguggaccugaugugucaugccacauucaccaugagacuccugucccccauccgggucccuaacuauaaucuuauuaucauggaugaggcgcacuuuacagaccccgccagcaucgcugcccgcggcuacauuuccaccagaguggaaaugggggaggcugccggcaucuucaugacggccacaccgccuggaucucgggaccccuuuccccagagcaacgcuccuauuauggaugaggaacgcgagauccccgaaagauccuggaauagcggccacgaguggguuaccgacuucaaggggaagaccgugugguuugucccuucuauuaaagcgggaaacgauaucgccgcuugccugcggaagaauggcaaaaaggugauccaacuguccagaaaaacauucgacagcgaauaugugaagacccgcacaaacgauugggacuuugucguuaccacggauauuucugagaugggggccaauuucaaggccgagcgggugaucgacccgagacgcuguaugaaacccgugauucucacagauggagaagaacgggucauccuggcuggcccuaugcccgugacccauagcuccgccgcgcagagacgcgggcggguuggcagaaacccuaagaaugaaaacgaccaguacauuuacaugggagagccccuugaaaaugaugaggacugcgcucacuggaaagaggccaagaugcugcucgacaacaucaacacaccggaaggcaucauuccuucuauguuugagcccgaacgcgagaaaguggaugccaucgacggggaauauagacugcggggagaggcucgcaagaccuucgucgaucugaugagacggggcgaccucccuguguggcuugccuaccgcguugcggccgaggggauuaauuaugcugauagacggugguguuuugacggagugaaaaacaaucaaauccuggaagagaacgucgaaguggagauuuggacgaaggagggcgaaagaaagaaacugaagccccgcuggcucgaugcccggaucuacagcgacccucuggcucuuaaagaguucaaggaguucgccgcugggagaaaaucccugacccucaaucugauuacagagaugggccgccugcccaccuuuaugacacagaaggcccggaacgcgcucgauaaucuugccguccugcauaccgcugaagccggaggcagagcuuauaaccacgcccugucugagcucccggagacacuggaaacccuucugcuccugacgcugcucgccacagugaccgggggaaucuuccuuuuucugaugagcggcaaggggaucggaaaaaugacccugggcaugugcugcauuguuacagcuuccauccuccugugguacgcgcagauucagccucacuggaucgccgcuagcauuauccuugaguucuuucugaucgugcuccugauucccgaacccgagaagcaacggaccccucaggacaaucagcugacauauguggucaucgccauucucacgguuguggccgcuaccauggccaacgaaaugggcuuccuugagaaaacaaagaaagauuuugggcugggaucuaucaccacacagcaaccggaguccaauauucuggacaucgaucuccgccccgcgagcgccuggacccuguacgcuguggccacgaccuucaucacaccuaugcuuagacauuccauugaaaacucuagcgucaaugugucccugaccgcuaucgccaaccaggcgacaguucucaugggccuggggaagggauggccccugucuaagauggacauuggcgugccucuccuugccaucggguguuacagccaggucaaucccauuacccugacggcugcccugcuccugcuuguggcucacuaugccaucauuggaccuggccugcaggcuaaagccacacgggaggcgcaaaagcgcgccgcugccggcaucaugaaaaucccggcugcccucauuaugaccgucaucgaccuggaucccauuccuuacgaccccaaguuugaaaaacagcugggacaggugaugcuccuuguucugugcuccacacaggugcugaugaugagaaccaccugggcccucugugaggcgcugacacuugcuacgggaccuaucagcacccugugggaaggcaaccccgggcgguucuggaauacaaccauugccgucucuauggcuaacaucuuucgcggauccuaucucgccggcgccgggcugcuguucagcaucaugaagaacacagcuaauaccagacggggaacgggcaacacaggcgagacccucggggagaaguggaaaaaucaacuuaacgcccugggaaagucugaauuucagauuuacaaaaaguccggcauccaggagguggaucgcacccuggcgaaagaagggauuaagagaggagagacagaccaucacgccguuagccggggcucugcuaaacucagaugguucguggagcgcaaucuggucaccccggaagggaaggugguggaucuuggaugcggccggggcggguggagcuauuacuguggaggccugaagaacguuaaagaggucaaggggcucacaaaaggaggcccugggcaugaggaacccauccccauguccacguauggauggaaucuggugagacugcaaucuggcguggacgucuucuuuaccccucccgaaaagugcgauacacuccuuugugacauuggcgagagcuccccuaacccgaccguugaggccgggcgcacacugcgggugcugaaucucguggaaaacuggcugaauaacaauacccaguucugcaucaaaguccuuaaccccuacaugccuagcgugaucgagaagauggaagcucugcagagaaaguacggaggcgcccucguucgcaauccccugucccggaacucuacgcacgagauguauugggugagcaacgcguccgggaauauugucucuagcgugaacaugaucuccagaaugcugauuaaucgcuuuaccaugcggcacaaaaaggccacauacgaaccugauguugaccucggaucuggcaccagaaacaucgggauugagagcgaggugcccaaucuugauaucaucggaaaacgcauugaaaagaucaaacaggagcaugaaacauccuggcacuaugaccaagaucauccguacaagaccugggcuuaucacggcagcuacgagacaaagcagaccggcucugccuccagcauggucaacgggguggugcggcugcugacgaaaccuugggacgucauucccaugguuacacagauggcuaugaccgacaccacaccuuucggacagcaaagaguguuuaaggaaaaaguggauacgcgcacccaggagcccaaggagggcaccaagaagcucaugaagaucaccgccgaauggcuguggaaagagcuugggaagaaaaagacaccuagaauguguacccgggaagaguucacacgcaaagucagaucuaaugcugcccugggagcgauuuuuaccgacgagaacaaguggaaauccgcccgggaagcuguggaggauagcggcuucugggaacucguugacaaggagagaaaucugcaccuggaagggaagugcgagacguguguguauaacaugaugggaaaacgggagaagaaacucggcgaauuuggcaaggccaaagggucucgcgcuaucugguacauguggcugggagccagauuccuugaguuugaagcccugggcuuccucaaugaggaucauugguuuucccgggaaaacagccuguccggggucgagggagagggccuucacaagcugggguacauucuccgcgacgugagcaagaaagaaggcggagcgauguaugcugaugacaccgccggcugggauacaagaaucacccuggaggaccugaagaaugaagagaugguuacaaaccauauggaaggggagcacaaaaagcucgccgaggcuaucuuccggcugaccuaccagaauaaagugguccgcgugcagagacccacgccgcggggaacaguuauggauauuaucucucgcagagaccaacggggcagcggacagguggucaccuauggacuuaacacauucaccaacauggaagcccagcugauucgccaaauggagggcgaagggguguuuaaguccauccagcaucucacggcuaccgaggagauugccgucaagaauuggcuggugagaguuggccgggaacgccuuucuagaauggcgaucagcggagacgauugcguggucaaaccucuggacgaucgguucgccaacgcucucacagcccugaaugacaugggcaaggugagaaaagauauccagcagugggagcccucccgcggguggaacgacuggacccaagugcccuuuugcucucaccacuuccaugaacugauuaugaaggauggacggguucucguggucccuuguagaaaucaggacgagcugaucggccgcgcucggauuagccagggggccggauggucccuuagagaaacagcgugccugggcaaaucuuacgcccagauguggagccucauguauuuucaccgccgggaucugagacuugcugccaacgcuaucuguuccgccgugccgagccauuggguucccaccucucgcacaaccugguccauucacgcuacgcacgaguggaugacaaccgaggacaugcugaccguguggaaucgggucuggauccaagaaaacccuuggauggaggauaagacacccguggaaagcugggaggaaaucccuuaccucgggaagagagaggaccaguggugcggcucucugauuggacugaccucccgcgccacaugggcgaaaaauauccagacggccauuaaccagguccggagccucaucggcaaugaggaauauaccgauuacaugcccuccaugaagagauuccggagagaggaagaggaagcuggggugcugugguga

SEQ ID NO: 19585 - RNA, 9876 nt, Artificial Sequence
  derived and/or modified CDS sequence (opt5) from DENV-2__KX380816__SS-prME
accgccggcaucauuaucaugaugauucccaccgugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuuagacaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaagaucagacccacguucgcggcuggacuucugcuccggaaacugacauccaaggagcucaugaugaccacaaucggcauugugcugcuuucucaaagcaccaucccugaguccauucuggaacucaccgaugcccuggcccuggggaugauggugcuuaaaaucguccgcaauauggagaaguaucagcuggcuguuacaauuauggccauccucugcgugcccaacgcggugauccugcagaaugcuuggaaagucucuuguacgacccucgccgugguuagcguguccccucugcuucugacaagcucucaacagaaggccgacuggauuccccucgcucugaccaucaagggacugaacccuacagccauuuuucuuaccacgcuguccagaacaagcaaaaagcggucuuggccccucaaugaagcuaucauggccgucggcaugguguccauucuggcgagcucucuccugaaaaacgauaucccgaugaccgggccucuuguugccggaggccugcugaccgugugcuacguccucacaggccgcuccgcugaccuggagcuugaaagagccgcugacgugcggugggaggagcaggccgaaaucagcggguccagccccauucugucuaucaccauuagcgaggauggauccaugucuaucaagaaugaagaggaggaacagacacucacgauucugauccgcaccggccuccuggucauuagcgggcuuuucccuguguccauccccaucacagccgcugcgugguaucugugggagguuaaaaagcaaagagccggagugcugugggacgucccgucuccucccccugugggcaaagcugaacucgaggauggggccuaccggauuaagcagaagggaauccugggcuauagccagauuggcgccgggguuuacaaagaaggaaccuuucacacaauguggcaugugacccgcggcgcuguccuuaugcacaaggggaaaagaaucgagcccuccugggccgacgugaagaaagaucugauuucuuacggaggcggguggaagcucgagggagaauggaaggagggcgaagaggugcagguucuggcgcucgaacccggcaaaaacccucgggcuguccaaacgaagccggggcuguucaaaaccaacacaggaaccaucggcgccgugagccuugacuuuucccccgggacaagcggaucuccuaucguggauaagaaaggcaaggucguggggcuguauggaaauggcguugugaccagauccggcacauacgucagcgccauugcucagacggagaagucuaucgaggacaaccccgaaauugaggaugacaucuuccgcaaaaagcggcugaccauuauggaucuccauccuggggccggaaaaacaaagagauaucugcccgcgaucgugcgcgaagcuaucaaacggggccuuagaacccugauucucgccccuacccgcguuguggccgcugagauggaagaggcccugcgggggcucccgaucagauaccagacacccgcuauucgcgccgagcacacgggacgggaaaucgucgaccugaugugucaugcgaccuucacaaugagacuucuguccccuauucgggugcccaauuauaaccugaucauuauggaugaggcccacuuuaccgacccugcuagcaucgccgcucgcggcuacaucuccacaagaguugaaaugggggaggccgccggcauuuucaugaccgcuacgcccccgggaucucgggacccuuuuccccagagcaaugcgcccaucauggaugaggaaaaggagauuccugaacgcuccuggaacagcggccacgagugggugacagacuucaaggggaaaaccgucugguuugugcccucuaucaaggccggaaaugauauugcugccugccuccgcaagaacggcaagaaagugauccaacugucccggaagaccuucgacagcgaauauaucaagacaagaaccaaugauugggacuuugucguuacaaccgauauuucugagaugggggccaacuucaaagcugagcgcgugaucgacccucggagauguaugaagccggugauucuuacggauggagaggaacgcgucauccuggccggccccaugccugugacacauagcuccgcggcucagcggagagggcgcguuggccggaaucccaaaaacgaaaaugaccaguacauuuacaugggagagccucucgaaaacgaugaggacugcgcccacuggaaggaggccaaaaugcugcuggacaauaucaacacccccgaaggcaucauuccgucuauguuugagccugaaagagagaagguggaugcuaucgacggggaauaucgccucagaggagaggcccggaaaacauucgucgaucuuaugcgcagaggcgaccugcccguguggcuggcguaccggguugccgcugaggggauuaacuaugccgaucgcagaugguguuuugacggagugaagaauaaccaaauccucgaagagaaugucgaaguggagauuuggaccaaggagggcgaacggaaaaagcugaaaccuagauggcuugaugcucgcaucuacagcgacccccuggcccucaaggaguucaaagaguucgcugccgggcggaagucccugacgcugaaccucauuaccgagaugggcagacuuccuacauuuaugacccagaaggcgaaaaaugcccuggauaaccuggcuguccuccauacagccgaagcuggaggccgcgccuauaaucacgcccugucugagcuucccgagacccuggaaacacuccugcugcucacccuucuggcuacggugacagggggaaucuuccuguuucucaugagcggcaaggggaucggaaaaaugacccugggcaugugcugcauuaucaccgcguccauucuucuguggcacgcccagauccagccgcauuggauugcugccagcaucauccucgaguucuuucugauuguucugcucaucccugaacccgagaagcaacggacaccccaggacaaccagcuuaccuacguggugauugccauccugacagucguugcugccacgauggcgaaugaaaugggcuuccuggagaaaaccaagaaggauuuugggcucggaucuauuacaacccagcaaccugaguccaacauccuggacaucgaucuuagaccggccagcgcuuggacacuguaugccguggcuaccacguucauuacccccaugcuccggcacuccaucgaaaauucuagcgugaacgucucccugacagccauugcgaaucaggccaccgugcugaugggccucgggaaaggauggccucuuucuaagauggacaucggcguuccccugcuggcuauuggguguuacagccaggugaacccuaucacacucaccgccgcucugcuucugcucgucgcccauuacgcuauuaucggacccggccugcaggccaaagcgacgcgcgaggcccaaaagagagcugccgcuggcaucaugaaaaauccuacaguggacgggaugaccgucauugaucuggacccgauccccuaugauccuaaguuugaaaagcagcucggacaggugaugcuucugguucugugcgugacacagguccucaugaugcggaccaccugggcccugugugaggcccuuacacuggcgacgggccccauuuccacccucugggaagggaacccuggacgcuucuggaauacaaccaucgcugugagcauggccaacauuuuuagaggcucuuaccuggcuggggccggacuccuguucuccaucaugaaaaacacagccaauacccggcgcggcacgggcaacacaggggagacccuuggagagaaguggaaaaauagacugaacgcucugggcaagagcgaauuucaaaucuauaaaaagucugggauucaggagguugaccggacccucgccaaagaaggaaucaagcgcggcgagacagaucaccaugcgguguccagagggagcgccaagcugcggugguucgucgagagaaaucuugugacccccgaaggaaaagugguugaccugggcugcggccgcgggggauggucuuacuauuguggcgggcucaagaacgucaaagaggugaagggacugacaaaaggcgggccgggacacgaagaaccuauucccaugagcacguacggcuggaaucuggugcggcuccaguccggcgucgauguuuucuuuaccucucccgaaaagugcgacacacuucugugugauaucggggagagcuccccuaaccccaccguggaggcuggaagaacacugcgcgugcucaaucuggucgaaaacuggcuuaauaacaauacccaauucugcauuaaggugcugaacccuuauaugccgagcguuaucgagaaaauggaagcccuccagcggaaguacggcggggcucuggugagaaauccccugucccgcaacucuacgcacgagauguacugggucagcaacgccuccggaaauaucgugucuagcguuaacaugauuucccggaugcucaucaauagauuuaccaugcgccauaaaaaggcgacauaugaaccugacguggaucuuggcucugggacccggaacauuggaaucgagagcgagacacccaaucuggacauuaucggcaaaagaaucgaaaagauuaagcaggagcacgaaaccuccuggcauuacgaucaggaccacccuuauaaaacaugggccuaccacggcagcuaugagaccaagcaaacggggucugcuuccagcauggucaacggaguggugcgccugcucacaaaacccugggacgucaucccgaugguuacccagauggccaugaccgauacaacgccuuucggccagcagcggguguuuaaggaaaaaguggacaccagaacacaagagcccaaggaggggaccaagaaacugaugaagauuacagcugaauggcuuuggaaagagcugggaaagaaaaagaccccucgcauguguacaagagaagaguucacccggaaaguccgcucuaaugccgcucucggcgccaucuuuacggaugagaacaaguggaaguccgcgagagaagccguggaggacagcggguucugggaacugguugauaaagagcggaaucugcaucucgaaggaaagugcgagaccuguguguacaacaugaugggcaaaagagagaagaaacugggcgaauuugggaaggcuaagggaucucgggccauuugguauauguggcuuggcgcucgcuuccuggaguuugaagcccucggguuccugaaugaggaccacugguuuuccagagaaaacagccuuuccggagucgagggcgaggggcugcauaaacucggcuacauccugcgggaugugagcaagaaagaaggaggcgccauguacgcggacgauacagcugggugggacacccgcauuacacuggaggaucucaagaaugaagagaugguuaccaaccacauggaaggagagcauaaaaagcuggccgaggccaucuucaaacuuacguaucagaauaaaguggucagagugcagcggcccacaccucgcggcaccguuauggacaucauuucuagacgggaccagcgcgggagcggacaaguggucacauacggccugaacaccuucacgaacauggaagcucagcucaucagacagauggagggggaaggcguguuuaaguccauucaacagcugaccgucaaagaggagaucgccgugaagaauuggcuuauucggguuggacgcgaaagacugucucggauggcuaucagcggcgaugacugcguggucaaaccccucgaugaccgcuucgccuccgcgcugacagcccugaacgauauggggaaggugagaaaggacauccagcagugggagccgucucggggauggaaugauuggacccaagugccuuuuugcagccaccacuuccaugaacucauuaugaaagacggcagaguucuggugguccccugucgcaaccaggaugagcuuaucgggcgggcuagaauuucccagggagccggcuggucucugcgcgaaacagcuugccucggaaagagcuaugcccagauguggucccugauguacuuucaccggagagaccuucgccuggcggccaaugcuaucuguagcgccgugcccucucauuggauuccuaccucccggacaaccuggagcauccacgcuacgcacgaguggaugacaaccgaggauaugcucaccguuuggaacagaguguggauccaagaaaauccguggauggaggacaaaacacccgucgaaucuugggaggaaauuccuuaucugggcaagcgcgaggaucaguggugcggaucccugaucggccucaccagccgggccacaugggcuaaaaacauucagacggccaucaaucaggugagaucccugauugggaacgaggaauacaccgacuauaugcccucuaugaagcgcuuccggagagaggaagaggaagcgggaguccuuugguga

SEQ ID NO: 19586 - RNA, 9876 nt, Artificial Sequence
  derived and/or modified CDS sequence (opt5) from DENV-2__KX380817__SS-prME
accgccggaaucauuaucaugaugauucccaccgugauggcuuuccaccugacgaccagaaacggggagccucauaugaucgugagccggcaggaaaagggaaaaucccuccuguuuaagaccgagaauggcguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaaucacaccccaguccagcaucacagaagcugagcugaccggcuacgggacgguuaccauggaauguucuccucggacaggacuugacuucaaugagauggugcugcuccagauggaaaacaaggccuggcugguccaccgccaaugguuucuugaucugccccucccguggcugccuggcgcugacacccagggguccaacuggauucagaaagagacacuggugaccuucaagaauccccacgccaagaaacaggauguugugguccucggaagccaagagggcgccaugcauacggcucugacaggggcgaccgaaauccagauguccucuggcaaccuucuguuuacaggacaccucaagugcagacugcggauggacaaacuucagcugaagggcaugagcuauuccauguguaccgggaaauucaagguggucaaggagauugccgaaacccaacauggaacaaucgugauuagaguucaguacgagggcgacgggagcccuugcaaaauccccuucgagaucauggaucucgaaaagcgccacgugcugggacggcugauuacggucaaucccaucgugaccgagaaagacucuccuguuaacauugaagcugagccgcccuuuggcgauuccuacaucauuaucgggguggaaccuggccagcucaagcugagcugguucaaaaagggaucuagcauuggccagauguuugagacaaccaugagaggggccaagcgcauggccauccuuggagacacagcuugggauuucggcucccucggcggggucuuuaccucuaucgggaaagcccuccaucaaguguucggggcgauuuauggcgcugccuuuagcggaguguccuggacgaugaagauccugauuggcguugucaucacauggauugggaugaauagccggucuaccucccugagcgugucucuugugcucgucggagugguuacccuguaccugggcgugaugguccaggccgacuccgggugugugguuagcuggaaaaacaaggagcucaaaugcggauccggcaucuucaucacagauaaugugcacaccuggacagaacaguauaaguuucagcccgagucuccuagcaagcuggcuuccgccauucaaaaagcucacgaagaggggaucuguggcauuagaucugucacgcgccuugaaaaccugauguggaagcagaucacccccgagcucaaucauauucugacagagaacgaagugaaacugaccaucaugacaggagacaucaagggcauuaugcaggccgggaaacggagccuuagaccgcagccuaccgagcucaaguacuccuggaaagcguggggaaaggccaagaugcugagcacggaacugcacaaucauaccuuccucaucgauggccccgagacagcugaaugcccuaacaccaaucgcgccuggaacucucuggagguugaggacuauggguuuggaguguucacaaccaauauuuggcuuaaacugaaggaacggcaagaugucuuuugugacuccaaacucaugagcgcugccaucaaggacaacagagcggugcacgccgauaugggcuacuggauugagucugcucugaacgacacauggaaaaucgaaaaggccuccuucaucgaggucaagagcugccacuggcccaaaucucauacccuguggagcaauggcguccuugaguccgaaaugauuaucccuaagaacuucgcugggcccguuagccagcacaauuaucgcccgggauaccauacgcagacagccggcccuuggcaccucgggcggcuggagauggauuuugacuucugugaaggaaccaccgugguggucacagaggauugcggcaacagagggcccucucugcggaccacgacagccuccggaaaacucauuaccgaauggugcugucgcagcugcacacugcccccucuuagauaccggggcgaggacggcuguugguaugggauggagaucagaccgcugaaggaaaaagaggaaaaucucgugaacucccugguuaccgcuggacauggccagauugauaauuuuucucugggggugcuuggaauggcgcuguuccuggaggaaaugcugcgcacacgggucggcaccaagcacgccauccuccugguggcuguuagcuuugugacgcuuauuaccgggaacauguccuucagagaccugggacgcgucauggugaugguuggcgccacaaugaccgaugacaucggcaugggggugacauaccucgcccugcuggcugccuuuaaggucagacccaccuucgcggcuggacuucugcuccggaaacugacgucuaaggagcucaugaugacaaccaucggcauugugcugcuuagccaauccacaaucccugagucuauucuggaacucaccgaugcccuggcccuggggaugauggugcuuaaaaucguccgcaauauggagaaguaucagcuggcuguuaccauuauggccaucagcugcgugcccaacgcggugauccuccagaaugcuuggaaagucuccuguacaacgcuggccgugguuagcgugucuccucuccugcuuaccuccagccaacagaaggccgacuggauuccccuggcucucacaaucaagggacugaacccuaccgccauuuuucugacaacccuuucuagaacguccaaaaagcggagcuggccccugaaugaagcuaucauggccgucggcauggugucuauucucgcguccagccugcucaaaaacgauaucccgaugacagggccucugguugccggaggccuucugaccgugugcuacguccugaccggccgcuccgcugaccucgagcuggaaagagccgcugacgugcggugggaggagcaggccgaaaucagcgggucuagccccauucuuuccaucacaauuucugaggauggaagcauguccaucaagaaugaagaggaggaacagacccugacaauucucauccgcacgggccugcucgucauuucugggcuguucccugugagcauccccaucaccgccgcugcgugguaucuuugggagguuaaaaagcaaagagccggagugcugugggacgucccguccccucccccugugggcaaagcugaacuggaggauggggccuaccggauuaagcagaagggaauccucggcuauucucagauuggcgccgggguuuacaaagaaggaacauuucacaccauguggcaugugacacgcggcgcuguccugaugcacaaggggaaaagaaucgagcccagcugggccgacgugaagaaagaucuuauuuccuacggaggcggguggaagcuggagggagaauggaaggagggcgaagaggugcagguucucgcgcuggaacccggcaaaaacccucgggcuguccaaaccaagccgggacucuucaaaacgaacaccggaacaaucggcgccgugagccuggacuuuucucccgggaccuccggaagcccuaucguggauaagaaaggcaaggucguggggcuuuauggaaauggcguugugacaagaucuggcaccuacgucuccgccauugcucagacagaaaagagcaucgaggacaaccccgaaauugaggaugacaucuuccgcaaaaagcggcugacgauuauggaucugcauccuggggccggaaaaaccaagagauaucuccccgcgaucgugcgcgaagcuaucaaacggggccugagaacacuuauucuggccccuacccgcguuguggccgcugagauggaagaggcccuccgggggcugccgaucagauaccagacccccgcuauucgcgccgagcacacaggacgggaaaucgucgaccucaugugucaugcgacguucaccaugagacugcuuuccccuauucgggugcccaauuauaaccugaucauuauggaugaggcccacuuuacagacccugcuucuaucgccgcucgcggcuacaucagcaccagaguugaaaugggggaggccgccggcauuuucaugacagcuacacccccgggaucccgggacccuuuuccccagagcaaugcgcccaucauggaugaggaacgcgagauuccugaaagaucuuggaacuccggccacgagugggugacggacuucaaggggaagacagucugguuugugcccagcaucaaagccggaaaugauauugcugccugccugcggaagaacggcaaaaaggugauccaacucucuagaaaaaccuucgacagcgaauauaucaagacccgcacaaaugauugggacuuugucguuaccacagauauuuccgagaugggggccaacuucaaggcugagcgggugaucgacccuagacgcuguaugaaaccggugauucugaccgauggagaggaacgggucauccuugccggccccaugccugugacgcauucuagcgcggcucagagacgcgggcggguuggcagaaaucccaagaacgaaaaugaccaguacauuuacaugggagagccucuggaaaacgaugaggacugcgcccacuggaaagaggccaagaugcuccuggacaauaucaacacacccgaaggcaucauuccguccauguuugagccugaacgcgagaaaguggaugcuaucgacggggaauauagacugcggggagaggcccgcaagaccuucgucgaucucaugagacggggcgaccuucccguguggcuggcguaccgcguugccgcugaggggauuaacuaugccgauagacggugguguuuugacggagugaaaaauaaccaaauccuggaagagaaugucgaaguggagauuuggacaaaggagggcgaaagaaagaaacucaagccucgcuggcuggaugcucggaucuacucugacccccuugcccugaaagaguucaaggaguucgcugccgggagaaaaagccucacccugaaccugauuacggagaugggccgccucccuaccuuuaugacacagaaggcgaagaaugcccuugauaaccuggcuguccugcauaccgccgaagcuggaggccgggccuauaaucacgcccucuccgagcugcccgagacacuugaaacccugcuccugcugacacuccuugcuaccgugacagggggaaucuuccuguuucugaugagcggcaaagggaucggaaagaugacacucggcaugugcugcauuaucaccgcgucuauucugcuuugguacgcccagauccagccgcacuggauugcugccuccaucauccuggaguucuuucucauuguucugcugaucccugaacccgagaaacaaagaacaccccaggacaaccagcucacauauguggugauugccauccuuaccgucguugcugccacaauggcgaaugaaaugggcuuccuggagaagacgaaaaaggauuuugggcugggaagcauuaccacacagcaaccugaguccaacauccucgacaucgaucugcggccggccucugcuuggacccuuuacgccguggcuacaaccuucauuacgcccaugcugcgccauagcaucgaaaauuccucugugaacgucagccucaccgccauugcgaaucaggccacagugcugaugggccuggggaagggauggccucucuccaaaauggacaucggcguuccccuucuggcuauuggguguuacagccaggugaacccuaucacccugacagccgcucuccugcuucuggucgcccacuaugcuauuaucggacccggccuccaggccaaggcgaccagagaggcccaaaaacgggcugccgcuggcaucaugaagaauccuacgguggacgggaugacagucauugaucuggacccgauccccuacgauccuaaauuugaaaagcagcugggacaggugaugcuccuuguucugugcgugacccagguccugaugaugcgcacaaccugggcccucugugaggcccugacccuugcgacaggccccauuucuacgcugugggaagggaacccuggaagauucuggaauaccacaaucgcuguguccauggccaacauuuuucggggcagcuaucucgcuggggccggacugcuguucucuaucaugaagaacaccgccaauacacgcagaggcaccggcaacacgggggagacacucggagagaaauggaagaaucggcuuaacgcucugggcaaauccgaauuucaaaucuacaagaaaagcgggauucaggagguugaccgcacccuggccaaggaaggaaucaaaagaggcgagaccgaucaucacgcggugucucgggggagcgccaagcucagaugguucgucgagcgcaaucuggugacacccgaaggaaaggugguugaccuuggcugcggcagagggggaugguccuauuacuguggcgggcugaaaaacgucaaggaggugaaaggacucaccaagggcgggccgggacaugaagaaccuauucccaugucuacauauggcuggaaucuggugagacugcagagcggcgucgauguuuucuuuacgcccccugaaaaaugcgacacccuccuuugugauaucggggaguccagccccaacccuacaguggaggcuggacgcacccugcgggugcugaaucucgucgaaaacuggcugaauaacaauacacaauucugcauuaaggugcuuaacccguacaugcccuccguuaucgagaagauggaagcccugcagagaaaauacggcggggcucucgugcgcaauccucugucucggaacagcacccacgagauguauugggucuccaacgccucuggaaauaucgugagcuccguuaacaugauuucuagaaugcugaucaaucgcuuuacgaugcggcacaagaaagcgaccuacgaacccgacguggaucucggcagcgggacaagaaacauuggaaucgaguccgagaccccuaaucuugacauuaucggcaagcgcaucgagaagauuaagcaggagcaugaaacaagcuggcacuaugaucaggaccaucccuacaagaccugggccuaucacggcucuuacgagacaaaacaaaccggguccgcuagcucuauggucaacggaguggugcggcugcugacgaagccgugggacgucaucccuaugguuacacagauggccaugaccgauaccacacccuucggccagcagagaguguuuaaagaaaagguggacacgcgcacccaagagccuaaagaggggacaaagaagcucaugaaaauuaccgcugaauggcuguggaaggagcuuggcaaaaagaaaacacccagaauguguacccgggaagaguucacacgcaaggucagauccaaugccgcucugggcgccaucuuuaccgaugagaacaaauggaaaagcgcgcgggaagccguggaggacucuggguucugggaacucguugauagagagcggaaucugcaccuggaaggaaagugcgagacguguguguauaacaugaugggcaaacgcgagaagaaacucggcgaauuugggaaggcuaaaggauccagagccauuugguacauguggcugggcgcucgguuccuugaguuugaagcccugggguuccucaaugaggaccauugguuuagccgcgaaaacucccugagcggagucgagggcgaggggcuucacaagcugggcuacauccucagagaugugucuaagaaagaaggaggcgccauguaugcggacgauaccgcugggugggacacacggauuacccuggaggaucugaagaaugaagagaugguuacaaaccauauggaaggagagcacaaaaagcucgccgaggccaucuucaaacugaccuaccagaauaaggugguccgcgugcagagaccuacgccccggggcacaguuauggacaucauuagccgcagagaccagcggggguccggacaaguggucaccuauggccuuaacacauucaccaacauggaagcucagcugauccgccagauggagggggaaggcguguuuaagucuauucaacagcucacggucaaagaggagaucgccgugaagaauuggcugauuagaguuggacgggaacgccuuagcagaauggcuaucuccggcgaugacugcguggucaaaccgcuggaugaccgguucgccucugcgcucaccgcccugaacgauauggggaaggugagaaaagacauccagcagugggagccuagccgcggauggaaugauuggacacaagugcccuuuugcucccaucacuuccacgaacugauuaugaaggacggccggguucucgugguccccuguagaaaccaggaugagcugaucgggcgcgcucggauuucucagggagccggcuggagccuuagagaaaccgcuugccuggggaaguccuacgcccagauguggagccucauguauuuucaucgccgggaccugagacuugcggccaaugcuaucuguucugccgugccuucccacuggauuccgacaagccgcaccacauggucuauccaugcuacccacgaguggaugacgacagaggauaugcugaccguuuggaaccggguguggauccaagaaaaucccuggauggaggacaaaaccccugucgaauccugggaggaaauucccuaccucggcaagagagaggaucaguggugcggaagccugaucggccugacaucccgcgccaccugggcuaaaaacauucagacagccaucaaucaggugcggucucucauugggaacgaggaauauacggacuacaugccuagcaugaagagauuccggagagaggaagaggaagcgggaguccugugguga

SEQ ID NO: 19587 - RNA, 9876 nt, Artificial Sequence
  derived and/or modified CDS sequence (opt5) from DENV-2__KX380818__SS-prME
accgcuggaaucauuaucaugaugauucccaccgugauggcuuuccaccugacgaccagaaacggggagccucauaugaucgugagccggcaggaaaagggcaagagccuccuguuuaagacagagaaugggguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaagcgcuccguggcucuggucccucauguggggaugggacucgagacaagaaccgaaacguggaugucuagcgagggcgccuggaagcacgcccagcggaucgagacauggguucugcgccaucccggcuucaccauuauggcugccauccuggcuuacacaauugggaccaccuauuuucagagagugcucaucuucauucugcuuacagccgucgcgccuuccaugacgaugcggugcaucggaauuucuaaccgcgacuuuguggaaggcguuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacgguuaccauggaauguucuccccggacaggacuggacuucaaugagauggugcuucugcagauggaaaacaaggccuggcucguccaccgccaaugguuucuggaucuuccgcugccuuggcuccccggcgcugacacccagggguccaacuggauucagaaagagacacuggugaccuucaagaauccucacgccaagaaacaggauguugugguccugggaagccaagagggcgccaugcauacggcucucacaggggcgaccgaaauccagauguccucuggcaaccugcuuuuuacaggacaccugaagugcagacuccggauggacaaacugcagcuuaagggcaugagcuauuccauguguaccgggaaauucaagguggucaaggagauugccgaaacccaacauggaacaaucgugauuagaguucaguacgagggcgacgggagccccugcaaaauccccuucgagaucauggaucuggaaaagcgccacgugcucggacggcugauuacggucaauccuaucgugaccgagaaagacucuccgguuaacauugaagcugagcccccuuuuggcgauuccuacaucauuaucgggguggaacccggccagcugaagcucagcugguucaaaaagggaucuagcauuggccagauguuugagacaaccaugagaggggccaagcgcauggccauccugggagacacagcuugggauuucggcucccuugggggagucuuuaccucuaucggcaaagcccugcaucaaguguucggggcgauuuauggcgcugccuuuagcggaguguccuggacgaugaagauccucauuggcguugucaucacauggauugggaugaauagccggucuaccucccugagcgugucucuggugcuugucggagugguuacccucuaccugggcgugaugguccaggccgacuccgggugugugguuagcuggaaaaacaaggagcugaaaugcggauccggcaucuucaucacagauaaugugcacaccuggacagaacaguauaaguuucagccugagucucccagcaagcucgcuuccgccauucaaaaagcucacgaagaggggaucuguggcauuagaucugucacgcgccuggaaaaccuuauguggaagcagaucaccccggagcugaaucauauucucacagagaacgaagugaaacugaccaucaugacaggagacaucaagggcauuaugcaggccgggaaacggagccugagaccucagcccaccgagcuuaaguacuccuggaaagcguggggaaaggccaagaugcucagcacggaacugcacaaucauaccuuccugaucgauggcccugagacagcugaaugccccaacaccaaucgcgccuggaacucucucgagguugaggacuauggguuuggaguguucacaaccaauauuuggcugaaacuuaaggaacggcaagaugucuccugugacagcaaacugaugucugcugccaucaaggacaacagagcggugcacgccgauaugggcuacuggauugaguccgcucucaacgacacauggaaaaucgaaaaggccagcuuuaucgaggugaagucuugccacuggccuaaaagccauacccugugguccaauggcguccuggagagcgaaaugauuauccccaagaacuucgcugggccgguuucucagcacaauuaucgcccuggauaccauacgcagacagccggccccuggcaccuugggcggcucgagauggauuucgacuuuugugaaggaaccaccgugguggucacagaggauugcggcaacagagggcccucccugcggaccacgacagccagcggaaaacugauuaccgaauggugcugucgcuccugcacacucccuccgcugagauaccggggcgaggacggcuguugguaugggauggagaucagaccccuuaaggaaaaagaggaaaaucuggugaacucucucguuaccgcuggacauggccagauugauaauuucagccugggggugcugggaauggcgcuuuuucucgaggaaaugcugcgcacacgggucggcaccaagcacgccauccugcucguggcuguuuccuucgugacgcugauuaccgggaacaugucuuuuagagaccuuggacgcgucauggugaugguuggcgccacaaugaccgaugacaucggcaugggggugacauaccuggcccuccuggcugccuucaaggucagaccuaccuuugcggcuggacugcuucugcggaaacucacgagcaaggagcugaugaugacaaccaucggcauugugcuccugucccaaucuacaauccccgagaccauucuugaacugaccgaugcccucgcccuggggaugauggugcugaaaaucguccgcaauauggagaaguaucagcuugcuguuacaauuauggccauccugugcgugccuaacgcggugauccuccagaaugcuuggaaagucagcuguacgacccuggccgugguuuccgugagcccccuccugcuuacaucuucccaacagaagaccgacuggauuccucuggcccucacaaucaagggacugaaccccaccgcuauuuuccugacgacacuuagcagaaccucuaaaaagcgguccuggccgcugaaugaagccaucauggcugucggcauggugagcauucucgccucuuccuuucugaaaaacgauaucccuaugaccgggccccucguugcgggaggccugcuuacagugugcuacguccugaccggccgcagcgccgaccuggagcucgaaagagcugccgacauccggugggaggagcaggcugaaauuuccgggagcucuccuauccugagcauuacaaucuccgaggauggaucuaugagcauuaagaaugaagaggaggaacagacgcuuaccauccugauucgcacaggccuccuggugaucuccggacucuuccccgucucuaucccgauuaccgccgccgcuugguaucugugggaggugaaaaagcaaagagcgggaguucuuugggacgugccuucucccccucccgucggcaaagccgaacuggaggauggggcuuaccggaucaagcagaagggcauucugggcuauucccagaucggcgccgggguguacaaagaaggaacauuucacaccauguggcauguuacgcgcggcgccgugcucaugcacaaggggaaaagaauugagcccuccugggcugacgucaagaaagaucugaucagcuacggaggcggguggaaacuugagggagaauggaaggagggcgaagagguccaggugcuggcccucgaaccuggcaaaaacccgcgggcgguucaaaccaagcccgggcuguucaaaacaaacaccggaacaaucggcgcugucucccucgacuuuagcccugggaccucuggaucccccauuguggauaagaaaggcaagguggucgggcuguauggaaauggcgugguuacaagaagcggcacguacgugucugccaucgcccagaccgagaagaacauugaggacaauccugaaaucgaggaugacauuuuccgcaaaaagcggcuuacaaucauggaucugcaucccggggcuggaaaaaccaagagauaucugccugccaucguccgcgaagcgauuaaacggggccucagaacccugauccuugcuccgacacgcgugguugccgccgagauggaagaggcucugcgggggcuccccauuagauaccagacgccugccauccgcgcugagcacaccggacgggaaauuguggaccugaugugucaugccacauucaccaugagacuccugucccccauccgggucccuaacuauaaucuuauuaucauggaugaggcgcacuuuacagaccccgccagcaucgcugcccgcggcuacauuuccaccagaguggaaaugggggaggcugccggcaucuucaugacggccacaccgccuggaucucgggaccccuuuccccagagcaacgcuccuauuauggaugaggaacgcgagauccccgaaagauccuggaauagcggccacgaguggguuaccgacuucaaggggaagaccgugugguuugucccuucuauuaaagcgggaaacgauaucgccgcuugccugcggaagaauggcaaaaaggugauccaacuguccagaaaaacauucgacagcgaauaugugaagacccgcacaaacgauugggacuuugucguuaccacggauauuucugagaugggggccaauuucaaggccgagcgggugaucgacccgagacgcuguaugaaacccgugauucucacagauggagaagaacgggucauccuggcuggcccuaugcccgugacccauagcuccgccgcgcagagacgcgggcggguuggcagaaacccuaagaaugaaaacgaccaguacauuuacaugggagagccccuugaaaaugaugaggacugcgcucacuggaaagaggccaagaugcugcucgacaacaucaacacaccggaaggcaucauuccuucuauguuugagcccgaacgcgagaaaguggaugccaucgacggggaauauagacugcggggagaggcucgcaagaccuucgucgaucugaugagacggggcgaccucccuguguggcuugccuaccgcguugcggccgaggggauuaauuaugcugauagacggugguguuuugacggagugaaaaacaaucaaauccuggaagagaacgucgaaguggagauuuggacgaaggagggcgaaagaaagaaacugaagccccgcuggcucgaugcccggaucuacagcgacccucuggcucuuaaagaguucaaggaguucgccgcugggagaaaaucccugacccucaaucugauuacagagaugggccgccugcccaccuuuaugacacagaaggcccggaacgcgcucgauaaucuugccguccugcauaccgcugaagccggaggcagagcuuauaaccacgcccugucugagcucccggagacacuggaaacccuucugcuccugacgcugcucgccacagugaccgggggaaucuuccuuuuucugaugagcggcaaggggaucggaaaaaugacccugggcaugugcugcauuguuacagcuuccauccuccugugguacgcgcagauucagccucacuggaucgccgcuagcauuauccuugaguucuuucugaucgugcuccugauucccgaacccgagaagcaacggaccccucaggacaaucagcugacauauguggucaucgccauucucacgguuguggccgcuaccauggccaacgaaaugggcuuccuugagaaaacaaagaaagauuuugggcugggaucuaucaccacacagcaaccggaguccaauauucuggacaucgaucuccgccccgcgagcgccuggacccuguacgcuguggccacgaccuucaucacaccuaugcuuagacauuccauugaaaacucuagcgucaaugugucccugaccgcuaucgccaaccaggcgacaguucucaugggccuggggaagggauggccccugucuaagauggacauuggcgugccucuccuugccaucggguguuacagccaggucaaucccauuacccugacggcugcccugcuccugcuuguggcucacuaugccaucauuggaccuggccugcaggcuaaagccacacgggaggcgcaaaagcgcgccgcugccggcaucaugaaaaucccggcugccgacauugggagagucaucgaucucgaccccauuccuuacgaucccaaguuugaaaaacagcugggacaggugaugcugcucguucuuugcgugacccagguccugaugaugcggacaaccugggcccugugugaggcgcucacccuggcuacaggcccuaucuccacgcuuugggaagggaaccccggacgcuucuggaauaccacaauugccgugagcauggcuaacaucuuuagaggcucuuaucuggccggggccggacuccuguucuccaucaugaagaacaccgcuaauacacggcgcggcaccggcaacacgggggagacacugggagagaaguggaaaaaucaacucaacgcccuuggcaagagcgaauuucagauuuacaaaaagucugggauccaggagguugacagaacccuggcgaaagaaggaauuaagcggggcgagaccgaucaucacgccguguccagagggagcgcuaaacugcgcugguucgucgagcggaaucucgugacaccggaaggaaaggugguugaccugggcugcggcagagggggauggucuuauuacuguggcgggcuuaagaacgucaaagaggugaagggacugaccaaaggcgggccuggacaugaggaacccauccccaugagcacauauggcuggaaucucgugcgccugcaauccggcgucgauguuuucuuuacgccucccgaaaagugcgacacccugcucugugauauuggggagucuagcccuaacccgacaguggaggccggacggacccuuagagugcugaaucuggucgaaaacuggcucaauaacaauacacaguucugcaucaaagugcugaaccccuacaugccuuccguuaucgagaagauggaagcccuucagcgcaaguacggcggggcccuggugcggaauccccucagcagaaacuccacccacgagauguauugggucucuaacgcgagcggaaauauuguguccucuguuaacaugaucagccgcaugcugauuaaucgguuuacgaugagacacaaaaaggccaccuacgaaccugacguggaucugggcuccgggacacgcaacaucggaauugagucugagguccccaaucucgacaucaucggcaaacggauugaaaagaucaaacaggagcaugaaaccagcuggcacuaugaucaagaccauccguacaagacaugggcuuaucacggcuccuacgagaccaagcagacagggagcgccucuuccauggugaacggaguggucagacuucugaccaaaccuugggacguuauucccauggugacgcagauggcuaugacagauaccaccccuuucggccagcaacgcguguuuaaggaaaaagucgacacaagaacgcaggagcccaaggaggggaccaaaaagcugaugaagaucacagccgaauggcucuggaaagagcugggaaagaaaaagaccccucggauguguacacgcgaagaguucaccagaaaagugcggagcaaugcugcccuuggcgcgauuuuuacagaugagaacaaguggaaaucugccagagaagcuguugaggacuccggguucugggaacugguggauaaggagcggaaucuccaccuggaaggaaagugcgagaccugugucuauaacaugaugggcaaacgcgagaagaaacugggcgaauuugggaaggccaaaggaagcagagcuaucugguacauguggcucggcgcccgguuccuggaguuugaagcccuuggguuccugaaugaggaccauugguuuucucgcgaaaacucccucagcggaguggagggcgaggggcugcacaaacuuggcuacauucugagagauguuuccaagaaagaaggaggcgcgauguaugcugacgauacggccgggugggacacccggaucacacucgaggaucugaagaaugaagagauggugaccaaccauauggaaggagagcacaaaaagcuggccgaggcuaucuuccgccucacauaccagaauaaagucgugagaguucagcggcccaccccgcgcggcacggugauggacauuaucagcagacgggaccaacgcgggucuggacaggucgugacauauggccugaacaccuucacaaacauggaagcccagcuuauuagacaaauggagggggaaggcgucuuuaagagcauccagcaucugaccgcuacggaggagauugccgugaagaauuggcucguucgggugggacgcgaaagacugucccggauggcgaucucuggcgaugacugcgucgugaaaccucuugaugacagauucgccaacgcucugaccgcccucaaugauauggggaaggugcgcaaagacauccagcagugggagcccagccggggauggaacgauuggacacaaguucccuuuugcucccaccacuuccaugaacugauuaugaaggacggcagagugcuggucgugccuugucgcaaucaggaugagcucaucgggcgggcuagaauuucucagggagccggcuggagccugcgcgaaaccgcgugccuugggaaauccuacgcccagauguggucucugauguauuuucaccggagagaccuccgccuggcugccaacgcuaucuguagcgccguuccgucccauugggugcccacaagccggaccacauggucuauucacgcuacccacgaguggaugacgacagaggauaugcuuaccgucuggaauagaguguggauccaagaaaacccuuggauggaggacaagacccccgucgaauccugggaggaaaucccuuaccugggcaagcgcgaggaucaguggugcggaagccucauuggccugacaucucgggccaccugggcgaaaaauauccagacagccauuaaccaggugagaucccugaucgggaaugaggaauauacggacuacaugcccagcaugaagcgguucagacgcgaggaagaggaagcuggaguucucugguga

SEQ ID NO: 19588 - RNA, 9876 nt, Artificial Sequence
  derived and/or modified CDS sequence (opt5) from DENV-2__KX380819__SS-prME
accgccggaaucauuaucaugaugauucccaccgugauggcuuuccaccugacgaccagaaacggggaaccucauaugaucguuagccggcaggaaaaggggaaaagccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcauuagcgggggauccuggguggauaucguccuggagcacggcagcugugugaccacaauggccaaaaauaagcccacccucgacuucgaacugaucaagacagaggcuaaacacccugccacccuuagaaaguacugcauugaagcuaaacugacgaacacaaccaccgccucucgguguccgacacagggggagcccucccucaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagauugugcagccugaaaaccuggaguauacgaucgugauuacaccccacucuggcgaagagaaugccgucgggaacgauacaggaaaacauggcaaggagaucaaagugaccccucaguccagcaucacagaagcugagcucaccggcuacgggacggccaccauggaauguucuccccggacaggacuggacuucaaugagaugguucuucugcagauggaaaacaaggcuuggcucgugcaccgccaaugguuucuggaucuuccgcugccuuggcuccccggcgccgacacccagggguccaacuggauucagaaagagacacuggucaccuucaagaauccucacgccaagaaacaggaugugguugugcugggaagccaagagggcgcuaugcauacggcgcucacaggggccaccgaaauccagauguccucuggcaaccugcuuuuuacaggacaccugaagugcagacuccggauggacaaacugcagcuuaagggcaugagcuauuccauguguaccgggaaauucaaggucgugaaggagauugcugaaacccaacauggaacaaucgucauuagagugcaguacgagggcgacgggagccccugcaaaauccccuucgagaucauggaucuggaaaagcgccacguucucggacggcugauuacggugaauccuaucgucaccgagaaagacucuccggugaacauugaagccgagcccccuuuuggcgauuccuacaucauuaucgggguugaacccggccagcugaagcucagcugguucaaaaagggaucuagcauuggccagauguuugagacaaccaugagaggggccaagcgcauggcuauccugggagacacagccugggauuucggcucccuugggggaguguuuaccucuaucggcaaagcgcugcaucaagucuucggggcuauuuauggcgccgccuuuagcggaguguccuggacgaugaagauccucauuggcgugguuaucacauggauugggaugaauagccggucuaccucccugagcgucucucuggugcuugugggaaucgucacccucuaccugggcgugaugguucaggcugacuccggguguguggucagcuggaaaaacaaggagcugaaaugcggauccggcaucuucauuacagauaaugugcacaccuggacagaacaguauaaguuucagccugagucucccagcaagcucgccuccgcuauccaaaaagcccacgaagaggggauuuguggcaucagaucuguuacgcgccuggaaaaccuuauguggaagcagauuaccccggagcugaaucauauccucagcgagaacgaagugaaacugacaaucaugaccggagacauuaagggcaucaugcaggcggggaaacggucccugagaccucagcccacagagcuuaaguacagcuggaaagccuggggaaaggcuaagaugcucucuaccgaacugcacaaucauacguuccugauugauggcccugagaccgccgaaugccccaacacaaaucgcgcuuggaacucccucgaggucgaggacuauggguuuggaguguucaccacaaauaucuggcugaaacuuaaggaacggcaagaugucuuuugugacagcaaacugaugucugccgcgauuaaggacaacagagccgugcacgcugauaugggcuacuggaucgaguccgcccucaacgacaccuggaaaaucgaaaaggcuagcuucauugaggucaagucuugccacuggccuaaaagccauacacugugguccaauggcgugcuggagagcgaaaugaucauucccaagaacuucgccgggccggugucucagcacaauuaucgcccuggauaccauacccagacggccggccccuggcaccuugggcggcucgagauggauuuugacuucugugaaggaacaaccgucguugugaccgaggauugcggcaacagagggcccucccugcggacaaccacggcuagcggaaaacugaucacagaauggugcugucgcuccugcacccucccuccgcugagauaccggggcgaggacggcuguugguaugggauggagauuagaccccuuaaggaaaaagaggaaaaucuggugaacucucucgucacagcgggacauggccagaucgauaauuuuagccugggggugcugggaauggcccuuuuccucgaggaaaugcugcgcacccggguuggcacaaagcacgcuauucugcucguggccgucuccuuugugacccugaucacggggaacaugucuuucagagaccuuggacgcguuauggugauggucggcgccaccaugacagaugacaucggcaugggggugaccuaccuggcucuccuggccgcguuuaagguuagaccuacauucgcugccggacugcuucugcggaaacucaccagcaaggagcugaugaugacgacaauuggcaucgugcuccugucccaaucuaccauucccgagacaauccuugaacugaccgaugcccucgcucuggggaugaugguccugaaaauugugcgcaauauggagaaguaucagcuugccgugaccaucauggcgauccugugcgucccuaacgcuguuauucuccagaaugccuggaaagugagcuguacaauccuggccguggucuccgugagcccccuccugcuuacgucuucccaacagaaggcugacuggauuccucuggcccucaccaucaagggacugaaccccacagcuauuuuucugaccacacuuagcagaaccucuaaaaagcgguccuggccgcugaaugaagccaucauggcgguuggcauggugagcauccucgccucuucccugcucaaaaacgauauuccuaugacggggccccuggucgcuggaggccuucugacagugugcuacguucugaccggccgcagcgccgaccucgagcuggaaagagcugccgacgugcggugggaggagcaggccgaaaucuccgggagcucuccuauucuuagcaucaccauuuccgaggauggaucuaugagcaucaagaaugaagaggaggaacagacacugaccauucucauccgcacaggccugcucgucaucuccgggcuguuccccgugucuauuccgaucacggcugcggccugguaucuuugggaggucaaaaagcaaagagcuggagugcugugggacguuccuucucccccucccgugggcaaagccgaacuggaggauggggccuaccggauuaagcagaagggaauccucggcuauucccagauuggcgcuggggucuacaaagaaggaaccuuucacacaauguggcaugugacccgcggcgccguucugaugcacaaggggaaaagaaucgagcccuccugggcggacgugaagaaagaucuuaucagcuacggaggcggguggaagcuggagggagaauggaaggagggcgaagagguccaggugcucgcucuggaaccuggcaaaaacccgcgggccgugcaaacaaagcccggacuguucaaaaccaacacgggaaccauuggcgccguuucccuggacuuuagcccugggacaucuggaucccccaucgucgauaagaaaggcaaggugguggggcuuuauggaaauggcgucgugaccagaagcggcacauacguuucugcuauugcccagaccgagaaguccaucgaggacaacccugaaauugaggaugacaucuuccgcaaaaagcggcugacaaucauggaucugcaucccggggcgggaaaaacgaagagauaucucccugcuauugugcgcgaagccaucaaacggggccugagaacccuuauucuggccccgacacgcgucguggcugccgagauggaagaggcucuccgggggcugcccaucagauaccagaccccugccauucgcgcggagcacaccggacgggaaaucguugaccucaugugucaugccacauucacgaugagacugcuuagccccauucgggugccuaauuauaaccugaucaucauggaugaggcucacuuuaccgaccccgccuccauugcugcccgcggcuacaucucuacaagagucgaaaugggggaggccgcuggcauuuucaugaccgcgacaccgccuggaagccgggaccccuuuccccaguccaaugccccuaucauggaugaggaacgcgagauucccgaaagaagcuggaacucuggccacgagugggugaccgacuucaaggggaagacgguuugguuugugccuuccaucaaagcuggaaaugauaucgccgccugccugcggaagaacggcaaaaaggucauucaacucagcagaaaaacauucgacucugaauauaucaagacccgcaccaaugauugggacuuuguggugacaaccgauauuagcgagaugggggcuaacuucaaggccgagcgggucaucgacccgagacgcuguaugaaacccguuauucugacagauggagaagaacgggugauccuugcgggcccuaugcccgugacccauuccucugcugcccagagacgcgggcgggucggcagaaauccuaagaacgaaaaugaccaguacaucuacaugggagagccccuggaaaacgaugaggacugcgcccacuggaaagaggcuaagaugcuccuggacaauauuaacacgccggaaggcaucauuccuagcauguuugagcccgaacgcgagaaaguggaugccaucgacggggaauauagacugcggggagaggcgcgcaagacauucguugaucucaugagacggggcgaccuuccuguguggcuggccuaccgcgucgcugccgaggggauuaacuaugcugauagacggugguguuuugacggagugaaaaauaaccaaauccuggaagagaauguugaaguggagauuuggaccaaggagggcgaaagaaagaaacucaagccccgcuggcuggaugcccggaucuacuccgacccucuugcucugaaagaguucaaggaguucgccgcggggagaaaaucucucacacugaaccugaucaccgagaugggccgccuccccacguuuaugacccagaaggcccggaaugcucuugauaaccuggccguccugcauacagcugaagccggaggcagagccuauaaucacgcucucagcgagcugccggagacccuugaaacacugcuccugcugacccuccuugcgacagugaccgggggaauuuuccuguuucugauguccggcaaggggaucggaaaaaugacgcucggcaugugcugcauuaucacagccagcauucugcuuugguacgcucagauccagccucacuggaucgccgccucuauuauccuggaguucuuucucauuguccugcugauccccgaacccgagaagcaacggaccccucaggacaaccagcucaccuaugugguuauugcuauccuuacagugguggccgcgaccauggccaaugaaaugggcuuccuggagaaaacaaagaaagauuuugggcugggauccaucacgacccagcaaccggacagcaacauucucgauaucgaccugcgccccgcuuccgccuggacacuuuacgcugucgccaccacauucauuaccccuaugcugagacauucuaucgagaauagcuccguuaacgugucucucacggcgauugccaaucaggcuaccgugcugaugggccuggggaagggauggccccucagcaagauggacaucggcgucccucuucuggccauuggguguuacucccaggugaaccccaucacacugaccgcugcccuccugcuucugguugcucacuaugccaucauuggaccuggccuccaggcgaaagccacacgggaagcucaaaagcgcgccgcugccggcaucaugaaaauuccggccgcgcugaucgggagagugauugaucuggaccccaucccuuacgaucccaaguuugagaaacagcucggacaggucaugcuucuggugcugugcgucacccaggugcucaugaugcggacgacaugggcucugugugaagcccuuacccuggcuacaggcccuaucagcacccucugggaggggaaucccggacgcuucuggaacaccacaauugccguuucuauggccaauaucuuuagaggcuccuaucuggcuggggccggacuccucuucagcauuaugaagaacacggcgaacacccggcgcggcacaggcaauaccggggaaacacuuggagagaaguggaaaaacagacugaaugcccugggcaagucugaguuucaaaucuacaaaaaguccgggauucaggaaguggaccggacccucgcuaaagagggaaucaagagaggcgaaacggaucaucacgccgucagccgcgggucugcuaaacugcggugguucguggagagaaaccuuguuacaccggagggaaagguggucgaccugggcugcggccgcgggggauggagcuauuacuguggcgggcucaagaaugugaaagaagugaagggacugaccaaaggcgggccuggacaugaggaacccauccccauguccaccuauggcuggaaccugguucggcuccagucuggcgucgauguguucuuuacaccucccgagaagugcgacacccuucugugugauauuggggaaagcuccccuaauccgacaguggaggccggaagaacgcugcgcguccucaaccugguugagaauuggcuuaacaauaacacccaauucugcaucaaagugcugaaucccuacaugccuagcgugauugaaaagauggaggcgcuccagcggaaguacggcggggcccuggucagaaacccccugucccgcaauucuacacacgaaauguauugggugagcaacgcuuccggaaacaucguuucuagcgugaauaugauuucccggaugcucaucaacagauuuaccaugaaacacaagaaagccacauacgagccugacgucgaucuuggcucugggacccgcaauaucggaauugaaagcgagacgcccaaccuggacaucauuggcaagcggaucgagaaaauuaagcaggaacaugagaccuccuggcacuaugaucaggaccauccguacaagacaugggcuuaucacggcagcuacgaaaccaaacaaacagggucugccuccagcauggugaauggaguugugagacugcucaccaagccuugggacgucauccccauggugacacagauggcuaugaccgauacgacaccuuucggccagcagcgcguguuuaaagagaaggucgacaccagaacccaagaacccaaagaggggacaaagaagcugaugaaaauuacggccgaguggcuuuggaaggaacugggcaaaaagaaaaccccucggauguguacacgcgaggaguucaccagaaagguucggucuaacgcggcccucggcgcuaucuuuacagaugagaauaaauggaaguccgccagagaggcuguggaagacagcggguucugggagcugguggauaaggaacggaaccugcaccucgagggaaaaugcgaaaccugugucuauaauaugaugggcaagcgcgagaaaaagcugggcgaguuugggaaagccaagggaucuagagccaucugguacauguggcuuggcgcgcgguuccuggaauuugaggcucucggguuccugaacgaagaccauugguuuucccgcgagaauagccuuuccggaguggaaggcgaggggcugcacaagcucggcuacauucugagagauguuagcaaaaaggagggaggcgccauguaugccgacgauacagcugggugggacacccggaucacgcuggaagaucucaaaaacgaggaaauggugaccaaucauauggagggagaacaccgcaagcuggccgaggcuauuuucagacuuacauaccagaacaaagucgugcggguucagcgccccaccccgagaggcacagugauggacaucauuucucggcgcgaccagagagggagcggacaagucgugaccuauggccugaauacguucacaaacauggaggcccagcucauccggcagauggaaggggagggcguuuuuaaguccauccaacaucugaccgugacagaagagauugcggucaagaacuggcuugagcgcgugggaagagaacggcugucuagaauggccaucagcggcgaugacugcgucgugaaaccucucgaugaccgcuucgcuuccgcccugaccgcucugaaugauauggggaagguucggaaagacauucagcagugggagcccucuagaggauggaacgauuggacacaggugcccuuuugcagccaccacuuccaugaacucaucaugaaggacggccgcguccugguggugccuugucggaaucaagaugagcuuauugggagagcccgcaucucccagggagcgggcuggucucugcgggaaaccgccugccucgggaaaagcuacgcucagauguggucccugauguauuuucacagacgcgaccuucggcuggccgcuaacgccaucuguagcgcuguuccgucucauugggugcccauuuccagaacaaccuggagcauccacgccacacacgaguggaugaccacagaggauaugcucaccgcguggaaucgcgucuggauucaggaaaacccuuggauggaggacaagacgcccguggaaucuugggaggaaaucccuuaccugggcaagcgggaggaucaauggugcggaucccugauuggccucacaagcagagccaccugggcuaaaaauauccagaccgccauuaaccagguucggucccugaucgggaaugaggaauauacagacuacaugcccucuaugaagagauuccgccgggaggaagaggaagccggagugcuuugguga

SEQ ID NO: 19589 - RNA, 9876 nt, Artificial Sequence
  derived and/or modified CDS sequence (opt5) from DENV-2__KX380821__SS-prME
accgccggcaucauuaucaugaugauucccacagugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucaccccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggagugguuacccucuaccugggcgugaugguccaggcugacuccgggugugugguuagcuggaaaaacaaggagcugaaaugcggauccggcauuuucaucacagauaaugugcacaccuggacagaacaguauaaguuucagccugagucucccagcaagcucgccuccgcuauccaaaaagcccacgaagaggggauuuguggcaucagaucugucacgcgccuggaaaaccuuauguggaagcagauuaccccggagcugaaucauauccucacagagaacgaagugaaacugaccauuaugacaggagacaucaagggcaucaugcaggcggggaaacggacccugagaccucagcccacggagcuuaaguacagcuggaaagccuggggaaaggcuaagaugcucuccaccgaacugcacaaucauacauuccugauugauggcccugagaccgccgaaugccccaacacaaaucgcgcuuggaacagccucgagguugaggacuauggguuuggaguguucaccacaaauaucuggcugaaacuuaaggaacggcaagaugucuuuugugacucuaaacugauguccgccgcgauuaaggacaacagagccgugcacgcugauaugggcuacuggaucgagagcgcccucaacgacaccuggaaaauugaaaaggcuucuuucaucgaggugaaguccugccacuggccuaaaagccauacgcuguggucuaauggcguccuggagagcgaaaugaucauucccaagaacuucgccgggccgguuucccagcacaauuaucgcccuggauaccauacacagaccgccggccccuggcaccuugggcggcucgagauggauuuugacuucugugaaggaaccacagugguggucaccgaggauugcggcaacagagggcccagccugcggacgacaaccgcuucuggaaaacugaucacagaauggugcugucgcuccugcacccucccuccgcugagauaccggggcgaggacggcuguugguaugggauggagauuagaccccuuaaggaaaaagaggaaaaucuggugaacagccucguuacagcgggacauggccagaucgauaauuuuucccugggggugcugggaauggcccuuuuccucgaggaaaugcugcgcacccgggucggcacgaagcacgcuauucugcucguggccguuucuuuugugacccugaucacagggaacaugagcuucagagaccuuggacgcgucauggugaugguuggcgccaccaugacagaugacauuggcaugggggugaccuaccuggcucuccuggccgcguuuaagaucagaccuacguucgcugccggacugcuucugcggaaacucacauccaaggagcugaugaugaccacaaucggcauuguccuccugucucaaagcaccauccccgaguccauucuugaacugaccgaugcccucgcucuggggaugauggugcugaaaaucgugcgcaauauggagaaguaucagcuugccgucacaauuauggcgauccugugcguuccuaacgcugugauccuccagaaugccuggaaagugucuuguacgacccuggccgucgugagcguuuccccccuccugcuuacaagcucucaacagaaggcugacuggauuccucuggcccucaccaucaagggacugaaccccacagcuauuuuucugaccacgcuuuccagaacaagcaaaaagcggucuuggccgcugaaugaagccaucauggcggugggcauggucuccauucucgccagcucucugcucaaaaacgauaucccuaugaccgggccccugguggcuggaggccuucugaccguuugcuacgugcugacaggccgcuccgccgaccucgagcuggaaagagcugccgacguccggugggaggagcaggccgaaaucagcggguccagcccuauucuuucuaucaccauuagcgaggauggauccaugucuaucaagaaugaagaggaggaacagacacugacgauucucauccgcaccggccugcucgugauuagcgggcuguuccccgucuccaucccgaucacagcugcggccugguaucuuugggaggugaaaaagcaaagagcuggaguucugugggacgugccuucucccccucccgucggcaaagccgaacuggaggauggggccuaccggauuaagcagaagggaauccucggcuauagccagauuggcgcugggguguacaaagaaggaaccuuucacacaauguggcauguuacccgcggcgccgugcugaugcacaaggggaaaagaaucgagcccuccugggcggacgucaagaaagaucuuauuucuuacggaggcggguggaagcuggagggagaauggaaggagggcgaagaggugcaggugcucgcucuggaaccuggcaaaaacccgcgggccguucaaacgaagcccgggcucuucaaaaccaacacaggaaccaucggcgccgucagccuggacuuuuccccugggacaagcggaucucccaucguggauaagaaaggcaagguggucgggcuuuauggaaauggcgugguuaccagauccggcacauacgugagcgcuauugcccagacggagaagucuaucgaggacaacccugaaauugaggaugacaucuuccgcaaaaagcggcugaccauuauggaucugcaucccggggcgggaaaaacaaagagauaucucccugcuaucguccgcgaagccaucaaacggggccugagaacccuuauucuggccccgacccgcgugguugcugccgagauggaagaggcucuccgggggcugcccaucagauaccagacaccugccauucgcgcggagcacacgggacgggaaaucguggaccucaugugucaugccaccuucacaaugagacugcuuucccccauucgggucccuaauuauaaccugaucauuauggaugaggcucacuuuaccgaccccgccagcaucgcugcccgcggcuacaucuccacaagaguggaaaugggggaggccgcuggcauuuucaugaccgcgacgccgccuggaucucgggaccccuuuccccagagcaaugccccuaucauggaugaggaaaaggagauucccgaacgcuccuggaacagcggccacgaguggguuacagacuucaaggggaaaaccgugugguuugucccuucuaucaaggcuggaaaugauauugccgccugccugagaaaaaacggcaagaaagugauccaacucucccggaagaccuucgacagcgaauauaucaagacaagaaccaaugauugggacuuuguggucacaaccgauauuucugagaugggggcuaacuucaaagccgagcgcguuaucgacccgcggagauguaugaagcccgugauucugacggauggagaagagcgcgugauccuugcgggcccuaugcccgucacacauagcuccgcugcccagcggagagggcgcgugggccggaauccuaaaaacgaaaaugaccaguacauuuacaugggagagccccuggaaaacgaugaggacugcgcccacuggaaggaggcuaaaaugcuccuggacaauaucaacaccccggaaggcaucauuccuucuauguuugagcccgaaagagagaagguugaugccaucgacggggaauaucgccugagaggagaggcgcggaaaacauucguggaucucaugcgcagaggcgaccuuccugucuggcuggccuaccggguggcugccgaggggauuaacuaugcugaucgcagaugguguuuugacggaguuaagaauaaccaaauccuggaagagaauguggaagucgagauuuggaccaaggagggcgaacggaaaaagcucaaacccagauggcuggaugcccgcaucuacagcgacccucuugcucugaaggaguucaaagaauucgccgcggggcggaagucccucacgcugaaccugauuaccgagaugggcagacuccccacauuuaugacccagaaggccaaaaaugcucuugauaaccuggccgugcugcauacagcugaagccggaggccgcgccuauaaucacgcucucucugagcugccggagacccuugaaacacugcuccugcugacccuccuugcgacggucacagggggaaucuuccuguuucugaugagcggcaaggggaucggaaaaaugacccucggcaugugcugcauuaucaccgccuccauucugcuuugguacgcucagauccagccucacuggauugccgccagcaucauccuggaguucuuucucauugugcugcugauccccgaacccgagaagcaacggacaccucaggacaaccagcucaccuauguugugauugcuauccuuacaguggucgccgcgacgauggccaaugaaaugggcuuccuggagaaaaccaagaaggauuuugggcugggaucuauuacaacccagcaaccggaguccaacauccucgacaucgaucugagacccgcuagcgccuggacacuuuacgcuguugccaccacguucauuaccccuaugcugcggcauuccaucgaaaauucuagcgugaacgugucccucacagcgauugccaaucaggcuaccguccugaugggccuggggaaaggauggccccucucuaagauggacaucggcgugccucuucuggccauuggguguuacagccagguuaaccccaucacacugaccgcugcccuccugcuucugguggcucacuaugccauuaucggaccuggccuccaggcgaaagccacgcgcgaggcucaaaagagagccgcugccggcaucaugaaaaauccgacagucgacgggaugaccgugauugaucuggaccccaucccuuacgaucccaaguuugaaaagcagcugggacaggucaugcuccuugugcugugcguuacacaggugcugaugaugcggaccaccugggcccucugugaggcgcugacacuugcuacgggcccuauuuccacccugugggaagggaaccccggacgcuucuggaauacaaccaucgccgucagcauggcuaacauuuuuagaggcucuuaucucgccggggccggacugcuguucuccaucaugaaaaacacagcuaauacccggcgcggcacgggcaacacaggggagacccucggagagaaguggaaaaauagacuuaacgcccugggcaagagcgaauuucaaaucuacaaaaagucugggauucaggagguggaccggacccuggcgaaagaaggaaucaagcgcggcgagacagaucaucacgccguuuccagagggagcgcuaagcuccggugguucguggagagaaaucuggucaccccggaaggaaaagugguggaccuuggcugcggccgcgggggauggucuuauuacuguggcgggcugaagaacguuaaagaggucaagggacucacaaaaggcgggccuggacaugaagagcccauucccaugagcacguauggcuggaaucuggugcggcugcaguccggcguggaugucuucuuuaccccucccgaaaagugcgacacacuccuuugugauaucggggagucuagcccuaacccgaccguugaggccggaagaacacugcgcgugcugaaucucguggaaaacuggcugaauaacaauacccaauucugcauuaagguccuuaaccccuacaugccuuccgugaucgagaaaauggaagcucugcagcggaaguacggcggggcccucguuagaaauccccugagccgcaacuccacgcacgagauguauugggugucuaacgcgagcggaaauaucgucuccucugugaacaugauuagccggaugcugaucaauagauuuaccaugcgccacaaaaaggccacauacgaaccugacguugaucucggcuccgggacccggaacauuggaaucgagucugagacacccaaucuugacauuaucggcaaaagaaucgaaaagauuaagcaggagcaugaaaccagcuggcacuaugaucaggaccauccguacaaaacaugggcuuaucacggcuccuacgagaccaagcaaacggggagcgccucuuccauggugaacggagucgugcgccugcugacaaaaccuugggacgugauccccauggucacccagauggcuaugaccgauacaacgccuuucggccagcagcggguuuuuaaggaaaaaguggacaccagaacacaagagcccaaggaggggaccaagaaacucaugaagauuacagccgaauggcuguggaaagagcuuggaaagaaaaagaccccucgcauguguacaagagaagaguucacccggaaagugcgcagcaaugcugcccugggcgcgaucuuuacggaugagaacaaguggaagucugccagagaagcugucgaggacuccggguucugggaacucguggauaaagagcggaaucugcaccuggaaggaaagugcgagaccuguguuuauaacaugaugggcaaaagagagaagaaacucggcgaauuugggaaggccaagggaagccgggcuauuugguacauguggcugggcgcccgcuuccuugaguuugaagcccugggguuccucaaugaggaccauugguuuucuagagaaaacucccugagcggaguggagggcgaggggcuucacaaacugggcuacauccuccgggaugucuccaagaaagaaggaggcgcgauguaugcugacgauacagccgggugggacacccgcauuacacuggaggaucugaagaaugaagagauggugaccaaccauauggaaggagagcacaaaaagcucgccgaggcuaucuucaagcugacguaccagaauaaaguugugagaguccagcggcccacaccgcgcggcaccgugauggacaucauuagcagacgggaccagcgcgggucuggacaaguugugacauauggccuuaacaccuucacgaacauggaagcccagcugaucagacagauggagggggaaggcgucuuuaagagcauucaacagcucaccgugaaagaggagaucgcugucaagaauuggcugauucgggugggacgcgaaagacuuucccggauggccaucucuggcgaugacugcguugugaaaccucuggaugaccgcuucgcgagcgcccucacagcucugaacgauauggggaaggucagaaaggacauccagcagugggagcccucccggggauggaaugauuggacccaagugcccuuuugcucucaucacuuccacgaacugauuaugaaagacggcagagugcucguugugccuugucgcaaccaggaugagcugaucgggcgggccagaauuagccagggagcuggcuggucccuucgcgaaacagccugccuggggaagucuuacgcgcagauguggagccucauguauuuucaucggagagaccugcgccuugccgcuaaugccaucuguuccgcugucccgagccacuggauucccaccucucggacaaccugguccauccaugccacgcacgaguggaugacaaccgaggauaugcugaccguguggaacagaguuuggauccaagaaaauccuuggauggaggacaaaacacccguggaaagcugggaggaaauuccuuaccucggcaagcgcgaggaucaguggugcggaucucugaucggccugaccucccgggcuacaugggccaaaaacauucagacggcgaucaaucaggucagaagccucauugggaacgaggaauauaccgacuacaugcccuccaugaagcgcuuccggagagaggaagaggaagccggagugcugugguga

SEQ ID NO: 19590 - RNA, 9876 nt, Artificial Sequence
  derived and/or modified CDS sequence (opt5) from DENV-2__KX380822__SS-prME
accgccggaaucauuaucaugaugauucccaccgugauggcuuuccaccugacgaccagaaacggggaaccucauaugaucgugagccggcaggaaaaggggaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuaugacaauccugugcguuccuaacgcggugauccuccagaaugcuuggaaagugagcuguacgauucuggccgucguguccguuagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcauggucagcauccucgcgucuucccugcucaaaaacgauaucccuaugacagggccccugguggccggaggccuucugaccguuugcuacgugcugaccggccgcagcgcugaccucgagcuggaaagagccgcugacguccggugggaggagcaggccgaaauuuccgggagcucuccuauccuuagcauuacaaucuccgaggauggaucuaugagcauuaagaaugaagaggaggaacagacccugacaauccucauucgcacgggccugcucgugaucuccgggcuguuccccgucucuaucccgauuaccgccgcugcgugguaucuuugggaggugaaaaagcaaagagccggaguucugugggacgugccuucucccccucccgucggcaaagcugaacuggaggauggggccuaccggaucaagcagaagggcauucucggcuauucccagaucggcgccgggguguacaaagaaggaacauuucacaccauguggcauguuacacgcggcgcugugcugaugcacaaggggaaaagaauugagcccuccugggccgacgucaagaaagaucuuaucagcuacggaggcggguggaagcuggagggagaauggaaggagggcgaagagguccaggugcucgcgcuggaaccuggcaaaaacccgcgggcuguucaaaccaagcccggacucuucaaaacgaacaccggaacaaucggcgccgucucccuggacuuuagcccugggaccucuggaucccccauuguggauaagaaaggcaagguggucgggcuuuauggaaauggcgugguuacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgaucguccgcgaagcuauuaaacggggccugagaacacuuauccuggccccgacccgcgugguugccgcugagauggaagaggcccuccgggggcugcccauuagauaccagaccccugcuauccgcgccgagcacacaggacgggaaauuguggaccucaugugucaugcgacguucaccaugagacugcuuagccccauccgggucccuaauuauaaccugauuaucauggaugaggcccacuuuacagaccccgcuuccaucgccgcucgcggcuacauuucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgaguggguuacggacuucaaggggaagacagugugguuugucccuuccauuaaagccggaaaugauaucaccgcuugccugcggaagaacggcaaaaaggugauccaacucagcagaaaaaccuucgacucugaauauauuaagacacgcaccaaugauugggacuuuguggucacaaccgauaucagcgagaugggggccaacuucaaggccgagcggguuauugacccgagacgcuguaugaaacccgugauccugacggauggagaagaacgggugauucuugcuggcccuaugcccgucacacauuccucugccgcgcagagacgcgggcgggugggcagaaauccuaagaacgaaaaugaccaguacaucuacaugggagagccccuggaaaacgaugaggacugcgcucacuggaaagaggccaagaugcuccuggacaauaucaacaccccggaaggcauuaucccuagcauguuugagcccgaacgcgagaaaguugaugccauugacggggaauauagacugcggggagaggcucgcaagacauucguggaucucaugagacggggcgaccuuccugucuggcuggccuaccgcguggcggccgaggggaucaacuaugcugauagacggugguguuuugacggaguuaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcugggagaaaaucucucacgcugaaccugaucaccgagaugggccgccuccccacauuuaugacccagaaggcccggaaugcgcuugauaaccuggccgugcugcauacagcugaagccggaggcagagcuuauaaucacgcccucagcgagcugccggagacccuugaaacacugcuccugcugacccuccuugccacggucacagggggaaucuuccuguuucugauguccggcaaggggauuggaaaaaugacccucggcaugugcugcaucauuaccgcuagcauccugcuuugguacgcgcagauucagccucacuggaucgccgcuucuaucauucuggaguucuuucucaucgugcugcugauucccgaacccgagaagcaacggacaccucaggacaaccagcucaccuauguugugaucgccauucuuacaguggucgccgcuacgauggccaaugaaaugggcuuccuggagaaaaccaagaaagauuuugggcugggauccaucacaacccagcaaccggacagcaacauccucgauauugaccugcgccccgcguccgccuggacacuuuacgcuguugccaccacguucaucaccccuaugcugagacauucuauugagaauagcuccgugaacgugucucucacagcuaucgccaaucaggcgaccguccugaugggccuggggaagggauggccccucagcaagauggacauuggcgugccucuucuggccaucggguguuacucccagguuaaccccauuacacugaccgcugcccuccugcuucugguggcucacuaugccaucaucggaccuggccuccaggcuaaagccacgcgggaagcgcaaaagcgcgccgcugccggcauuaugaaaaucccggcugccgaugggaugacagucauugaccuggaucccaucccuuacgaccccaaguuugagaaacagcugggacaggugaugcuccuuguccugugcgugacccagguucugaugaugagaacaaccugggcccucugugaagcgcugacccuugcuacaggcccuauuagcacgcugugggaggggaaucccggacgguucuggaacaccacaaucgccgugucuauggcuaauaucuuucgcggcuccuaucucgccggggccggacugcuguucagcauuaugaagaacaccgcuaacacaagacggggcaccggcaauacgggggaaacacucggagagaaguggaaaaaccgccuuaaugcccugggcaagucugaguuucaaaucuacaaaaaguccgggauucaggaagucgauagaacccuggcgaaagagggaaucaagcggggcgaaaccgaccaucacgccgugagcagagggucugcuaaacuccgcugguucguugagcggaaccuggugacaccggagggaaaggucguggaucuuggcugcggcagagggggauggagcuauuacuguggcgggcugaagaaugugaaagaaguuaagggacucaccaaaggcgggccuggacaugaggaacccauucccauguccacauauggcuggaaccugguccgccugcagucuggcguggacguguucuuuacgccucccgagaagugcgauacccuccuuugugacaucggggaaagcuccccuaauccgacagucgaggccggacggacccugagaguucugaaccucguggagaauuggcugaacaauaacacacaauucugcaucaaagugcuuaaucccuacaugccuagcgucauugaaaagauggaggcucugcagcgcaaguacggcggggcccucgugcggaacccccuguccagaaauucuacccacgaaauguauuggguuagcaacgcguccggaaacaucgugucuagcgucaauaugauuucccgcaugcugaucaaccgguuuacgaugaaacacaagaaagccaccuacgagccugauguggaccucggcucugggacaagaaauauuggaaucgaaagcgagacccccaaccuugauaucauuggcaagcgcaucgagaaaauuaagcaggaacaugagacauccuggcacuaugaccaggaccauccguacaagaccugggcuuaucacggcagcuacgaaacaaaacaaaccgggucugccuccagcaugguuaauggagugguccggcugcugacgaagccuugggaugugauccccauggugacacagauggcuaugaccgacaccacaccuuucggccagcagagagucuuuaaagagaagguugauacgcgcacccaagaacccaaagaggggacaaagaagcucaugaaaauuaccgccgaguggcuguggaaggaacuuggcaaaaagaaaacaccuagaauguguacccgggaggaguucacacgcaaggugagaucuaacgcugcccugggcgcgaucuuuaccgacgagaauaaauggaaguccgcccgggaggcuguggaagauagcggguucugggagcucgucgacaaggaaagaaaccugcaccuggagggaaaaugcgaaacguguguguauaauaugaugggcaagcgggagaaaaagcucggcgaguuugggaaagccaagggaucucgcgcuauuugguacauguggcugggcgccagauuccuugaauuugaggcccugggguuccucaacgaagaucauugguuuucccgggagaauagccuguccggaguugaaggcgaggggcuucacaagcugggcuacauccuccgcgacgugagcaaaaaggagggaggcgcgauguaugcugaugacaccgccgggugggauacaagaaucacccuggaagaccugaaaaacgaggaaauggucacaaaucauauggagggagaacaccggaagcucgccgaggcuauuuuccgccugaccuaccagaacaaagugguuagagugcagcggcccacgccgcgcggcacagucauggacaucauuucuagacgggaucagcgcgggagcggacaagugguuaccuauggccuuaauacauucaccaacauggaggcccagcugaucagacagauggaaggggagggcguguuuaaguccauucaacaucucacggucaccgaagagaucgcugugaagaacuggcuggagcgggucggacgcgaaagacuuucucggauggccaucagcggcgacgauugcgugguuaaaccucuggacgauagauucgcguccgcccucacagcucugaaugacauggggaaggugcgcaaagauauucagcagugggagcccucucggggauggaacgacuggacccagguccccuuuugcagccaccacuuccaugaacugaucaugaaggauggcagagugcucgugguuccuugucgcaaucaagacgagcugauugggcgggccagaaucucccagggagcuggcuggucucuucgcgaaacagccugccuggggaaaagcuacgcgcagauguggucccucauguauuuucaccggagagaucugcgccuugccgcuaacgccauuuguagcgcugugccgucucauuggguccccaccucccggacaaccuggagcauccacgccacgcacgaguggaugacaaccgaggacaugcugaccguguggaauagaguuuggauccaggaaaacccuuggauggaggauaagacacccguggaaucuugggaggaaauuccuuaccucggcaagcgcgaggaccaauggugcggaucccugaucggccugaccagccgggcuacaugggccaaaaauauucagacggcgaucaaccaggucagaucccucauugggaaugaggaauauaccgacuacaugcccucuaugaagcgguucagacgcgaggaagaggaagccggagugcugugguga

SEQ ID NO: 19591 - RNA, 9876 nt, Artificial Sequence
  derived and/or modified CDS sequence (opt5) from DENV-2__KX380828__SS-prME
accgccggcgugaucauuaugcugauccccaccgcuauggccuuccaccucacgaccagaaacggggaaccucauaugauugucagccggcaggaaaagggaaaaucccugcuuuuuaagacagaggacggcguuaauaugugcacccugauggcgauggaucucggggaacugugugaggacacaaucaccuacaacugcccccuucugagacaaaaugaacccgaggauauugacuguuggugcaacucuacaagcaccugggugacguauggaaccuguacagcuaccggcgagcacagacgggaaaaacgcuccguggcccucgucccucauguggggaugggacuggagacaagaaccgaaacguggaugucuagcgagggcgccuggaagcacgcucagcggaucgagacauggauccugcgccaucccggcuucaccauuauggccgcuauccucgccuacacaauugggaccaccuauuuucagagaguucugaucuucauucuucugacagcgguggccccuuccaugacgaugcggugcaucggaauuucuaaucgcgauuuugucgaaggcgugagcgggggauccuggguugacaucgugcucgagcacggcagcugugucaccacaauggcuaaaaacaagcccacccuggauuucgaacuuaucaagacagaggccaaacagccugcuacccugagaaaguacugcauugaagccaaacucacgaauacaaccaccgcgucucgguguccgacacaaggggagcccucccugaacgaggaacaggacaagcgcuuugugugcaaacacagcaugguggauagaggauggggcaauggcugugggcuguucggaaagggcgggaucgugaccugcgccauguuuacaugcaagaaaaacauggagggaaagauuguucagccugaaaaucucgaguauacgaucguggugacaccccauucuggcgaagagaacgcugucgggaaugacacaggaaaacacggcaaggagauuaaagugaccccucaguccagcaucacagaagccgagcugaccggcuacgggacgguuaccauggaauguucuccccggacaggacuugauuucaacgagauggugcugcuccaaauggaaaauaaggcuuggcugguccaucgccagugguuucuugaccugccgcucccuuggcugcccggcgccgauacccagggguccaacuggauccagaaagagaugcuggugacauucaagaacccucacgccaagaaacaagacguugugguccucggaagccaggagggcgcuaugcacaccgcgcugacgggggccacagaaauucagauguccucuggcaaucuucuguuuaccggacaucucaagugcagacugcggauggacaaacuucaacugaagggcaugagcuauuccauguguacagggaaauucaagguggucaaggagaucgcugaaacccagcacggaaccauugugguuagagugcaguacgagggcgaugggagccccugcaaaauccccuucgagauuauggaccucgaaaagcgccauguccugggacggcugaucacagugaacccuaucguuacggagaaagauucuccggugaauauugaagccgagcccccuuuuggcgacuccuacaucauuaucggggucgaacccggccagcucaagcugagcugguucaaaaagggaucuagcauuggccaaauguuugagaccacaaugagaggggccaagcgcauggcuauccuuggagauaccgccugggacuucggcucccucggcgggguguuuacaucuauugggaaagcgcuccaccagguguucggggcuaucuauggcgccgccuuuagcggaguuuccuggaccaugaagauccugauuggcgucgugaucacguggauugggaugaacagccggucuacaucccugagcgugucucuuguccucgugggaguugugacccuguaccugggcgucauggugcaggcugauuccggguguguugugagcuggaaaaauaaggagcucaaaugcggauccggcaucuucauuaccgacaacguccauacauggaccgaacaguauaaguuucaaccugagucucccagcaagcuggccuccgcuauccagaaagcccacgaagaggggaucuguggcauuagaucugugacacgccuugaaaaucugauguggaagcagaucacgccggagcucaaccacauucugagcgagaaugaaguuaaacugaccaucaugacaggagauauuaagggcaucaugcaggcggggaaacggucccuuagaccucaacccaccgagcucaaguacagcuggaaaacauggggaaaggccaagaugcugucuaccgaaccucauaaccagacguuccugaucgacggccccgagaccgcugaaugcccuaauacaaaccgcgccuggaacucccucgagguggaggauuauggguuuggagucuucaccacaaacauuuggcugaaacuuaaggaacggcaggacguguuuugugacagcaaacugaugucugcugccaucaaggauaauagagcggugcacgccgacaugggcuacuggauugaguccgcucucaacgauaccuggaaaaucgaaaaggccagcuucauugaggucaagucuugccauuggcccaaaagccacacacugugguccaacggcguucuggagagcgaaaugaucaucccgaagaauuucgcugggccugugucucagcacaacuaucgccccggauaccauacccaaacggccggccccuggcaccuugggaaacucgagauggacuuugauuucugugaaggaacaaccguggucgugaccgaggacugcggcaaucgggggccuucccugagaacaaccacggccagcggaaagcugauuacagaauggugcugucgguccugcacccucccgccccugcgcuacaaaggcgaggauggcuguugguaugggauggagaucagaccucuuaaggaaaaggaggaaaaccugguuaauucucucgugacagcuggacauggccagauugacaacuuuagccuggggguccugggaauggcgcuuuuccucgaggaaaugcugcggaccagagugggcacaaaacacgccguucugcucguggcugucuccuuuaugacccugaucacggggaauaugucuuuccgcgaucuuggacgggugaugguuauggugggcgccgccaugaccgacgauauuggcaugggggucacauaccuggcucuccuggccgcguuuaaggugagacccaccuucgcugccggacugcuucugcgcaaacucacaagcaaggagcugaugaugaccacgaucggcauugugcuccugucccagucuacaaucccugagaccauccuugaacugacagacgcccucgcucuggggaugaugauucugaaaaucgucagaaacauggagaaguaucaacuugccguuaccauuauggcgauccugugcgcucccaaugccgugauucuccagaacgccuggaaggugagcuguaccauccuggcugucguguccguuagcccucuccugcuuacaucuucccagcagaaagccgauuggaucccccuggcucucacgauuaagggacugaauccgaccgccaucuuucugacaacccuuagccggacaaacaaaaagcgcucuuggccucugaaugaagcgauuauggccgugggcauggucuccauccucgcuagcucucugcucaaaaacgacauucccaugaccgggccucugguggccggaggccuucugacgguuugcuacgugcugacaggcagauccgcugaccucgagcuggaacgggccgccgauguccgcugggaggaccaagcugagaucagcggguccagccccauccuuucuauuaccaucagcgaagauggauccaugucuauuaagaaugaggaagaggagcagacccugacaauccucauuagaaccggccugcucgugaucagcgggcuguucccggucuccauuccuaucacagcggccgcuugguaucuuugggaagugaaaaagcagcgggccggaguucugugggacgugcccucuccuccgcccgucggcaaggccgagcuggaagauggggcuuaccgcaucaaacagaaggggauucugggcuauagccaaaucggcgccgggguguacaaagagggaacguuucauaccauguggcacguuacaagaggcgcggugcugaugcacaaggggaaacggauugaaccuuccugggcugacguccgcaaggaucuuaucucuuacggaggcggguggaagcuggagggagaguggaaagaaggcgaggaaguccaggugcucgcccuggagccgggcaagaaccccagagccguucagaccaaaccuggacucuucaagacaaacaccggaacgauuggcgcugucagccuggacuuuucccccgggaccagcggaucuccuaucguggauaaaaagggcaagguggucgggcuuuauggaaauggcgugguuacacgguccggcaccuacgugagcgccaucgcgcagacagaaaaaucuauugaggacaaccccgagaucgaagaugacauuuucagaaagaaacgccugaccaucauggaucugcauccuggggcuggaaagacaaaacgguaucucccggccauugucagagaggccaucaagcgcggccugcggacgcuuauccuggcucccaccagagugguugccgcugaaauggaggaagcccuccgcgggcugccuauucgguaccaaacacccgcgaucagagccgagcacaccggacgcgagauuguggaccucaugugucaugcuaccuucacaaugcggcugcuuuccccugucagagugcccaauuauaaccugaucauuauggacgaagcccacuuuacggauccggcuagcaucgccgcccggggcuacauuuccacccgcguugagaugggggaagcugcgggcaucuucaugacagccaccccucccggaucuagagaccccuuuccucagagcaaugcucccaucauggaugaggagcgggaaauuccugagcgcuccuggaacagcggccaugaaugggugacagacuucaaggggaaaaccgucugguuugugccgucuaucaaggccggaaaugauauugccgcuugccugcgcaaaaauggcaagaaagugauccagcucucccggaagacguucgacagcgaguauauuaagacaagaaccaaugauugggacuuugucguuaccacagauaucucugaaaugggggccaacuucaaagcggagcgcgugaucgacccccggagauguaugaagccugugauucugaccgauggagaggaacgcgucauccuugcuggccccaugccugugacacacagcuccgccgcccaacggagagggcgcauuggccggaaucccaaaaacgagaaugaccaguacaucuacaugggagaaccgcuggagaacgacgaagauugcgcucacuggaaggaggccaaaaugcuccuggacaauauuaacaccccugagggcaucauccccucuauguuugaaccugagagagaaaagguugaugcgauugacggggaguaucgccugagaggagaagcccggaaaacguucguggagcucaugcgcagaggcgaucuucccgucuggcuggcuuaccggguggccgcugaggggaucaacuaugccgaccgcagaugguguuuugauggaauuaagaauaaccagauccuggaagagaauguugaaguggagauuuggacaaaggagggcgagaaaaagaaacucaagccucgguggcuggacgcuagaaucuacagcgauccccuugcccugaaagaguucaaggaguucgcggccgggcgcaagucccucaccaugaaccugauuacagagaugggccggcugccgaccuuuaugacgcagaaagcuagaaaugcccucgacaaccuugcuguccugcauaccgccgaagccggaggccgcgcuuauaaucacgcgcugucugagcucccugagacacuggaaacccuucugcuccugacacugcucgccaccgugacagggggaaucuuccuuuuucugaugagcggcaaggggaucggaaaaaugacccugggcaugugcugcauuaucacggcuuccauucuccugugguacgcccaaauccagccccauuggauugccgcuagcaucauccuugaguucuuucugauuguccuccugauccccgaaccugagaagcagcggacaccgcaggauaaccaacugaccuaugugguuauugccauccucaccgugguggcggccacaauggcuaaugaaaugggcuuccuugagaaaaccaagaaggacuuugggcugggaucuauugucgcccagcagcccgaguccaacauccuggauaucgaccucagaccugcuagcgccuggacacuguacgcgguugccacgaccuucauuacacccaugcuucggcacuccaucgaaaauucuagcgugaacgugucccugaccgcuauugccaaucaggcuacaguccucaugggccuggggaaaggauggccucugucuaagauggacaucggcgugccccuccuugccauuggguguuacagccaaguuaacccuaucacccugacggcugcccugcuccugcuuguggcgcacuaugccauuaucggaccgggccugcaggcuaaagccacccgcgaggcucagaagagagccgccgcgggcaucaugaaaauucccacagucgaugggaucaccgugauugaccucgauccuauccccuacgacccuaaguuugaaaagcagcugggacaagucaugcugcucgugcuuugcguuacacaggugcugaugaugcggaccacgugggcucugugugaggcccucacacuggcuaccggccccauuuccacacuuugggaagggaauccgggacgcuucuggaacaccaccaucgccgucagcauggccaauaucuuuagaggcucuuaucuggcuggggccggacuccuguucuccauuaugaaaaacacaacgaacacccggcgcggcacaggcaauaccggggagacacugggagagaaguggaaaaacagacucaauagccuuggcaagucugaauuucagaucuacaaacgguccgggauucaagagguggaucgcacccuggcgaaggaaggaaucaaaagaggcgagacggaccaucacgccguuagccgggggucugcuaagcugagaugguucguggagcgcaaccucgucacaccugaaggaaaggugauggaucugggcugcggcagagggggauggagcuauuacuguggcgggcuuaaaaaugugcgggagguuaagggacugaccaaaggcgggcccggacaugaagaacccauuccuauguccaccuauggcuggaaccucguccgccugcagucuggcguggacguguucuuuacacccccugaaaagugcgauacccugcucugugacaucggggagagcuccccgaaucccacagucgaggccggacggacgcuuagaguucugaaccugguggaaaauuggcucaacaauaacacccaguucugcaucaaagugcugaauccuuacaugcccagcgucauugagaagauggaaacacuucagcgcaaguacggcggggcucuggugcggaacccucucuccagaaauucuacccacgagauguauuggguuagcaacgccuccggaaacaucgugucuagcgucaauaugauuucccgcaugcugaucaaccgguuuacaaugagacauaaaaaggcgaccuacgaacccgauguggaccugggcucugggacgcgcaauauuggaaucgagagcgagaccccgaaccucgauaucauuggcaaacggaucgaaaagauuaaacaagagcacgaaacauccuggcacuaugaccaggaccauccuuacaagaccugggccuaucacggcagcuacgagacaaagcagaccgggucugcuuccagcaugguuaauggaguggucagacuucugacaaaacccugggaugugaucccuauggugacccagauggccaugacggacacaacccccuucggccaacagcgcgucuuuaaggaaaaaguugauaccagaacacaggagccuaaggaggggacgaaaaagcugaugaagauuaccgcugaauggcucuggaaagagcugggaaagaaaaagacaccccggauguguacccgcgaagaguucacaagaaaagugcggucuaacgccgcucuuggcgccaucuuuaccgacgagaauaaguggaaauccgcgagagaagccguggaggauagccgguucugggaacuggucgacaaggagcgcaaccuccaucuggaagggaagugcgagacauguguguauaauaugaugggaaaaagagagaagaaaauuggcgaauuuggccgggcuaaggggucucgcgccaucugguacauguggcugggagcuagauuccucgaguuugaagcccugggcuuccuuaacgaggaucacugguuuucccgggaaaauagccuguccgggguugagggagagggccuccacaaacugggguacauccuucgcgaagugagcaagaaggagggcggagccauguaugcggacgauaccgcuggcugggacacgagaauuacccuggaagaucucaaaaacgaggaaauggucacaaaucauauggagggggagcacaagaaacuggccgaagccaucuucaagcugaccuaccagaacaaagugguucgggugcaacgcccgacaccuagaggaaccgucauggacauuaucucucggcgcgaccagagaggcagcggacaggugggaacguauggccucaauacauucaccaacaugggggcucaacugauucggcagauggagggcgaaggaguuuuuaaguccauccagcaucuuacaaccacggaggagguggccguccaggauuggcuggcucgcgugggcagagaacggcucucuagaauggccaucagcggggacgauugcgucgugaagccccuggacgaucgcuucgcguccgcccuuaccgcucugaacgacaugggaaaaguucggaaggauauucaacagugggagcccucuaaaggcuggaaugacuggacacaggugccuuuuugcagccaccauuuccacgaacucaucaugaaggaugggagaguccugguggugccgugucgcaaccaggacgagcugauuggacgggccagaaucucccaaggcgcuggguggucucuccgcgaaaccgccugccugggcaaaagcuacgcgcagauguggucccuuauguauuuucaccggagagaucugcgccucgccgcuaaugccauuuguagcgcuguucccucucauugggugccuacaucccggaccacauggagcauccacgccagacaugaguggaugaccacggaggacaugcugacagucuggaaccgcguguggauccaggaaaaucccuggauggaggauaagaccccuguugaaucuugggaggaaauucccuaccuuggaaagcgggaggaccaguggugcggcucccugaucgggcucaccagcagagcuacaugggccaaaaacauucaaaccgcgaucaaucaggugcggucccugauuggaucugaggaauauacagacuacaugccuagcaugaagagauuccgccgggaggaagaggaagccggcguccugugguga

SEQ ID NO: 19592 - RNA, 9876 nt, Artificial Sequence
  derived and/or modified CDS sequence (opt5) from DENV-2__KX380829__SS-prME
accgccggcgugaucauuaugcugauccccaccgcuauggccuuccaccucacgaccagaaacggggaaccucauaugauugucagccggcaggaaaagggaaaaucccugcuuuuuaagacagaggacggcguuaauaugugcacccugauggcgauggaucucggggaacugugugaggacacaaucaccuacaacugcccccuucugagacaaaaugaacccgaggauauugacuguuggugcaacucuacaagcaccugggugacguauggaaccuguacagcuaccggcgagcacagacgggaaaaacgcuccguggcccucgucccucauguggggaugggacuggagacaagaaccgaaacguggaugucuagcgagggcgccuggaagcacgcucagcggaucgagacauggauccugcgccaucccggcuucaccauuauggccgcuauccucgccuacacaauugggaccaccuauuuucagagaguucugaucuucauucuucugacagcgguggccccuuccaugacgaugcggugcaucggaauuucuaaucgcgauuuugucgaaggcgugagcgggggauccuggguugacaucgugcucgagcacggcagcugugucaccacaauggcuaaaaacaagcccacccuggauuucgaacuuaucaagacagaggccaaacagccugcuacccugagaaaguacugcauugaagccaaacucacgaauacaaccaccgcgucucgguguccgacacaaggggagcccucccugaacgaggaacaggacaagcgcuuugugugcaaacacagcaugguggauagaggauggggcaauggcugugggcuguucggaaagggcgggaucgugaccugcgccauguuuacaugcaagaaaaacauggagggaaagauuguucagccugaaaaucucgaguauacgaucguggugacaccccauucuggcgaagagaacgcugucgggaaugacacaggaaaacacggcaaggagauuaaagugaccccucaguccagcaucacagaagccgagcugaccggcuacgggacgguuaccauggaauguucuccccggacaggacuugauuucaacgagauggugcugcuccaaauggaaaauaaggcuuggcugguccaucgccagugguuucuugaccugccgcucccuuggcugcccggcgccgauacccagggguccaacuggauccagaaagagaugcuggugacauucaagaacccucacgccaagaaacaagacguugugguccucggaagccaggagggcgcuaugcacaccgcgcugacgggggccacagaaauucagauguccucuggcaaucuucuguuuaccggacaucucaagugcagacugcggauggacaaacuucaacugaagggcaugagcuauuccauguguacagggaaauucaagguggucaaggagaucgcugaaacccagcacggaaccauugugguuagagugcaguacgagggcgaugggagccccugcaaaauccccuucgagauuauggaccucgaaaagcgccauguccugggacggcugaucacagugaacccuaucguuacggagaaagauucuccggugaauauugaagccgagcccccuuuuggcgacuccuacaucauuaucggggucgaacccggccagcucaagcugagcugguucaaaaagggaucuagcauuggccaaauguuugagaccacaaugagaggggccaagcgcauggcuauccuuggagauaccgccugggacuucggcucccucggcgggguguuuacaucuauugggaaagcgcuccaccagguguucggggcuaucuauggcgccgccuuuagcggaguuuccuggaccaugaagauccugauuggcgucgugaucacguggauugggaugaacagccggucuacaucccugagcgugucucuuguccucgugggaguugugacccuguaccugggcgucauggugcaggcugauuccggguguguugugagcuggaaaaauaaggagcucaaaugcggauccggcaucuucauuaccgacaacguccauacauggaccgaacaguauaaguuucaaccugagucucccagcaagcuggccuccgcuauccagaaagcccacgaagaggggaucuguggcauuagaucugugacacgccuugaaaaucugauguggaagcagaucacgccggagcucaaccacauucugagcgagaaugaaguuaaacugaccaucaugacaggagauauuaagggcaucaugcaggcggggaaacggucccuuagaccucaacccaccgagcucaaguacagcuggaaaacauggggaaaggccaagaugcugucuaccgaaccucauaaccagacguuccugaucgacggccccgagaccgcugaaugcccuaauacaaaccgcgccuggaacucccucgagguggaggauuauggguuuggagucuucaccacaaacauuuggcugaaacuuaaggaacggcaggacguguuuugugacagcaaacugaugucugcugccaucaaggauaauagagcggugcacgccgacaugggcuacuggauugaguccgcucucaacgauaccuggaaaaucgaaaaggccagcuucauugaggucaagucuugccauuggcccaaaagccacacacugugguccaacggcguucuggagagcgaaaugaucaucccgaagaauuucgcugggccugugucucagcacaacuaucgccccggauaccauacccaaacggccggccccuggcaccuugggaaacucgagauggacuuugauuucugugaaggaacaaccguggucgugaccgaggacugcggcaaucgggggccuucccugagaacaaccacggccagcggaaagcugauuacagaauggugcugucgguccugcacccucccgccccugcgcuacaaaggcgaggauggcuguugguaugggauggagaucagaccucuuaaggaaaaggaggaaaaccugguuaauucucucgugacagcuggacauggccagauugacaacuuuagccuggggguccugggaauggcgcuuuuccucgaggaaaugcugcggaccagagugggcacaaaacacgccguucugcucguggcugucuccuuuaugacccugaucacggggaauaugucuuuccgcgaucuuggacgggugaugguuauggugggcgccgccaugaccgacgauauuggcaugggggucacauaccuggcucuccuggccgcguuuaaggugagacccaccuucgcugccggacugcuucugcgcaaacucacaagcaaggagcugaugaugaccacgaucggcauugugcuccugucccagucuacaaucccugagaccauccuugaacugacagacgcccucgcucuggggaugaugauucugaaaaucgucagaaacauggagaaguaucaacuugccguuaccauuauggcgauccugugcgcucccaaugccgugauucuccagaacgccuggaaggugagcuguaccauccuggcugucguguccguuagcccucuccugcuuacaucuucccagcagaaagccgauuggaucccccuggcucucacgauuaagggacugaauccgaccgccaucuuucugacaacccuuagccggacaaacaaaaagcgcucuuggccucugaaugaagcgauuauggccgugggcauggucuccauccucgcuagcucucugcucaaaaacgacauucccaugaccgggccucugguggccggaggccuucugacgguuugcuacgugcugacaggcagauccgcugaccucgagcuggaacgggccgccgauguccgcugggaggaccaagcugagaucagcggguccagccccauccuuucuauuaccaucagcgaagauggauccaugucuauuaagaaugaggaagaggagcagacccugacaauccucauuagaaccggccugcucgugaucagcgggcuguucccggucuccauuccuaucacagcggccgcuugguaucuuugggaagugaaaaagcagcgggccggaguucugugggacgugcccucuccuccgcccgucggcaaggccgagcuggaagauggggcuuaccgcaucaaacagaaggggauucugggcuauagccaaaucggcgccgggguguacaaagagggaacguuucauaccauguggcacguuacaagaggcgcggugcugaugcacaaggggaaacggauugaaccuuccugggcugacguccgcaaggaucuuaucucuuacggaggcggguggaagcuggagggagaguggaaagaaggcgaggaaguccaggugcucgcccuggagccgggcaagaaccccagagccguucagaccaaaccuggacucuucaagacaaacaccggaacgauuggcgcugucagccuggacuuuucccccgggaccagcggaucuccuaucguggauaaaaagggcaagguggucgggcuuuauggaaauggcgugguuacacgguccggcaccuacgugagcgccaucgcgcagacagaaaaaucuauugaggacaaccccgagaucgaagaugacauuuucagaaagaaacgccugaccaucauggaucugcauccuggggcuggaaagacaaaacgguaucucccggccauugucagagaggccaucaagcgcggccugcggacgcuuauccuggcucccaccagagugguugccgcugaaauggaggaagcccuccgcgggcugccuauucgguaccaaacacccgcgaucagagccgagcacaccggacgcgagauuguggaccucaugugucaugcuaccuucacaaugcggcugcuuuccccugucagagugcccaauuauaaccugaucauuauggacgaagcccacuuuacggauccggcuagcaucgccgcccggggcuacauuuccacccgcguugagaugggggaagcugcgggcaucuucaugacagccaccccucccggaucuagagaccccuuuccucagagcaaugcucccaucauggaugaggagcgggaaauuccugagcgcuccuggaacagcggccaugaaugggugacagacuucaaggggaaaaccgucugguuugugccgucuaucaaggccggaaaugauauugccgcuugccugcgcaaaaauggcaagaaagugauccagcucucccggaagacguucgacagcgaguauauuaagacaagaaccaaugauugggacuuugucguuaccacagauaucucugaaaugggggccaacuucaaagcggagcgcgugaucgacccccggagauguaugaagccugugauucugaccgauggagaggaacgcgucauccuugcuggccccaugccugugacacacagcuccgccgcccaacggagagggcgcauuggccggaaucccaaaaacgagaaugaccaguacaucuacaugggagaaccgcuggagaacgacgaagauugcgcucacuggaaggaggccaaaaugcuccuggacaauauuaacaccccugagggcaucauccccucuauguuugaaccugagagagaaaagguugaugcgauugacggggaguaucgccugagaggagaagcccggaaaacguucguggagcucaugcgcagaggcgaucuucccgucuggcuggcuuaccggguggccgcugaggggaucaacuaugccgaccgcagaugguguuuugauggaauuaagaauaaccagauccuggaagagaauguugaaguggagauuuggacaaaggagggcgagaaaaagaaacucaagccucgguggcuggacgcuagaaucuacagcgauccccuugcccugaaagaguucaaggaguucgcggccgggcgcaagucccucaccaugaaccugauuacagagaugggccggcugccgaccuuuaugacgcagaaagcuagaaaugcccucgacaaccuugcuguccugcauaccgccgaagccggaggccgcgcuuauaaucacgcgcugucugagcucccugagacacuggaaacccuucugcuccugacacugcucgccaccgugacagggggaaucuuccuuuuucugaugagcggcaaggggaucggaaaaaugacccugggcaugugcugcauuaucacggcuuccauucuccugugguacgcccaaauccagccccauuggauugccgcuagcaucauccuugaguucuuucugauuguccuccugauccccgaaccugagaagcagcggacaccgcaggauaaccaacugaccuaugugguuauugccauccucaccgugguggcggccacaauggcuaaugaaaugggcuuccuugagaaaaccaagaaggacuuugggcugggaucuauugucgcccagcagcccgaguccaacauccuggauaucgaccucagaccugcuagcgccuggacacuguacgcgguugccacgaccuucauuacacccaugcuucggcacuccaucgaaaauucuagcgugaacgugucccugaccgcuauugccaaucaggcuacaguccucaugggccuggggaaaggauggccucugucuaagauggacaucggcgugccccuccuugccauuggguguuacagccaaguuaacccuaucacccugacggcugcccugcuccugcuuguggcgcacuaugccauuaucggaccgggccugcaggcuaaagccacccgcgaggcucagaagagagccgccgcgggcaucaugaaaaaucccacagucgaugggaugaccgugauugaccucgauccuauccccuacgacccuaaguuugaaaagcagcugggacaagucaugcugcucgugcuuugcguuacacaggugcugaugaugcggaccacgugggcucugugugaggcccucacacuggcuaccggccccauuuccacacuuugggaagggaacccgggacgcuucuggaauaccaccaucgccgucagcauggccaacauuuuuagaggcucuuaucuggcuggggccggacuccuguucuccaucaugaaaaacacaacgaauacccggcgcggcacaggcaacaccggggagacacugggagagaaguggaaaaauagacucaacagccuuggcaagucugaauuucagaucuacaaacgguccgggauucaagagguggaucgcacccuggcgaaggaaggaaucaaaagaggcgagacggaccaucacgccguuagccgggggucugcuaagcugagaugguucguggagcgcaaucucgucacaccugaaggaaaggugauggaucugggcugcggcagagggggauggagcuauuacuguggcgggcuuaaaaacgugcgggagguuaagggacugaccaaaggcgggcccggacaugaagaacccauuccuauguccaccuauggcuggaaucucguccgccugcagucuggcguggacguguucuuuacacccccugaaaagugcgauacccugcucugugacaucggggagagcuccccgaaccccacagucgaggccggacggacgcuuagaguucugaaucugguggaaaacuggcucaauaacaauacccaguucugcauuaaagugcugaacccuuacaugcccagcgucaucgagaagauggaaacacuucagcgcaaguacggcggggcucuggugcggaauccucucuccagaaacucuacccacgagauguauuggguuagcaacgccuccggaaauaucgugucuagcgucaacaugauuucccgcaugcugaucaaucgguuuacaaugagacauaaaaaggcgaccuacgaacccgauguggaccugggcucugggacgcgcaacauuggaaucgagagcgagaccccgaaucucgauauuaucggcaaacggaucgaaaagauuaaacaagagcacgaaacauccuggcacuaugaccaggaccauccuuacaagaccugggccuaucacggcagcuacgagacaaagcagaccgggucugcuuccagcaugguuaacggaguggucagacuucugacaaaacccugggaugugaucccuauggugacccagauggccaugacggacacaacccccuucggccaacagcgcgucuuuaaggaaaaaguugauaccagaacacaggagccuaaggaggggacgaaaaagcugaugaagauuaccgcugaauggcucuggaaagagcugggaaagaaaaagacaccccggauguguacccgcgaagaguucacaagaaaagugcggucuaaugccgcucuuggcgccaucuuuaccgacgagaacaaguggaaauccgcgagagaagccguggaggauagccgguucugggaacuggucgacaaggagcgcaaucuccaucuggaagggaagugcgagacauguguguauaacaugaugggaaaaagagagaagaaaauuggcgaauuuggccgggcuaaggggucucgcgccaucugguacauguggcugggagcuagauuccucgaguuugaagcccugggcuuccuuaaugaggaucacugguuuucccgggaaaacagccuguccgggguugagggagagggccuccacaaacugggguacauucuucgcgaagugagcaagaaggagggcggagccauguaugcggacgauaccgcuggcugggacacgagaaucacccuggaagaucucaaaaaugaggaaauggucacaaaccauauggagggggagcacaagaaacuggccgaagccaucuucaagcugaccuaccagaauaaagugguucgggugcaacgcccgacaccuagaggaaccgucauggacauuaucucucggcgcgaccagagaggcagcggacaggugggaacguauggccucaacacauucaccaacaugggggcucaacugauucggcagauggagggcgaaggaguuuuuaaguccauccagcaucuuacaaccacggaggagguggccguccaggauuggcuggcucgcgugggcagagaacggcucucuagaauggccauuagcggggacgauugcgucgugaagccccuggacgaucgcuucgcguccgcccuuaccgcucugaaugacaugggaaaaguucggaaggauauccaacagugggagcccucuaaaggcuggaacgacuggacacaggugccuuuuugcagccaccauuuccacgaacucaucaugaaggaugggagaguccugguggugccgugucgcaaucaggacgagcugauuggacgggccagaaucucccaaggcgcuggguggucucuccgcgaaaccgccugccugggcaaaagcuacgcgcagauguggucccuuauguauuuucaccggagagaucugcgccucgccgcuaacgccauuuguagcgcuguucccucucauugggugccuacaucccggaccacauggagcauccacgccagacaugaguggaugaccacggaggacaugcugacagucuggaaucgcguguggauucaggaaaaccccuggauggaggauaagaccccuguugaaucuugggaggaaauccccuaccuuggaaagcgggaggaccaguggugcggcucccugaucgggcucaccagcagagcuacaugggccaaaaauauucaaaccgcgaucaaccaggugcggucccugauuggaucugaggaauauacagacuacaugccuagcaugaagagauuccgccgggaggaagaggaagccggcguccugugguga

SEQ ID NO: 19593 - RNA, 9876 nt, Artificial Sequence
  derived and/or modified CDS sequence (opt5) from DENV-2__KX380830__SS-prME
accgccggaaucauuaucaugaugauucccaccgugauggcuuuccaccugacgaccagaaacggggaaccucauaugaucgugagccggcaggaaaaggggaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuauggcgauccugugcguuccuaacgcugugauccuccagaaugccuggaaagugagcuguacaauucuggccgucguguccguuagcccccuccugcuuacgucuucccaacagaaggcugacuggaucccucuggcccucaccauuaagggacugaaccccacagcuaucuuucugaccacacuuagcagaaccucuaaaaagcgguccuggccgcugaaugaagccauuauggcggugggcauggucagcauccucgccucuucccugcucaaaaacgauaucccuaugacggggccccugguggcuggaggccuucugacaguuugcuacgugcugaccggccgcagcgccgaccucgagcuggaaagagcugccgacguccggugggaggagcaggccgaaauuuccgggagcucuccuauccuuagcauuaccaucuccgaggauggaucuaugagcauuaagaaugaagaggaggaacagacacugaccauccucauucgcacaggccugcucgugaucuccgggcuguuccccgucucuaucccgauuacggcugcggccugguaucuuugggaggugaaaaagcaaagagcuggaguucugugggacgugccuucucccccucccgucggcaaagccgaacuggaggauggggccuaccggaucaagcagaagggcauucucggcuauucccagaucggcgcugggguguacaaagaaggaaccuuucacacaauguggcauguuacccgcggcgccgugcugaugcacaaggggaaaagaauugagcccuccugggcggacgucaagaaagaucuuaucagcuacggaggcggguggaagcuggagggagaauggaaggagggcgaagagguccaggugcucgcucuggaaccuggcaaaaacccgcgggccguucaaacaaagcccggacucuucaaaaccaacacgggaaccaucggcgccgucucccuggacuuuagcccugggacaucuggaucccccauuguggauaagaaaggcaagguggucgggcuuuauggaaauggcgugguuaccagaagcggcacauacgugucugcuaucgcccagaccgagaaguccauugaggacaacccugaaaucgaggaugacauuuuccgcaaaaagcggcugacaaucauggaucugcaucccggggcgggaaaaacgaagagauaucucccugcuaucguccgcgaagccauuaaacggggccugagaacccuuauccuggccccgacacgcgugguugcugccgagauggaagaggcucuccgggggcugcccauuagauaccagaccccugccauccgcgcggagcacaccggacgggaaauuguggaccucaugugucaugccacauucacgaugagacugcuuagccccauccgggucccuaauuauaaccugauuaucauggaugaggcucacuuuaccgaccccgccuccaucgcugcccgcggcuacauuucuacaagaguggaaaugggggaggccgcuggcaucuucaugaccgcgacaccgccuggaagccgggaccccuuuccccaguccaaugccccuauuauggaugaggaacgcgagauccccgaaagaagcuggaacucuggccacgaguggguuaccgacuucaaggggaagacggugugguuugucccuuccauuaaagcuggaaaugauaucgccgccugccugcggaagaacggcaaaaaggugauccaacucagcagaaaaacauucgacucugaauauauuaagacccgcaccaaugauugggacuuuguggucacaaccgauaucagcgagaugggggcuaacuucaaggccgagcggguuauugacccgagacgcuguaugaaacccgugauccugacagauggagaagaacgggugauucuugcgggcccuaugcccgucacccauuccucugcugcccagagacgcgggcgggugggcagaaauccuaagaacgaaaaugaccaguacaucuacaugggagagccccuggaaaacgaugaggacugcgcccacuggaaagaggcuaagaugcuccuggacaauaucaacacgccggaaggcauuaucccuagcauguuugagcccgaacgcgagaaaguugaugccauugacggggaauauagacugcggggagaggcgcgcaagacauucguggaucucaugagacggggcgaccuuccugucuggcuggccuaccgcguggcugccgaggggaucaacuaugcugauagacggugguguuuugacggaguuaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcggggagaaaaucucucacacugaaccugaucaccgagaugggccgccuccccacguuuaugacccagaaggcccggaaugcucuugauaaccuggccgugcugcauacagcugaagccggaggcagagccuauaaucacgcucucagcgagcugccggagacccuugaaacacugcuccugcugacccuccuugcgacagucaccgggggaaucuuccuguuucugauguccggcaaggggauuggaaaaaugacgcucggcaugugcugcaucauuacagccagcauccugcuuugguacgcucagauucagccucacuggaucgccgccucuaucauucuggaguucuuucucaucgugcugcugauucccgaacccgagaagcaacggaccccucaggacaaccagcucaccuauguugugaucgcuauucuuacaguggucgccgcgaccauggccaaugaaaugggcuuccuggagaaaacaaagaaagauuuugggcugggauccaucacgacccagcaaccggacagcaacauccucgauauugaccugcgccccgcuuccgccuggacacuuuacgcuguugccaccacauucaucaccccuaugcugagacauucuauugagaauagcuccgugaacgugucucucacggcgaucgccaaucaggcuaccguccugaugggccuggggaagggauggccccucagcaagauggacauuggcgugccucuucuggccaucggguguuacucccagguuaaccccauuacacugaccgcugcccuccugcuucugguggcucacuaugccaucaucggaccuggccuccaggcgaaagccacacgggaagcucaaaagcgcgccgcugccggcauuaugaaaaucccggccgcggaugggaugaccgucauugaccuggaucccaucccuuacgaccccaaguuugagaaacagcugggacaggugaugcuccuuguccugugcgugacgcagguucugaugaugagaacaaccugggcucucugugaagcccugacacuugcuaccggcccuauuagcacccugugggaggggaaucccggacgguucuggaacacaacgaucgccgugucuauggccaauaucuuucgcggcuccuaucucgcuggggccggacugcuguucagcauuaugaagaacaccgcgaacacaagacggggcaccggcaauacaggggaaacccucggagagaaguggaaaaaccgccuuaaugcccugggcaagucugaguuucaaaucuacaaaaaguccgggauucaggaagucgauagaacgcuggcuaaagagggaaucaagcggggcgaaacagaccaucacgccgugagcagagggucugcuaaacuccgcugguucguugagcggaaccuggugaccccggagggaaaggucguggaucuuggcugcggcagagggggauggagcuauuacuguggcgggcugaagaaugugaaagaaguuaagggacucaccaaaggcgggccuggacaugaggaacccauucccauguccacauauggcuggaaccugguccgccugcagucuggcguggacguguucuuuaccccucccgagaagugcgauacacuccuuugugacaucggggaaagcuccccuaauccgacggucgaggccggacggacccugagaguucugaaccucguggagaauuggcugaacaauaacacacaauucugcaucaaagugcuuaaucccuacaugccuagcgucauugaaaagauggaggcgcugcagcgcaaguacggcggggcccucgugcggaacccccuguccagaaauucuacccacgaaauguauuggguuagcaacgcuuccggaaacaucgugucuagcgucaauaugauuucccgcaugcugaucaaccgguuuacaaugaaacacaagaaagccaccuacgagccugauguggaccucggcucugggacgagaaauauuggaaucgaaagcgagacccccaaccuugauaucauuggcaagcgcaucgagaaaauuaagcaggaacaugagacauccuggcacuaugaccaggaccauccguacaagaccugggcuuaucacggcagcuacgaaacaaaacaaaccgggucugccuccagcaugguuaauggagugguccggcugcugacaaagccuugggaugugauccccauggugacccagauggcuaugacggacacaaccccuuucggccagcagagagucuuuaaagagaagguugauacccgcacacaagaacccaaagaggggacgaagaagcucaugaaaauuaccgccgaguggcuguggaaggaacuuggcaaaaagaaaacaccuagaauguguacccgggaggaguucacacgcaaggugagaucuaacgcggcccugggcgcuaucuuuaccgacgagaauaaauggaaguccgcccgggaggcuguggaagauagcggguucugggagcucgucgacaaggaaagaaaccugcaccuggagggaaaaugcgaaacauguguguauaauaugaugggcaagcgggagaaaaagcucggcgaguuugggaaagccaagggaucucgcgccauuugguacauguggcugggcgcgagauuccuugaauuugaggcucugggguuccucaacgaagaucauugguuuucccgggagaauagccuguccggaguugaaggcgaggggcuucacaagcugggcuacauccuccgcgacgugagcaaaaaggagggaggcgccauguaugccgaugacaccgcugggugggauacgagaaucacccuggaagaccugaaaaacgaggaaauggucacaaaucauauggagggagaacaccggaagcucgccgaggcuauuuuccgccugaccuaccagaacaaagugguuagagugcagcggcccacaccgcgcggcaccgucauggacaucauuucuagacgggaucagcgcgggagcggacaagugguuacguauggccuuaauacauucaccaacauggaggcccagcugaucagacagauggaaggggagggcguguuuaaguccauucaacaucucacagucaccgaagagaucgcggugaagaacuggcuggagcgggucggacgcgaaagacuuucucggauggccaucagcggcgacgauugcgugguuaaaccucuggacgauagauucgcuuccgcccucacggcucugaaugacauggggaaggugcgcaaagauauucagcagugggagcccucucggggauggaacgacuggacccagguccccuuuugcagccaccacuuccaugaacugaucaugaaggauggcagagugcucgugguuccuugucgcaaucaagacgagcugauugggcgggccagaaucucccagggagcgggcuggucucuucgcgaaacagccugccuggggaaaagcuacgcucagauguggucccucauguauuuucaccggagagaucugcgccuugccgcuaacgccauuuguagcgcugugccgucucauuggguccccaucucccggaccacauggagcauccacgccacccacgaguggaugacaaccgaggacaugcugacgguguggaauagaguuuggauucaggaaaacccuuggauggaggauaagacacccguggaaucuugggaggaaaucccuuaccucggcaagcgcgaggaccaauggugcggaucccugauuggccugaccagccgggcgaccugggccaaaaauauccagacagcuauuaaccaggucagaucccucaucgggaaugaggaauauaccgacuacaugcccucuaugaagcgguucagacgcgaggaagaggaagccggagugcugugguga

SEQ ID NO: 19594 - RNA, 9876 nt, Artificial Sequence
  derived and/or modified CDS sequence (opt5) from DENV-2__KX380831__SS-prME
accgccggaaucauuaucaugaugauucccaccgugauggcuuuccaccugacgaccagaaauggggagccucauaugaucgucagccggcaggaaaagggaaaaucccuccuguuuaagaccgagaauggcguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaccucaugagcgcugccauuaaagacaacagagcggugcacgccgauaugggcuacuggaucgagucugcucugaaugacacauggaagauugaaaaagccuccuucaucgaggucaagagcugccacuggcccaagucucauacccuguggagcaacggcguucuugaguccgaaaugaucauuccuaaaaauuucgcugggcccgugagccagcacaacuaucgcccgggauaccauacgcagacagccggcccuuggcaccucgggcggcuggagauggauuuugacuucugugaaggaaccaccguggucgugacagaggauugcggcaauagagggcccucucugcggaccacgacagccuccggaaagcucaucaccgaauggugcugucgcagcugcacacugcccccucuuagauaccggggcgaggacggcuguugguaugggauggagauuagaccgcugaaagaaaaggaggaaaaccucguuaauucccuggugaccgcuggacauggccagaucgauaacuuuucucuggggguccuuggaauggcgcuguuccuggaggaaaugcugcgcacacgggugggcaccaaacacgccauucuccugguugcugugagcuuugucacgcuuaucaccgggaauauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaagcugacgucuaaagagcucaugaugacaaccaucggcaucgugcugcuuagccaauccacaauuccugagucuauccuggaacucaccgaugcccuggcccuggggaugaugguccuuaagauuguucgcaacauggagaaauaucagcuggcugugaccaucauggccauucucugcgugcccaaugcggucauccugcagaacgcuuggaaggugagcuguacaacgcucgccguuguguccgucagcccucugcuucugaccucuucccaacagaaagccgacuggaucccccucgcucugacaauuaagggacugaauccuaccgccaucuuucuuacaacccugagcagaacgucuaagaaacgguccuggccccucaacgaagcuauuauggccgugggcaugguuagcauccuggcgucuucccuccugaagaaugauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaaaaacgaagaggaggaacagacccucacaauccugauucgcacgggccuccuggugaucuccgggcuuuucccuguuucuauucccaucaccgccgcugcgugguaucugugggaggugaagaaacaaagagccggaguccugugggacgugccgagcccucccccuguuggcaaggcugaacucgaggauggggccuaccggaucaaacagaagggcauucugggcuauucccagaucggcgccgggguguacaaggaaggaacauuucacaccauguggcaugucacacgcggcgcugugcuuaugcacaaagggaagagaauugagcccucuugggccgacgugaaaaaggaucugaucagcuacggaggcggguggaaacucgagggagaauggaaggagggcgaagagguucagguccuggcgcucgaacccggcaagaacccucgggcugugcaaaccaaaccggggcuguucaagacgaauaccggaacaauuggcgccgugucccuugacuuuagccccgggaccucuggauccccuaucgucgauaaaaagggcaaagugguugggcuguauggaaacggcguggucacaagaagcggcaccuacgugucugccaucgcucagacagagaaguccauugaggacaaucccgaaaucgaggaugacauuuuccgcaagaaacggcugacgaucauggaucuccauccuggggccggaaagaccaaaagauaucugcccgcgauuguucgcgaagcuaucaagcggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaacuauaaucugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaacgcgcccauuauggaugaggaacgcgagaucccugaaagaagcuggaacucuggccacgagugggucacggacuucaaagggaagacagugugguuugugcccuccauuaaggccggaaacgauaucgcugccugccuccggaaaaauggcaagaaagucauucaacugagcagaaagaccuucgacucugaauauaucaaaacccgcacaaacgauugggacuuuguugugaccacagauaucagcgagaugggggccaauuucaaggcugagcgggugauugacccuagacgcuguaugaagccggucauccuuaccgauggagaggaacgggugauucuggccggccccaugccuguuacgcauuccucugcggcucagagacgcgggcgggugggcagaaaccccaaaaaugaaaacgaccaguacaucuacaugggagagccucucgaaaaugaugaggacugcgcccacuggaaggaggccaaaaugcugcuggacaacauuaacacacccgaaggcaucaucccgagcauguuugagccugaacgcgagaaggucgaugcuauugacggggaauauagacuccggggagaggcccgcaaaaccuucguggaucuuaugagacggggcgaccugcccguuuggcuggcguaccgcguggccgcugaggggaucaauuaugccgauagacggugguguuuugacggagucaagaacaaucaaauucucgaagagaacguggaagucgagaucuggacaaaagagggcgaaagaaagaagcugaaaccucgcuggcuugaugcucggauuuacuccgacccccuggcccucaaggaguucaaagaguucgcugccgggagaaagucucugacccugaaucucaucacggagaugggccgccuuccuaccuuuaugacacagaaagcgaagaacgcccuggauaaucuggcugugcuccauaccgccgaagcuggaggccgggccuauaaccacgcccugagcgagcuucccgagacacuggaaacccuccugcugcucacacuucuggcuaccguuacagggggaauuuuccuguuucucauguccggcaaggggaucggaaaaaugacacugggcaugugcugcaucauuaccgcgagcauccuucugugguacgcccagauucagccgcacuggaucgcugccucuauuauccucgaguucuuucugaucgugcugcucauuccugaacccgagaagcaaagaacaccccaggacaaucagcuuacauauguggucaucgccauucugaccguuguggcugccacaauggcgaacgaaaugggcuuccuggagaaaacgaagaaagauuuugggcucggauccaucaccacacagcaaccugagagcaauauucuggacaucgaucuucggccggccuccgcuuggacccuguacgccguggcuacaaccuucaucacgcccaugcuccgccauucuauugaaaacagcuccgucaaugugucucugaccgccaucgcgaaccaggccacaguucugaugggccucgggaagggauggccucuuagcaagauggacauuggcgugccccugcuggcuaucggguguuacucccaggucaauccuauuacccucacagccgcucugcuucugcucguggcccacuaugcuaucauuggacccggccugcaggccaaagcgaccagagaggcccaaaagcgggcugccgcuggcaucaugaaaaacccuacggucgacgggaugacagugaucgaucuggacccgauucccuacgauccuaaguuugaaaaacagcucggacagguuaugcuucuggugcugugcgucacccaggugcucaugaugcgcacaaccugggcccugugugaggcccuuacccuggcgacaggccccaucagcacgcucugggaagggaauccuggaagauucuggaacaccacaauugcuguuucuauggccaacaucuuucggggcuccuaucuggcuggggccggacuccuguucagcauuaugaagaauaccgccaacacacgcagaggcaccggcaauacgggggagacacuuggagagaaguggaaaaaccggcugaaugcucugggcaagucugaauuucaaaucuacaaaaaguccgggauccaggagguggaccgcacccucgccaaagaaggaauuaagagaggcgagaccgaucaucacgcggucagccgggggucugccaaacugagaugguucguggagcgcaaccuugugacacccgaaggaaagguugucgaccugggcugcggcagagggggauggagcuauuacuguggcgggcucaagaaugugaaagaggugaagggacugaccaaaggcgggccgggacaugaagaaccuauccccauguccacauauggcuggaaccuggucagacuccagucuggcguugauguguucuuuacgcccccugaaaagugcgacacccuucugugugauauuggggagagcucccccaauccuacaguggaggcuggacgcacccugcggguccucaaccugguggaaaauuggcuuaacaauaacacacaauucugcaucaaaguucugaauccguacaugcccagcgugauugagaagauggaagcccuccagagaaaguacggcggggcucugguccgcaacccucugucccggaacucuacccacgagauguauugggugagcaaugccuccggaaacaucguuucuagcgugaauacgaucuccagaaugcucauuaaccgcuuuaccaugcggcacaaaaaggcgacauacgaacccgacgucgaucuuggcucugggaccagaaauaucggaauugagagcgagacaccuaaccuggacaucauuggcaaacgcaucgaaaagaucaaacaggagcaugaaaccuccuggcacuaugaucaggaccaucccuacaagacaugggccuaucacggcagcuacgagaccaagcaaacggggucugcuuccagcauggugaauggagugguccggcugcucacaaaaccgugggacguuauuccuauggugacccagauggccaugaccgauacaacgcccuucggccagcagagaguguuuaaggaaaaagucgacacccgcacacaagagccuaaggaggggaccaaaaagcugaugaagaucacagcugaauggcuuuggaaagagcugggaaagaaaaagacccccagaauguguacacgggaagaguucacccgcaaagugagaucuaacgccgcucucggcgccauuuuuacggaugagaauaaguggaaauccgcgcgggaagccguugaggacagcggguucugggaacugguggauaaggagagaaaccugcaccucgaaggaaagugcgagaccugugucuauaauaugaugggcaaacgggagaagaaacugggcgaauuugggaaggcuaaaggaucucgcgccaucugguacauguggcuuggcgcuagauuccuggaguuugaagcccucggguuccugaacgaggaccauugguuuucccgggaaaauagccuuuccggaguggagggcgaggggcugcacaagcucggcuacauucugcgcgauguuagcaagaaagaaggaggcgccauguaugcggacgauacagcugggugggacaccagaaucacacuggaggaucucaagaacgaagagauggugaccaaucauauggaaggagagcacaaaaagcuggccgaggccauuuucaaacuuacguaccagaacaaggucgugcggguucagcgcccuacacccagaggcaccgugauggacaucaucucucggcgcgaccagagagggagcggacaagucgugacauauggccugaacaccuucacgaauauggaagcucagcucauucggcagauggagggggaaggcgucuuuaaguccauccaacagcugaccgugaaagaggagauugccguuaagaacuggcuuauccgcgugggaagagaacggcugucucgcauggcuauuagcggcgaugacugcgucgugaaaccgcucgaugacagauucgccuccgcgcugacagcccugaaugauauggggaaggugcggaaagacauccagcagugggagccuucuagaggauggaacgauuggacccaaguucccuuuugcagccaucacuuccacgaacucaucaugaaggacggccgcgugcuggucgugcccugucggaaucaggaugagcuuauugggagagcucgcaucucccagggagccggcuggucucugcgggaaacagcuugccucggaaagagcuacgcccagauguggucccugauguauuuucauagacgcgaccuucggcuggcggccaacgcuauuuguagcgccguuccuucucacuggaucccgaccuccagaacaaccuggagcauucaugcuacgcacgaguggaugacaaccgaggauaugcucaccguguggaaucgcgucuggauccaagaaaaccccuggauggaggacaaaacaccuguggaaucuugggaggaaauccccuaccugggcaagcgggaggaucaguggugcggaucccugauuggccucaccagcagagccacaugggcuaaaaauauccagacggccauuaaccagguccgcucccugaucgggaaugaggaauauaccgacuacaugccuucuaugaagcgguucagacgggaggaagaggaagcgggagugcuuugguga

SEQ ID NO: 19595 - RNA, 9876 nt, Artificial Sequence
  derived and/or modified CDS sequence (opt5) from DENV-2__KX380808__SS-prME
accgccggaaucauuaucaugaugauucccaccgucauggcuuuccaccugacgaccagaaacggggaaccucauaugaucgucagccggcaggaaaagggaaaaucccuccuguuuaagacagagaauggcguuaacaugugcacccuuauggccauggaccugggggaacucugugaggauacaauuaccuacaauugcccgcugcuuaaacaaaacgaacccgaggacaucgauuguuggugcaauucuacaagcaccugggugacguauggaaccuguacagcgaccggcgagcaccgccgggaaaagcgguccguggcucuggucccucauguggggaugggacucgagacacgcaccgaaacguggaugucuagcgagggcgccuggaaacacgcccagagaaucgagacauggguucugcggcaucccggcuucaccauuauggcugccauccuggcuuacacaauugggaccaccuauuuucagcgcgugcucaucuucauucugcuuacagccaucgcgccuuccaugacgaugagaugcauuggaaucucuaaccgggacuuugucgaaggcgugagcgggggauccuggguugauaucgugcuggagcacggcagcugugucaccacaauggccaagaauaagcccacccucgacuucgaacugauuaaaacagaggcuaagcacccugccacccuucgcaaauacugcaucgaagcuaagcugacgaacacaaccaccgccucuagauguccgacacagggggagcccucccucaaugaggaacaagauaaacgguuugugugcaagcauagcaugguggaccgcggauggggcaacggcugugggcuguucggaaagggcgggauugugaccugcgcgauguuuacaugcaaaaagaauauggagggaaaaaucguucagccugaaaaccuggaguauacgauugugaucacaccccacucuggcgaagagaaugccguggggaacgauacaggaaagcauggcaaagagaucaaggucaccccucaguccagcauuacagaagcugagcucaccggcuacgggacggugaccauggaauguucucccagaacaggacuggacuucaaugagaugguucuucugcagauggaaaacaaagccuggcucgugcaccggcaaugguuucuggaucuuccgcugccuuggcuccccggcgcugacacccagggguccaacuggauccagaaggagacacuggucaccuucaagaauccucacgccaaaaagcaggaugugguugugcugggaagccaagagggcgccaugcauacggcucucacaggggcgaccgaaauucagauguccucuggcaaccugcuuuuuacaggacaccugaaaugccgccucagaauggacaagcugcagcuuaaaggcaugagcuauuccauguguaccgggaaguucaaggucgugaaagagaucgccgaaacccaacauggaacaauugucauccgggugcaguacgagggcgacgggagccccugcaagauccccuucgagauuauggaucuggagaagcggcacguucucggacgccugaucacggugaauccuauugucaccgagaaggacucuccggugaacaucgaagcugagcccccuuuuggcgauuccuacauuaucauugggguugaacccggccagcugaaacucagcugguucaagaagggaucuagcaucggccagauguuugagacaaccaugagaggggccaaaagaauggccauccugggagacacagcuugggauuucggcucccuugggggaguguuuaccucuauuggcaaggcccugcaucaagucuucggggcgaucuauggcgcugccuuuagcggaguguccuggacgaugaaaauucucaucggcgugguuauuacauggaucgggaugaauagccgcucuaccucccugagcgucucucuggugcuugugggagucgugacccucuaccugggcguuauggugcaggccgacuccgggugugucgugagcuggaagaacaaagagcugaagugcggauccggcaucuucauuacagauaauguucacaccuggacagaacaguauaaguuucagccugagucucccagcaaacucgcuuccgccauccaaaaggcucacgaagaggggauuuguggcauccggucugugacgagacuggaaaaccuuauguggaaacagauuaccccggagcugaaucauauccucagcgagaacgaagucaagcugacaaucaugaccggagacauuaaaggcaucaugcaggccgggaagcgcucccugcggccucagcccacagagcuuaaauacagcuggaaggcguggggaaaggccaaaaugcucucuaccgaacugcacaaucauacguuccugauugauggcccugagaccgcugaaugccccaacacaaauagagccuggaacucccucgagguggaggacuauggguuuggaguuuucaccacaaauaucuggcugaaacuuaaagaacgccaagauguguuuugugacagcaagcugaugucugcugccauuaaagacaaccgggcgguccacgccgauaugggcuacuggaucgaguccgcucucaacgacaccuggaagaucgaaaaggccagcuucauugagaucaaaucuugccacuggccuaagagccauacacugugguccaauggcgugcuggagagcgaaaugauuauccccaaaaacuucgcugggccggugucucagcacaauuauagaccuggauaccauacccagacggccggccccuggcaccuugggcgccucgagauggauuuugacuucugugaaggaacaaccgucguugugaccgaggauugcggcaaccgggggcccucccugagaacaaccacggccagcggaaagcugauuacagaauggugcugucgguccugcacccucccuccgcugcgcuacagaggcgaggacggcuguugguaugggauggagauccggccccuuaaagaaaaggaggaaaaucuggugaacucucucgucacagcuggacauggccagauugauaauuuuagccugggggugcugggaauggcgcuuuuccucgaggaaaugcugagaacccgcguuggcacaaagcacgccauccugcucguggcugucuccuuugugacccugaucacggggaacaugucuuuccgggaccuuggaagaguuauggugauggucggcgccaccaugacagaugacauuggcaugggggugaccuaccuggcccuccuggcugccuuuaaaguucgcccuacauucgcggcuggacugcuucugagaaagcucaccagcaaagagcugaugaugacgacaaucggcauugugcuccugucccaaucuaccauccccgagacaauucuugaacugaccgaugcccucgcccuggggaugaugguccugaagaucgugcggaauauggagaaauaucagcuugcugugaccaucauggccauucugugcgucccuaacgcgguuauccuccagaaugcuuggaaggugagcuguacaacgcuggccguggucuccgugagcccccuccugcuuaccucuucccaacagaaggccgacuggauuccucuggcucucacaaucaaaggacugaaccccaccgccauuuuucugacaacccuuagccgcacgucuaagaaaagauccuggccgcugaaugaagcuaucauggccguuggcauggugagcauccucgcgucuucccugcucaagaacgauauuccuaugacagggccccuggucgccggaggccuucugaccgugugcuacguucugaccggccggagcgcugaccucgagcuggaacgcgccgcugacgugagaugggaggagcaggccgaaaucuccgggagcucuccuauucuuagcaucacaauuuccgaggauggaucuaugagcaucaaaaaugaagaggaggaacagacccugacaauucucauccggacgggccugcucgucaucuccgggcuguuccccgugucuauuccgaucaccgccgcugcgugguaucuuugggaggucaagaaacaacgcgccggagugcugugggacguuccuucucccccucccgugggcaaggcugaacuggaggauggggccuacagaauuaagcagaaaggaauccucggcuauucccagauuggcgccggggucuacaaggaaggaacauuucacaccauguggcaugugacacggggcgcuguucugaugcacaaagggaagcgcaucgagcccuccugggccgacgugaaaaaggaucuuaucagcuacggaggcggguggaagcuggagggagaauggaaagagggcgaagagguccaggugcucgcgcuggaaccuggcaagaacccgagagcugugcaaaccaaacccggacucuucaagacgaacaccggaacaauuggcgccguuucccuggacuuuagcccugggaccucuggaucccccaucgucgauaaaaagggcaaggugguggggcuuuauggaaauggcgucgugacacggagcggcaccuacguuucugccauugcucagacagagaaauccaucgaggacaacccugaaauugaggaugacaucuucagaaagaaacgccugacgaucauggaucugcaucccggggccggaaagaccaaacgguaucucccugcgauugugagagaagcuaucaagcgcggccugcggacacuuauucuggccccgaccagagucguggccgcugagauggaagaggcccuccgcgggcugcccauccgguaccagaccccugcuauuagagccgagcacacaggacgcgaaaucguugaccucaugugucaugcgacguucaccaugcggcugcuuagccccauuagagugccuaauuauaaccugaucaucauggaugaggcccacuuuacagaccccgcuuccauugccgcucggggcuacaucucuacccgcgucgaaaugggggaggccgccggcauuuucaugacagcuaccccgccuggaagcagagaccccuuuccccaguccaaugcgccuaucauggaugaggaacgggagauucccgaacgcagcuggaacucuggccacgagugggugacggacuucaaggggaaaacaguuugguuugugccuuccaucaaggccggaaaugauaucgcugccugccugcgcaaaaacggcaagaaagucauucaacucagccggaagaccuucgacaccgaauauaucaagacaagaaccaaugauugggacuuuguggugacaaccgauauuucugagaugggggccaacuucaaagcugagcgcgucaucgacccgcggagauguaugaagcccguuauucugacggauggagaagaaagagugauccuugccggcccuaugcccgugacacauagcuccgcggcucagcggagagggcgcgucggccggaauccuaaaaacgaaaaugaccaguacaucuacaugggagagccccuggaaaacgaugaggacugcgcccacuggaaggaggccaaaaugcuccuggacaauauuaacaccccggaaggcaucauuccuucuauguuugagcccgaaagagagaagguggaugcuaucgacggggaauaucgccugagaggagaggcccggaaaacauucguugaucucaugcgcagaggcgaccuuccuguguggcuggcguaccgggucgccgcugaggggauuaacuaugccgaucgcagaugguguuuugacggagugaagaauaaccaaauccuggaagagaauguugaaguggagauuuggaccaaggagggcgaacggaaaaagcucaaacccagauggcuggaugcucgcaucuacagcgacccucuugcccugaaggaguucaaagaguucgcugccgggcggaagucccucacgcugaaccugaucaccgagaugggcagacuccccacauuuaugacccagaaggcgcgcaaugcccuugauaaccuggcuguccugcauacagccgaagcuggaggccgggccuauaaucacgcccucucugagcugccggagacccuugaaacacugcuccugcugacccuccuugcuacggugacagggggaauuuuccuguuucugaugagcggcaaagggaucggaaagaugacccucggcaugugcugcauuaucaccgcguccauucugcuuugguacgcccagauccagccucacuggaucgcugccagcauuauccuggaguucuuucucauuguccugcugauccccgaacccgagaaacaaagaacaccucaggacaaccagcucaccuaugugguuauugccauccuuacagugguggcugccacgauggcgaaugaaaugggcuuccuggagaagaccaaaaaggauuuugggcugggaucuaucacaacccagcaaccggaguccaacauucucgacaucgaucugcggcccgccagcgcuuggacacuuuacgccgucgcuaccacguucauuaccccuaugcugcgccauuccaucgaaaauucuagcguuaacgugucccucacagccauugcgaaucaggccaccgugcugaugggccuggggaagggauggccccucucuaaaauggacaucggcgucccucuucuggcuauuggguguuacagccaggugaaccccaucacacugaccgccgcucuccugcuucugguuacgcacuaugccaucauuggaccuggccuccaggcuaaggccacaagagaggcgcaaaaacgggccgcugccggcaucaugaagauuccgaccguggacgggaucacagucauugaucuggaccccaucccuuacgaucccaaauuugaaaagcagcugggacaggugaugcuccuuguccugugcgugacccagguucugaugaugcgcaccacaugggcucucugugaggcccugacgcuugccaccggcccuaucuccacacugugggaagggaaucccggaagauucuggaacaccacaauugcggugagcauggcuaauaucuuucggggcucuuaucucgccggggcuggacugcuguucuccauuaugaagaacaccgccaacacgcgcagaggcacaggcaauaccggggagacccucggagagaaauggaagaaccggcuuaaugcccugggcaaaagcgaauuucaaaucuacaagaaaucugggauucaggaggucgaccgcacacuggcuaaggaaggaaucaaaagaggcgagaccgaucaucacgccgugucccgggggagcgcgaagcucagaugguucguugagcgcaaccuggugacaccggaaggaaaggucguggaccuuggcugcggcagaggcggguggucuuauuacuguggagggcugaaaaaugugaaggagguuaaagggcucacgaagggcgggccuggacaugaagaacccauccccaugagcaccuauggcuggaaccuggucagacugcaguccggcguggauguguucuuuacaccucccgaaaaaugcgacacccuccuuugugauauuggggagucuagcccuaauccgacagucgaggccggacgcacccugcggguucugaaccucguggaaaauuggcugaacaauaacacgcaauucugcaucaaggugcuuaaucccuacaugccuuccgucauugagaagauggaagcucugcagagaaaauacggcggggcccucgugcgcaacccccugagccggaauagcacccacgagauguauuggguuucuaacgcuagcggaaacaucguguccucugucaauaugauuagcagaaugcugaucaaccgcuuuacaaugcggcacaagaaagccaccuacgaaccugacguggaucucggcuccgggacaagaaauaucggaauugagucugagacccccaaccuugacaucauuggcaagcgcaucgagaaaauuaagcaggagcaugaaacaagcuggcacuaugaucaggaccauccguacaagaccugggcguaucacggcuccuacgagacgaaacaaacagggagcgccucuuccaugguuaauggagugguccggcugcugaccaagccuugggacgugauccccauggugacccagauggcuaugacagauacgaccccuuucggccagcagagagucuuuaaagaaaagguugacacacgcacccaagagcccaaagaggggacaaagaagcucaugaaaauuaccgccgaauggcuguggaaggagcuuggcaaaaagaaaacaccuagaauguguacccgggaagaguucacgcgcaaggugagaagcaacgcugcccugggcgcuaucuuuaccgaugagaauaaauggaagucugcccgggaagcgguggaggacuccggguucugggaacucgucgauaaggagagaaaccugcaccuggaaggaaaaugcgagacauguguguauaauaugaugggcaagcgggagaaaaagcucggcgaauuugggaaagccaagggaagccgcgcuaucugguacauguggcugggcgccagauuccuugaguuugaagcucugggguuccucaacgaggaccauugguuuucucgggaaaauucccugagcggaguugagggcgaggggcuucacaagcugggcuacauucuccgcgauguguccaaaaaggaaggaggcgccauguaugccgacgauaccgcggggugggacacaagaaucacccuggaggaucugaaaaacgaagagauggucacgaaucauauggaaggagagcacaagaaacucgcugaggccauuuuccggcugacauaccagaacaaggugguucgcgugcagagacccaccccgcggggcacagucauggacaucauuagccgcagagaccagcgggggucuggacaagugguuaccuauggccuuaauacguucaccaacauggaagcccagcugauccgccagauggagggggaaggccucuuuaagagcauccaacaucugacagugaccgaggagauugcugucaaaaacuggcuugugagagucggacgggaacgccuguccagaauggccaucucuggcgaugacugcgugguuaagccucucgaugaccgguucgcuagcgcccugacagcgcugaaugauauggggaaagugagaaaggacauucagcagugggagcccucccgcggauggaacgauuggacccagguccccuuuugcucucaccacuuccaugaacucaucaugaaagacggccgggugcuggugguuccuuguagaaaucaagaugagcuuauugggcgcgcccggaucagccagggagcuggcuggucccugagagaaacagccugccucgggaagucuuacgcucagauguggagccugauguauuuucaccgccgggaccuuagacuggccgcgaacgccaucuguuccgcugugccgagccauuggguccccaccucucgcacgacaugguccauucacgccacccacgaguggaugaccacagaggauaugcucaccguguggaaucggguuuggauccaggaaaacccuuggauggaggacaagacacccguggaaagcugggaggaaauuccuuaccugggcaaaagagaggaucaauggugcggaucucugaucggccucacgucccgcgcuaccugggccaagaauauucagacagcuaucaaccagguccggagccugauugggaaugaggaauauaccgacuacaugcccuccaugaaaagauuccggagagaggaagaggaagccggagugcuuugguga

SEQ ID NO: 19596 - RNA, 9876 nt, Artificial Sequence
  derived and/or modified CDS sequence (opt5) from DENV-2__KX380832__SS-prME
accgccggaaucauuaucaugaugauucccaccgugauggcuuuccaccugacgaccagaaacggggaaccucauaugaucgugagccggcaggaaaaggggaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuaugacaauccugugcguuccuaacgcggugauccuccagaaugcuuggaaagugagcuguacgauucuggccgucguguccguuagcccccuccugcuuaccucuucccaacagaaggccgacuggaucccucuggcucucacaauuaagggacugaaccccaccgccaucuuucugacaacccuuagcagaacgucuaaaaagcgguccuggccgcugaaugaagcuauuauggccgugggcauggucagcauccucgcgucuucccugcucaaaaacgauaucccuaugacagggccccugguggccggaggccuucugaccguuugcuacgugcugaccggccgcagcgcugaccucgagcuggaaagagccgcugacguccggugggaggagcaggccgaaauuuccgggagcucuccuauccuuagcauuacaaucuccgaggauggaucuaugagcauuaagaaugaagaggaggaacagacccugacaauccucauucgcacgggccugcucgugaucuccgggcuguuccccgucucuaucccgauuaccgccgcugcgugguaucuuugggaggugaaaaagcaaagagccggaguucugugggacgugccuucucccccucccgucggcaaagcugaacuggaggauggggccuaccggaucaagcagaagggcauucucggcuauucccagaucggcgccgggguguacaaagaaggaacauuucacaccauguggcauguuacacgcggcgcugugcugaugcacaaggggaaaagaauugagcccuccugggccgacgucaagaaagaucuuaucagcuacggaggcggguggaagcuggagggagaauggaaggagggcgaagagguccaggugcucgcgcuggaaccuggcaaaaacccgcgggcuguucaaaccaagcccggacucuucaaaacgaacaccggaacaaucggcgccgucucccuggacuuuagcccugggaccucuggaucccccauuguggauaagaaaggcaagguggucgggcuuuauggaaauggcgugguuacaagaagcggcaccuacgugucugccaucgcucagacagagaaguccauugaggacaacccugaaaucgaggaugacauuuuccgcaaaaagcggcugacgaucauggaucugcaucccggggccggaaaaaccaagagauaucucccugcgaucguccgcgaagcuauuaaacggggccugagaacacuuauccuggccccgacccgcgugguugccgcugagauggaagaggcccuccgggggcugcccauuagauaccagaccccugcuauccgcgccgagcacacaggacgggaaauuguggaccucaugugucaugcgacguucaccaugagacugcuuagccccauccgggucccuaauuauaaccugauuaucauggaugaggcccacuuuacagaccccgcuuccaucgccgcucgcggcuacauuucuaccagaguggaaaugggggaggccgccggcaucuucaugacagcuaccccgccuggaagccgggaccccuuuccccaguccaaugcgccuauuauggaugaggaacgcgagauccccgaaagaagcuggaacucuggccacgaguggguuacggacuucaaggggaagacagugugguuugucccuuccauuaaagccggaaaugauaucaccgcuugccugcggaagaacggcaaaaaggugauccaacucagcagaaaaaccuucgacucugaauauauuaagacacgcaccaaugauugggacuuuguggucacaaccgauaucagcgagaugggggccaacuucaaggccgagcggguuauugacccgagacgcuguaugaaacccgugauccugacggauggagaagaacgggugauucuugcuggcccuaugcccgucacacauuccucugccgcgcagagacgcgggcgggugggcagaaauccuaagaacgaaaaugaccaguacaucuacaugggagagccccuggaaaacgaugaggacugcgcucacuggaaagaggccaagaugcuccuggacaauaucaacaccccggaaggcauuaucccuagcauguuugagcccgaacgcgagaaaguugaugccauugacggggaauauagacugcggggagaggcucgcaagacauucguggaucucaugagacggggcgaccuuccugucuggcuggccuaccgcguggcggccgaggggaucaacuaugcugauagacggugguguuuugacggaguuaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcugggagaaaaucucucacgcugaaccugaucaccgagaugggccgccuccccacauuuaugacccagaaggcccggaaugcgcuugauaaccuggccgugcugcauacagcugaagccggaggcagagcuuauaaucacgcccucagcgagcugccggagacccuugaaacacugcuccugcugacccuccuugccacggucacagggggaaucuuccuguuucugauguccggcaaggggauuggaaaaaugacccucggcaugugcugcaucauuaccgcuagcauccugcuuugguacgcgcagauucagccucacuggaucgccgcuucuaucauucuggaguucuuucucaucgugcugcugauucccgaacccgagaagcaacggacaccucaggacaaccagcucaccuauguugugaucgccauucuuacaguggucgccgcuacgauggccaaugaaaugggcuuccuggagaaaaccaagaaagauuuugggcugggauccaucacaacccagcaaccggacagcaacauccucgauauugaccugcgccccgcguccgccuggacacuuuacgcuguugccaccacguucaucaccccuaugcugagacauucuauugagaauagcuccgugaacgugucucucacagcuaucgccaaucaggcgaccguccugaugggccuggggaagggauggccccucagcaagauggacauuggcgugccucuucuggccaucggguguuacucccagguuaaccccauuacacugaccgcugcccuccugcuucugguggcucacuaugccaucaucggaccuggccuccaggcuaaagccacgcgggaagcgcaaaagcgcgccgcugccggcauuaugaaaaucccggcugccgaugggauuacagucaucgaccuggaucccauuccuuacgaccccaaguuugagaaacagcugggacaggugaugcuccuuguccugugcgugacccagguucugaugaugagaacaaccugggcccucugugaagcgcugacccuugcuacaggcccuaucagcacgcugugggaggggaaucccggacgguucuggaacaccacaaucgccgugucuauggcuaauauuuuucgcggcuccuaucucgccggggccggacugcuguucagcaucaugaagaacaccgcuaacacaagacggggcaccggcaauacgggggaaacacucggagagaaguggaaaaaccgccuuaaugcccugggcaagucugaguuucaaauuuacaaaaaguccgggauccaggaagucgauagaacccuggcgaaagagggaauuaagcggggcgaaaccgaccaucacgccgugagcagagggucugcuaaacuccgcugguucguugagcggaaccuggugacaccggagggaaaggucguggaucuuggcugcggcagagggggauggagcuauuacuguggcgggcugaagaaugugaaagaaguuaagggacucaccaaaggcgggccuggacaugaggaacccauccccauguccacauauggcuggaaccugguccgccugcagucuggcguggacguguucuuuacgccucccgagaagugcgauacccuccuuugugacaucggggaaagcuccccuaauccgacagucgaggccggacggacccugagaguucugaaccucguggagaauuggcugaacaauaacacacaauucugcauuaaagugcuuaaucccuacaugccuagcgucaucgaaaagauggaggcucugcagcgcaaguacggcggggcccucgugcggaacccccuguccagaaauucuacccacgaaauguauuggguuagcaacgcguccggaaacauugugucuagcgucaauaugaucucccgcaugcugauuaaccgguuuacgaugaaacacaagaaagccaccuacgagccugauguggaccucggcucugggacaagaaauaucggaaucgaaagcgagacccccaaccuugauauuaucggcaagcgcauugagaaaaucaagcaggaacaugagacauccuggcacuaugaccaggaccauccguacaagaccugggcuuaucacggcagcuacgaaacaaaacaaaccgggucugccuccagcaugguuaauggagugguccggcugcugacgaagccuugggaugugauucccauggugacacagauggcuaugaccgacaccacaccuuucggccagcagagagucuuuaaagagaagguugauacgcgcacccaagaacccaaagaggggacaaagaagcucaugaaaaucaccgccgaguggcuguggaaggaacuuggcaaaaagaaaacaccuagaauguguacccgggaggaguucacacgcaaggugagaucuaacgcugcccugggcgcgauuuuuaccgacgagaauaaauggaaguccgcccgggaggcuguggaagauagcggguucugggagcucgucgacaaggaaagaaaccugcaccuggagggaaaaugcgaaacguguguguauaauaugaugggcaagcgggagaaaaagcucggcgaguuugggaaagccaagggaucucgcgcuaucugguacauguggcugggcgccagauuccuugaauuugaggcccugggguuccucaacgaagaucauugguuuucccgggagaauagccuguccggaguugaaggcgaggggcuucacaagcugggcuacauccuccgcgacgugagcaaaaaggagggaggcgcgauguaugcugaugacaccgccgggugggauacaagaauuacccuggaagaccugaaaaacgaggaaauggucacaaaucauauggagggagaacaccggaagcucgccgaggcuaucuuccgccugaccuaccagaacaaagugguuagagugcagcggcccacgccgcgcggcacagucauggacauuaucucuagacgggaucagcgcgggagcggacaagugguuaccuauggccuuaauacauucaccaacauggaggcccagcugauuagacagauggaaggggagggcguguuuaaguccauccaacaucucacggucaccgaagagaucgcugugaagaacuggcuggagcgggucggacgcgaaagacuuucucggauggccauuagcggcgacgauugcgugguuaaaccucuggacgauagauucgcguccgcccucacagcucugaaugacauggggaaggugcgcaaagauauccagcagugggagcccucucggggauggaacgacuggacccagguccccuuuugcagccaccacuuccaugaacugauuaugaaggauggcagagugcucgugguuccuugucgcaaucaagacgagcugaucgggcgggccagaauuucccagggagcuggcuggucucuucgcgaaacagccugccuggggaaaagcuacgcgcagauguggucccucauguauuuucaccggagagaucugcgccuugccgcuaacgccaucuguagcgcugugccgucucauuggguccccaccucccggacaaccuggagcauccacgccacgcacgaguggaugacaaccgaggacaugcugaccguguggaauagaguuuggauucaggaaaacccuuggauggaggauaagacacccguggaaucuugggaggaaaucccuuaccucggcaagcgcgaggaccaauggugcggaucccugauuggccugaccagccgggcuacaugggccaaaaauauccagacggcgauuaaccaggucagaucccucaucgggaaugaggaauauaccgacuacaugcccucuaugaagcgguucagacgcgaggaagaggaagccggagugcugugguga

SEQ ID NO: 19597 - RNA, 9876 nt, Artificial Sequence
  derived and/or modified CDS sequence (opt5) from DENV-2__KX380833__SS-prME
accgccggaaucauuaucaugaugauucccaccgugauggcuuuccaccugacgaccagaaacggggaaccucauaugaucgugagccggcaggaaaaggggaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuauggcgauccugugcguuccuaacgcugugauccuccagaaugccuggaaagugagcuguacaauucuggccgucguguccguuagcccccuccugcuuacgucuucccaacagaaggcugacuggaucccucuggcccucaccauuaagggacugaaccccacagcuaucuuucugaccacacuuagcagaaccucuaaaaagcgguccuggccgcugaaugaagccauuauggcggugggcauggucagcauccucgccucuucccugcucaaaaacgauaucccuaugacggggccccugguggcuggaggccuucugacaguuugcuacgugcugaccggccgcagcgccgaccucgagcuggaaagagcugccgacguccggugggaggagcaggccgaaauuuccgggagcucuccuauccuuagcauuaccaucuccgaggauggaucuaugagcauuaagaaugaagaggaggaacagacacugaccauccucauucgcacaggccugcucgugaucuccgggcuguuccccgucucuaucccgauuacggcugcggccugguaucuuugggaggugaaaaagcaaagagcuggaguucugugggacgugccuucucccccucccgucggcaaagccgaacuggaggauggggccuaccggaucaagcagaagggcauucucggcuauucccagaucggcgcugggguguacaaagaaggaaccuuucacacaauguggcauguuacccgcggcgccgugcugaugcacaaggggaaaagaauugagcccuccugggcggacgucaagaaagaucuuaucagcuacggaggcggguggaagcuggagggagaauggaaggagggcgaagagguccaggugcucgcucuggaaccuggcaaaaacccgcgggccguucaaacaaagcccggacucuucaaaaccaacacgggaaccaucggcgccgucucccuggacuuuagcccugggacaucuggaucccccauuguggauaagaaaggcaagguggucgggcuuuauggaaauggcgugguuaccagaagcggcacauacgugucugcuaucgcccagaccgagaaguccauugaggacaacccugaaaucgaggaugacauuuuccgcaaaaagcggcugacaaucauggaucugcaucccggggcgggaaaaacgaagagauaucucccugcuaucguccgcgaagccauuaaacggggccugagaacccuuauccuggccccgacacgcgugguugcugccgagauggaagaggcucuccgggggcugcccauuagauaccagaccccugccauccgcgcggagcacaccggacgggaaauuguggaccucaugugucaugccacauucacgaugagacugcuuagccccauccgggucccuaauuauaaccugauuaucauggaugaggcucacuuuaccgaccccgccuccaucgcugcccgcggcuacauuucuacaagaguggaaaugggggaggccgcuggcaucuucaugaccgcgacaccgccuggaagccgggaccccuuuccccaguccaaugccccuauuauggaugaggaacgcgagauccccgaaagaagcuggaacucuggccacgaguggguuaccgacuucaaggggaagacggugugguuugucccuuccauuaaagcuggaaaugauaucgccgccugccugcggaagaacggcaaaaaggugauccaacucagcagaaaaacauucgacucugaauauauuaagacccgcaccaaugauugggacuuuguggucacaaccgauaucagcgagaugggggcuaacuucaaggccgagcggguuauugacccgagacgcuguaugaaacccgugauccugacagauggagaagaacgggugauucuugcgggcccuaugcccgucacccauuccucugcugcccagagacgcgggcgggugggcagaaauccuaagaacgaaaaugaccaguacaucuacaugggagagccccuggaaaacgaugaggacugcgcccacuggaaagaggcuaagaugcuccuggacaauaucaacacgccggaaggcauuaucccuagcauguuugagcccgaacgcgagaaaguugaugccauugacggggaauauagacugcggggagaggcgcgcaagacauucguggaucucaugagacggggcgaccuuccugucuggcuggccuaccgcguggcugccgaggggaucaacuaugcugauagacggugguguuuugacggaguuaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcggggagaaaaucucucacacugaaccugaucaccgagaugggccgccuccccacguuuaugacccagaaggcccggaaugcucuugauaaccuggccgugcugcauacagcugaagccggaggcagagccuauaaucacgcucucagcgagcugccggagacccuugaaacacugcuccugcugacccuccuugcgacagucaccgggggaaucuuccuguuucugauguccggcaaggggauuggaaaaaugacgcucggcaugugcugcaucauuacagccagcauccugcuuugguacgcucagauucagccucacuggaucgccgccucuaucauucuggaguucuuucucaucgugcugcugauucccgaacccgagaagcaacggaccccucaggacaaccagcucaccuauguugugaucgcuauucuuacaguggucgccgcgaccauggccaaugaaaugggcuuccuggagaaaacaaagaaagauuuugggcugggauccaucacgacccagcaaccggacagcaacauccucgauauugaccugcgccccgcuuccgccuggacacuuuacgcuguugccaccacauucaucaccccuaugcugagacauucuauugagaauagcuccgugaacgugucucucacggcgaucgccaaucaggcuaccguccugaugggccuggggaagggauggccccucagcaagauggacauuggcgugccucuucuggccaucggguguuacucccagguuaaccccauuacacugaccgcugcccuccugcuucugguggcucacuaugccaucaucggaccuggccuccaggcgaaagccacacgggaagcucaaaagcgcgccgcugccggcauuaugaaaaucccggccgcggaugggauuaccgucaucgaccuggaucccauuccuuacgaccccaaguuugagaaacagcugggacaggugaugcuccuuguccugugcgugacgcagguucugaugaugagaacaaccugggcucucugugaagcccugacacuugcuaccggcccuaucagcacccugugggaggggaaucccggacgguucuggaacacaacgaucgccgugucuauggccaauauuuuucgcggcuccuaucucgcuggggccggacugcuguucagcaucaugaagaacaccgcgaacacaagacggggcaccggcaauacaggggaaacccucggagagaaguggaaaaaccgccuuaaugcccugggcaagucugaguuucaaauuuacaaaaaguccgggauccaggaagucgauagaacgcuggcuaaagagggaauuaagcggggcgaaacagaccaucacgccgugagcagagggucugcuaaacuccgcugguucguugagcggaaccuggugaccccggagggaaaggucguggaucuuggcugcggcagagggggauggagcuauuacuguggcgggcugaagaaugugaaagaaguuaagggacucaccaaaggcgggccuggacaugaggaacccauccccauguccacauauggcuggaaccugguccgccugcagucuggcguggacguguucuuuaccccucccgagaagugcgauacacuccuuugugacaucggggaaagcuccccuaauccgacggucgaggccggacggacccugagaguucugaaccucguggagaauuggcugaacaauaacacacaauucugcauuaaagugcuuaaucccuacaugccuagcgucaucgaaaagauggaggcgcugcagcgcaaguacggcggggcccucgugcggaacccccuguccagaaauucuacccacgaaauguauuggguuagcaacgcuuccggaaacauugugucuagcgucaauaugaucucccgcaugcugauuaaccgguuuacaaugaaacacaagaaagccaccuacgagccugauguggaccucggcucugggacgagaaauaucggaaucgaaagcgagacccccaaccuugauauuaucggcaagcgcauugagaaaaucaagcaggaacaugagacauccuggcacuaugaccaggaccauccguacaagaccugggcuuaucacggcagcuacgaaacaaaacaaaccgggucugccuccagcaugguuaauggagugguccggcugcugacaaagccuugggaugugauucccauggugacccagauggcuaugacggacacaaccccuuucggccagcagagagucuuuaaagagaagguugauacccgcacacaagaacccaaagaggggacgaagaagcucaugaaaaucaccgccgaguggcuguggaaggaacuuggcaaaaagaaaacaccuagaauguguacccgggaggaguucacacgcaaggugagaucuaacgcggcccugggcgcuauuuuuaccgacgagaauaaauggaaguccgcccgggaggcuguggaagauagcggguucugggagcucgucgacaaggaaagaaaccugcaccuggagggaaaaugcgaaacauguguguauaauaugaugggcaagcgggagaaaaagcucggcgaguuugggaaagccaagggaucucgcgccaucugguacauguggcugggcgcgagauuccuugaauuugaggcucugggguuccucaacgaagaucauugguuuucccgggagaauagccuguccggaguugaaggcgaggggcuucacaagcugggcuacauccuccgcgacgugagcaaaaaggagggaggcgccauguaugccgaugacaccgcugggugggauacgagaauuacccuggaagaccugaaaaacgaggaaauggucacaaaucauauggagggagaacaccggaagcucgccgaggcuaucuuccgccugaccuaccagaacaaagugguuagagugcagcggcccacaccgcgcggcaccgucauggacauuaucucuagacgggaucagcgcgggagcggacaagugguuacguauggccuuaauacauucaccaacauggaggcccagcugauuagacagauggaaggggagggcguguuuaaguccauccaacaucucacagucaccgaagagaucgcggugaagaacuggcuggagcgggucggacgcgaaagacuuucucggauggccauuagcggcgacgauugcgugguuaaaccucuggacgauagauucgcuuccgcccucacggcucugaaugacauggggaaggugcgcaaagauauccagcagugggagcccucucggggauggaacgacuggacccagguccccuuuugcagccaccacuuccaugaacugauuaugaaggauggcagagugcucgugguuccuugucgcaaucaagacgagcugaucgggcgggccagaauuucccagggagcgggcuggucucuucgcgaaacagccugccuggggaaaagcuacgcucagauguggucccucauguauuuucaccggagagaucugcgccuugccgcuaacgccaucuguagcgcugugccgucucauuggguccccaucucccggaccacauggagcauucacgccacccacgaguggaugacaaccgaggacaugcugacgguguggaauagaguuuggauccaggaaaacccuuggauggaggauaagacacccguggaaucuugggaggaaauuccuuaccucggcaagcgcgaggaccaauggugcggaucccugaucggccugaccagccgggcgaccugggccaaaaauauucagacagcuaucaaccaggucagaucccucauugggaaugaggaauauaccgacuacaugcccucuaugaagcgguucagacgcgaggaagaggaagccggagugcugugguga

SEQ ID NO: 19598 - RNA, 9876 nt, Artificial Sequence
  derived and/or modified CDS sequence (opt5) from DENV-2__KX380834__SS-prME
accgccggaaucauuaucaugaugauucccaccgugauggcuuuccaccugacgaccagaaauggggagccucauaugaucgucagccggcaggaaaagggaaaaucccuccuguuuaagaccgagaauggcguuaacaugugcacccuuauggccauggaccugggggaacucugugaggauacgauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaccucaugagcgcugccauuaaagacaacagagcggugcacgccgauaugggcuacuggaucgagucugcucugaaugacacauggaagauugaaaaagccuccuucaucgaggucaagagcugccacuggcccaagucucauacccuguggagcaacggcguucuugaguccgaaaugaucauuccuaaaaauuucgcugggcccgugagccagcacaacuaucgcccgggauaccauacgcagacagccggcccuuggcaccucgggcggcuggagauggauuuugacuucugugaaggaaccaccguggucgugacagaggauugcggcaauagagggcccucucugcggaccacgacagccuccggaaagcucaucaccgaauggugcugucgcagcugcacacugcccccucuuagauaccggggcgaggacggcuguugguaugggauggagauuagaccgcugaaagaaaaggaggaaaaccucguuaauucccuggugaccgcuggacauggccagaucgauaacuuuucucuggggguccuuggaauggcgcuguuccuggaggaaaugcugcgcacacgggugggcaccaaacacgccauucuccugguugcugugagcuuugucacgcuuaucaccgggaauauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaagcugacgucuaaagagcucaugaugacaaccaucggcaucgugcugcuuagccaauccacaauuccugagucuauccuggaacucaccgaugcccuggcccuggggaugaugguccuuaagauuguucgcaacauggagaaauaucagcuggcugugaccaucauggccauucucugcgugcccaaugcggucauccugcagaacgcuuggaaggugagcuguacaacgcucgccguuguguccgucagcccucugcuucugaccucuucccaacagaaagccgacuggaucccccucgcucugacaauuaagggacugaauccuaccgccaucuuucuuacaacccugagcagaacgucuaagaaacgguccuggccccucaacgaagcuauuauggccgugggcaugguuagcauccuggcgucuucccuccugaagaaugauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaaaaacgaagaggaggaacagacccucacaauccugauucgcacgggccuccuggugaucuccgggcuuuucccuguuucuauucccaucaccgccgcugcgugguaucugugggaggugaagaaacaaagagccggaguccugugggacgugccgagcccucccccuguuggcaaggcugaacucgaggauggggccuaccggaucaaacagaagggcauucugggcuauucccagaucggcgccgggguguacaaggaaggaacauuucacaccauguggcaugucacacgcggcgcugugcuuaugcacaaagggaagagaauugagcccucuugggccgacgugaaaaaggaucugaucagcuacggaggcggguggaaacucgagggagaauggaaggagggcgaagagguucagguccuggcgcucgaacccggcaagaacccucgggcugugcaaaccaaaccggggcuguucaagacgaauaccggaacaauuggcgccgugucccuugacuuuagccccgggaccucuggauccccuaucgucgauaaaaagggcaaagugguugggcuguauggaaacggcguggucacaagaagcggcaccuacgugucugccaucgcucagacagagaaguccauugaggacaaucccgaaaucgaggaugacauuuuccgcaagaaacggcugacgaucauggaucuccauccuggggccggaaagaccaaaagauaucugcccgcgauuguucgcgaagcuaucaagcggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaacuauaaucugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaacgcgcccauuauggaugaggaacgcgagaucccugaaagaagcuggaacucuggccacgagugggucacggacuucaaagggaagacagugugguuugugcccuccauuaaggccggaaacgauaucgcugccugccuccggaaaaauggcaagaaagucauucaacugagcagaaagaccuucgacucugaauauaucaaaacccgcacaaacgauugggacuuuguugugaccacagauaucagcgagaugggggccaauuucaaggcugagcgggugauugacccuagacgcuguaugaagccggucauccuuaccgauggagaggaacgggugauucuggccggccccaugccuguuacgcauuccucugcggcucagagacgcgggcgggugggcagaaaccccaaaaaugaaaacgaccaguacaucuacaugggagagccucucgaaaaugaugaggacugcgcccacuggaaggaggccaaaaugcugcuggacaacauuaacacacccgaaggcaucaucccgagcauguuugagccugaacgcgagaaggucgaugcuauugacggggaauauagacuccggggagaggcccgcaaaaccuucguggaucuuaugagacggggcgaccugcccguuuggcuggcguaccgcguggccgcugaggggaucaauuaugccgauagacggugguguuuugacggagucaagaacaaucaaauucucgaagagaacguggaagucgagaucuggacaaaagagggcgaaagaaagaagcugaaaccucgcuggcuugaugcucggauuuacuccgacccccuggcccucaaggaguucaaagaguucgcugccgggagaaagucucugacccugaaucucaucacggagaugggccgccuuccuaccuuuaugacacagaaagcgaagaacgcccuggauaaucuggcugugcuccauaccgccgaagcuggaggccgggccuauaaccacgcccugagcgagcuucccgagacacuggaaacccuccugcugcucacacuucuggcuaccguuacagggggaauuuuccuguuucucauguccggcaaggggaucggaaaaaugacacugggcaugugcugcaucauuaccgcgagcauccuucugugguacgcccagauucagccgcacuggaucgcugccucuauuauccucgaguucuuucugaucgugcugcucauuccugaacccgagaagcaaagaacaccccaggacaaucagcuuacauauguggucaucgccauucugaccguuguggcugccacaauggcgaacgaaaugggcuuccuggagaaaacgaagaaagauuuugggcucggauccaucaccacacagcaaccugagagcaauauucuggacaucgaucuucggccggccuccgcuuggacccuguacgccguggcuacaaccuucaucacgcccaugcuccgccauucuauugaaaacagcuccgucaaugugucucugaccgccaucgcgaaccaggccacaguucugaugggccucgggaagggauggccucuuagcaagauggacauuggcgugccccugcuggcuaucggguguuacucccaggucaauccuauuacccucacagccgcucugcuucugcucguggcccacuaugcuaucauuggacccggccugcaggccaaagcgaccagagaggcccaaaagcgggcugccgcuggcaucaugaaaaacccuacggucgacgggaugacagugaucgaucuggacccgauucccuacgauccuaaguuugaaaaacagcucggacagguuaugcuucuggugcugugcgucacccaggugcucaugaugcgcacaaccugggcccugugugaggcccuuacccuggcgacaggccccaucagcacgcucugggaagggaauccuggaagauucuggaacaccacaauugcuguuucuauggccaacaucuuucggggcuccuaucuggcuggggccggacuccuguucagcauuaugaagaauaccgccaacacacgcagaggcaccggcaauacgggggagacacuuggagagaaguggaaaaaccggcugaaugcucugggcaagucugaauuucaaaucuacaaaaaguccgggauccaggagguggaccgcacccucgccaaagaaggaauuaagagaggcgagaccgaucaucacgcggucagccgggggucugccaaacugagaugguucguggagcgcaaccuugugacacccgaaggaaagguugucgaccugggcugcggcagagggggauggagcuauuacuguggcgggcucaagaaugugaaagaggugaagggacugaccaaaggcgggccgggacaugaagaaccuauccccauguccacauauggcuggaaccuggucagacuccagucuggcguugauguguucuuuacgcccccugaaaagugcgacacccuucugugugauauuggggagagcucccccaauccuacaguggaggcuggacgcacccugcggguccucaaccugguggaaaauuggcuuaacaauaacacacaauucugcaucaaaguucugaauccguacaugcccagcgugauugagaagauggaagcccuccagagaaaguacggcggggcucugguccgcaacccucugucccggaacucuacccacgagauguauugggugagcaaugccuccggaaacaucguuucuagcgugaauaugaucuccagaaugcucauuaaccgcuuuacgaugcggcacaaaaaggcgaccuacgaacccgacgucgaucuuggcucugggacaagaaauaucggaauugagagcgagaccccuaaccuggacaucauuggcaaacgcaucgaaaagaucaaacaggagcaugaaacauccuggcacuaugaucaggaccaucccuacaagaccugggccuaucacggcagcuacgagacaaagcaaaccgggucugcuuccagcauggugaauggagugguccggcugcucacgaaaccgugggacguuauuccuauggugacacagauggccaugaccgauaccacacccuucggccagcagagaguguuuaaggaaaaagucgacacgcgcacccaagagccuaaggaggggaccaaaaagcugaugaagaucaccgcugaauggcuuuggaaagagcugggaaagaaaaagacacccagaauguguacccgggaagaguucacacgcaaagugagaucuaacgccgcucucggcgccauuuuuaccgaugagaauaaguggaaauccgcgcgggaagccguugaggacagcggguucugggaacugguggauaaggagagaaaccugcaccucgaaggaaagugcgagacgugugucuauaauaugaugggcaaacgggagaagaaacugggcgaauuugggaaggcuaaaggaucucgcgccaucugguacauguggcuuggcgcuagauuccuggaguuugaagcccucggguuccugaacgaggaccauugguuuucccgggaaaauagccuuuccggaguggagggcgaggggcugcacaagcucggcuacauucugcgcgauguuagcaagaaagaaggaggcgccauguaugcggacgauaccgcugggugggacacaagaaucacccuggaggaucucaagaacgaagagauggugacaaaucauauggaaggagagcacaaaaagcuggccgaggccauuuucaaacuuaccuaccagaacaaggucgugcggguucagcgcccuacgcccagaggcacagugauggacaucaucucucggcgcgaccagagagggagcggacaagucgugaccuauggccugaacacauucaccaauauggaagcucagcucauucggcagauggagggggaaggcgucuuuaaguccauccaacagcugacggugaaagaggagauugccguuaagaacuggcuuauccgcgugggaagagaacggcugucucgcauggcuauuagcggcgaugacugcgucgugaaaccgcucgaugacagauucgccuccgcgcugaccgcccugaaugauauggggaaggugcggaaagacauccagcagugggagccuucuagaggauggaacgauuggacacaaguucccuuuugcagccaucacuuccacgaacucaucaugaaggacggccgcgugcuggucgugcccugucggaaucaggaugagcuuauugggagagcucgcaucucccagggagccggcuggucucugcgggaaaccgcuugccucggaaagagcuacgcccagauguggucccugauguauuuucauagacgcgaccuucggcuggcggccaacgcuauuuguagcgccguuccuucucacuggaucccgacauccagaaccacauggagcauucaugcuacccacgaguggaugacgacagaggauaugcucaccguguggaaucgcgucuggauccaagaaaaccccuggauggaggacaaaaccccuguggaaucuugggaggaaauccccuaccugggcaagcgggaggaucaguggugcggaucccugauuggccucacaagcagagccaccugggcuaaaaauauccagacagccauuaaccagguccgcucccugaucgggaaugaggaauauacggacuacaugccuucuaugaagcgguucagacgggaggaagaggaagcgggagugcuuugguga

SEQ ID NO: 19599 - RNA, 9876 nt, Artificial Sequence
  derived and/or modified CDS sequence (opt5) from DENV-2__KX380835__SS-prME
accgccggaaucauuaucaugaugauucccaccgugauggcuuuccaccugacgaccagaaacggggaaccucauaugaucgugagccggcaggaaaaggggaaaagccuccuguuuaagacagagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuauggcgauccugugcguuccuaacgcugugauccuccagaaugccuggaaagugagcuguacaauucuggccgucguguccguuagcccccuccugcuuacgucuucccaacagaaggcugacuggaucccucuggcccucaccauuaagggacugaaccccacagcuaucuuucugaccacacuuagcagaaccucuaaaaagcgguccuggccgcugaaugaagccauuauggcggugggcauggucagcauccucgccucuucccugcucaaaaacgauaucccuaugacggggccccugguggcuggaggccuucugacaguuugcuacgugcugaccggccgcagcgccgaccucgagcuggaaagagcugccgacguccggugggaggagcaggccgaaauuuccgggagcucuccuauccuuagcauuaccaucuccgaggauggaucuaugagcauuaagaaugaagaggaggaacagacacugaccauccucauucgcacaggccugcucgugaucuccgggcuguuccccgucucuaucccgauuacggcugcggccugguaucuuugggaggugaaaaagcaaagagcuggaguucugugggacgugccuucucccccucccgucggcaaagccgaacuggaggauggggccuaccggaucaagcagaagggcauucucggcuauucccagaucggcgcugggguguacaaagaaggaaccuuucacacaauguggcauguuacccgcggcgccgugcugaugcacaaggggaaaagaauugagcccuccugggcggacgucaagaaagaucuuaucagcuacggaggcggguggaagcuggagggagaauggaaggagggcgaagagguccaggugcucgcucuggaaccuggcaaaaacccgcgggccguucaaacaaagcccggacucuucaaaaccaacacgggaaccaucggcgccgucucccuggacuuuagcccugggacaucuggaucccccauuguggauaagaaaggcaagguggucgggcuuuauggaaauggcgugguuaccagaagcggcacauacgugucugcuaucgcccagaccgagaaguccauugaggacaacccugaaaucgaggaugacauuuuccgcaaaaagcggcugacaaucauggaucugcaucccggggcgggaaaaacgaagagauaucucccugcuaucguccgcgaagccauuaaacggggccugagaacccuuauccuggccccgacacgcgugguugcugccgagauggaagaggcucuccgggggcugcccauuagauaccagaccccugccauccgcgcggagcacaccggacgggaaauuguggaccucaugugucaugccacauucacgaugagacugcuuagccccauccgggucccuaauuauaaccugauuaucauggaugaggcucacuuuaccgaccccgccuccaucgcugcccgcggcuacauuucuacaagaguggaaaugggggaggccgcuggcaucuucaugaccgcgacaccgccuggaagccgggaccccuuuccccaguccaaugccccuauuauggaugaggaacgcgagauccccgaaagaagcuggaacucuggccacgaguggguuaccgacuucaaggggaagacggugugguuugucccuuccauuaaagcuggaaaugauaucgccgccugccugcggaagaacggcaaaaaggugauccaacucagcagaaaaacauucgacucugaauauauuaagacccgcaccaaugauugggacuuuguggucacaaccgauaucagcgagaugggggcuaacuucaaggccgagcggguuauugacccgagacgcuguaugaaacccgugauccugacagauggagaagaacgggugauucuugcgggcccuaugcccgucacccauuccucugcugcccagagacgcgggcgggugggcagaaauccuaagaacgaaaaugaccaguacaucuacaugggagagccccuggaaaacgaugaggacugcgcccacuggaaagaggcuaagaugcuccuggacaauaucaacacgccggaaggcauuaucccuagcauguuugagcccgaacgcgagaaaguugaugccauugacggggaauauagacugcggggagaggcgcgcaagacauucguggaucucaugagacggggcgaccuuccugucuggcuggccuaccgcguggcugccgaggggaucaacuaugcugauagacggugguguuuugacggaguuaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcggggagaaaaucucucacacugaaccugaucaccgagaugggccgccuccccacguuuaugacccagaaggcccggaaugcucuugauaaccuggccgugcugcauacagcugaagccggaggcagagccuauaaucacgcucucagcgagcugccggagacccuugaaacacugcuccugcugacccuccuugcgacagucaccgggggaaucuuccuguuucugauguccggcaaggggauuggaaaaaugacgcucggcaugugcugcaucauuacagccagcauccugcuuugguacgcucagauucagccucacuggaucgccgccucuaucauucuggaguucuuucucaucgugcugcugauucccgaacccgagaagcaacggaccccucaggacaaccagcucaccuauguugugaucgcuauucuuacaguggucgccgcgaccauggccaaugaaaugggcuuccuggagaaaacaaagaaagauuuugggcugggauccaucacgacccagcaaccggacagcaacauccucgauauugaccugcgccccgcuuccgccuggacacuuuacgcuguugccaccacauucaucaccccuaugcugagacauucuauugagaauagcuccgugaacgugucucucacggcgaucgccaaucaggcuaccguccugaugggccuggggaagggauggccccucagcaagauggacauuggcgugccucuucuggccaucggguguuacucccagguuaaccccauuacacugaccgcugcccuccugcuucugguggcucacuaugccaucaucggaccuggccuccaggcgaaagccacacgggaagcucaaaagcgcgccgcugccggcauuaugaaaaauccgaccgucgaugggaugacggugaucgaccuggaucccauuccuuacgaccccaaguuugagaaacagcugggacaggucaugcuccuugugcugugcguuacacaggugcugaugaugagaaccacaugggcccucugugaagcgcugacccuugcuaccggcccuaucagcacacugugggaggggaaccccggacgguucuggaauacgaccauugccgucucuauggcuaacaucuuucgcggcuccuaucucgccggggccggacugcuguucagcaucaugaagaacacagcuaauaccagacggggcacaggcaacaccggggaaacgcucggagagaaguggaaaaaucgccuuaacgcccugggcaagucugaguuucaaauuuacaaaaaguccgggauccaggaaguggauagaacacuggcgaaagagggaauuaagcggggcgaaaccgaccaucacgccguuagcagagggucugcuaaacuccgcugguucguggagcggaaucuggucaccccggagggaaaggugguggaucuuggcugcggcagagggggauggagcuauuacuguggcgggcugaagaacguuaaagaagucaagggacucacaaaaggcgggccuggacaugaggaacccauccccauguccaccuauggcuggaaucuggugcgccugcagucuggcguggacgucuucuuuacaccucccgagaagugcgauacgcuccuuugugacauuggggaaagcuccccuaacccgaccguugaggccggacggacacugagagugcugaaucucguggagaacuggcugaauaacaauacccaauucugcaucaaaguccuuaaccccuacaugccuagcgugaucgaaaagauggaggcucugcagcgcaaguacggcggggcccucguucggaauccccuguccagaaacucuacacacgaaauguauugggugagcaacgcguccggaaauauugucucuagcgugaacaugaucucccgcaugcugauuaaucgguuuaccaugaaacacaagaaagccacguacgagccugauguugaccucggcucugggaccagaaacaucggaauugaaagcgagacacccaaucuugauaucaucggcaagcgcauugagaaaaucaagcaggaacaugagaccuccuggcacuaugaccaggaccauccguacaagacaugggcuuaucacggcagcuacgaaaccaaacaaacagggucugccuccagcauggugaacggagucgugcggcugcugaccaagccuugggaugugauucccauggucacgcagauggcuaugacagacaccaccccuuucggccagcagagaguuuuuaaagagaagguggauacacgcacgcaagaacccaaagaggggaccaagaagcucaugaaaaucacagccgaguggcuguggaaggaacuuggcaaaaagaaaaccccuagaauguguacacgggaggaguucacccgcaaggugagaucuaaugcugcccugggcgcgauuuuuacagacgagaacaaauggaaguccgcccgggaggcugucgaagauagcggguucugggagcucguggacaaggaaagaaaucugcaccuggagggaaaaugcgaaaccuguguuuauaacaugaugggcaagcgggagaaaaagcucggcgaguuugggaaagccaagggaucucgcgcuaucugguacauguggcugggcgccagauuccuugaauuugaggcccugggguuccucaaugaagaucauugguuuucccgggagaacagccuguccggaguggaaggcgaggggcuucacaagcugggcuacauucuccgcgacgucagcaaaaaggagggaggcgcgauguaugcugaugacacggccgggugggauaccagaaucacacuggaagaccugaaaaaugaggaaauggugaccaaccauauggagggagaacaccggaagcucgccgaggcuaucuuccgccugacauaccagaauaaaguugugagaguccagcggcccaccccgcgcggcacggugauggacauuaucucuagacgggaucagcgcgggagcggacaaguugugacauauggccuuaacaccuucacaaacauggaggcccagcugauuagacagauggaaggggagggcgucuuuaaguccauccaacaucucaccgugacggaagagauugcugucaagaauuggcuggagcgggugggacgcgaaagacuuucucggauggccaucagcggcgacgauugcguugugaaaccucuggacgauagauucgcguccgcccucaccgcucugaacgacauggggaagguccgcaaagauauccagcagugggagcccucucggggauggaaugacuggacacaggugcccuuuugcagccaccacuuccaugaacugauuaugaaggauggcagagugcucguugugccuugucgcaaccaagacgagcugaucgggcgggccagaauuucccagggagcuggcuggucucuucgcgaaaccgccugccuggggaaaagcuacgcgcagauguggucccucauguauuuucaccggagagaucugcgccuugccgcuaaugccaucuguagcgcugucccgucucauugggugcccauuucccggacaaccuggagcauccacgccacacacgaguggaugaccacggaggacaugcugacaguuuggaacagaguguggauccaggaaaauccuuggauggaggauaagacccccgucgaaucuugggaggaaauuccuuaccucggcaagcgcgaggaccaauggugcggaucccugaucggccugaccagccgggcuacaugggccaaaaacauucagaccgcgaucaaucaggugagaucccucauugggaacgaggaauauacagacuacaugcccucuaugaagcgguucagacgcgaggaagaggaagccggaguccugugguga

SEQ ID NO: 19600 - RNA, 9876 nt, Artificial Sequence
  derived and/or modified CDS sequence (opt5) from DENV-2__KX380836__SS-prME
accgccggaaucauuaucaugaugauucccacagugauggcuuuccaccugacgaccagaaacggggagccucauaugaucgugagccggcaggaaaaggggaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuauggcgauccugugcguuccuaacgcugugauccuccagaaugccuggaaagugagcuguacaauucuggccgucguguccguuagcccccuccugcuuacgucuucccaacagaaggcugacuggaucccucuggcccucaccauuaagggacugaaccccacagcuaucuuucugaccacacuuagcagaaccucuaaaaagcgguccuggccgcugaaugaagccauuauggcggugggcauggucagcauccucgccucuucccugcucaaaaacgauaucccuaugacggggccccugguggcuggaggccuucugacaguuugcuacgugcugaccggccgcagcgccgaccucgagcuggaaagagcugccgacguccggugggaggagcaggccgaaauuuccgggagcucuccuauccuuagcauuaccaucuccgaggauggaucuaugagcauuaagaaugaagaggaggaacagacacugaccauccucauucgcacaggccugcucgugaucuccgggcuguuccccgucucuaucccgauuacggcugcggccugguaucuuugggaggugaaaaagcaaagagcuggaguucugugggacgugccuucucccccucccgucggcaaagccgaacuggaggauggggccuaccggaucaagcagaagggcauucucggcuauucccagaucggcgcugggguguacaaagaaggaaccuuucacacaauguggcauguuacccgcggcgccgugcugaugcacaaggggaaaagaauugagcccuccugggcggacgucaagaaagaucuuaucagcuacggaggcggguggaagcuggagggagaauggaaggagggcgaagagguccaggugcucgcucuggaaccuggcaaaaacccgcgggccguucaaacaaagcccggacucuucaaaaccaacacgggaaccaucggcgccgucucccuggacuuuagcccugggacaucuggaucccccauuguggauaagaaaggcaagguggucgggcuuuauggaaauggcgugguuaccagaagcggcacauacgugucugcuaucgcccagaccgagaaguccauugaggacaacccugaaaucgaggaugacauuuuccgcaaaaagcggcugacaaucauggaucugcaucccggggcgggaaaaacgaagagauaucucccugcuaucguccgcgaagccauuaaacggggccugagaacccuuauccuggccccgacacgcgugguugcugccgagauggaagaggcucuccgggggcugcccauuagauaccagaccccugccauccgcgcggagcacaccggacgggaaauuguggaccucaugugucaugccacauucacgaugagacugcuuagccccauccgggucccuaauuauaaccugauuaucauggaugaggcucacuuuaccgaccccgccuccaucgcugcccgcggcuacauuucuacaagaguggaaaugggggaggccgcuggcaucuucaugaccgcgacaccgccuggaagccgggaccccuuuccccaguccaaugccccuauuauggaugaggaacgcgagauccccgaaagaagcuggaacucuggccacgaguggguuaccgacuucaaggggaagacggugugguuugucccuuccauuaaagcuggaaaugauaucgccgccugccugcggaagaacggcaaaaaggugauccaacucagcagaaaaacauucgacucugaauauauuaagacccgcaccaaugauugggacuuuguggucacaaccgauaucagcgagaugggggcuaacuucaaggccgagcggguuauugacccgagacgcuguaugaaacccgugauccugacagauggagaagaacgggugauucuugcgggcccuaugcccgucacccauuccucugcugcccagagacgcgggcgggugggcagaaauccuaagaacgaaaaugaccaguacaucuacaugggagagccccuggaaaacgaugaggacugcgcccacuggaaagaggcuaagaugcuccuggacaauaucaacacgccggaaggcauuaucccuagcauguuugagcccgaacgcgagaaaguugaugccauugacggggaauauagacugcggggagaggcgcgcaagacauucguggaucucaugagacggggcgaccuuccugucuggcuggccuaccgcguggcugccgaggggaucaacuaugcugauagacggugguguuuugacggaguuaaaaauaaccaaauucuggaagagaauguggaagucgagaucuggaccaaggagggcgaaagaaagaaacucaagccccgcuggcuggaugcccggauuuacuccgacccucuugcucugaaagaguucaaggaguucgccgcggggagaaaaucucucacacugaaccugaucaccgagaugggccgccuccccacguuuaugacccagaaggccaagaaugcucuugauaaccuggccgugcugcauacagcugaagccggaggccgggccuauaaucacgcucucagcgagcugccggagacccuugaaacacugcuccugcugacccuccuugcgacagucaccgggggaaucuuccuguuucugauguccggcaaagggauuggaaagaugacgcucggcaugugcugcaucauuacagccagcauccugcuuugguacgcucagauucagccucacuggaucgccgccucuaucauucuggaguucuuucucaucgugcugcugauucccgaacccgagaaacaaagaaccccucaggacaaccagcucaccuauguugugaucgcuauucuuacaguggucgccgcgaccauggccaaugaaaugggcuuccuggagaagaccaaaaaggauuuugggcugggauccaucacgacccagcaaccggagagcaacauccucgacauugaucugcggcccgcuuccgccuggacacuuuacgcuguugccaccacauucaucaccccuaugcugcgccauucuauugaaaauagcuccgugaacgugucucucacggcgaucgccaaucaggcuaccguccugaugggccuggggaagggauggccccucagcaaaauggacauuggcgugccucuucuggccaucggguguuacucccagguuaaccccauuacacugaccgcugcccuccugcuucugguggcucacuaugccaucaucggaccuggccuccaggcgaaggccacaagagaggcucaaaaacgggccgcugccggcauuaugaagaauccgaccgucgacgggaugacggugaucgaucuggaccccauuccuuacgaucccaaauuugaaaagcagcugggacaggucaugcuccuugugcugugcguuacacaggugcugaugaugcgcaccacaugggcccucugugaggcgcugacccuugcuaccggcccuaucagcacacugugggaagggaaccccggaagauucuggaauacgaccauugccgucucuauggcuaacaucuuucggggcuccuaucucgccggggccggacugcuguucagcaucaugaagaacacagcuaauacccgcagaggcacaggcaacaccggggagacgcucggagagaaauggaagaaucggcuuaacgcccugggcaaaucugaauuucaaauuuacaagaaauccgggauccaggagguggaccgcacacuggcgaaggaaggaauuaaaagaggcgagaccgaucaucacgccguuagccgggggucugcuaagcucagaugguucguggagcgcaaucuggucaccccggaaggaaaggugguggaccuuggcugcggcagaggcggguggagcuauuacuguggagggcugaaaaacguuaaggaggucaaagggcucacaaagggcgggccuggacaugaggaacccauccccauguccaccuauggcuggaaucuggugagacugcagucuggcguggaugucuucuuuacaccucccgaaaaaugcgacacgcuccuuugugauauuggggagagcuccccuaacccgaccguugaggccggacgcacacugcgggugcugaaucucguggaaaacuggcugaauaacaauacccaauucugcaucaagguccuuaaccccuacaugccuagcgugaucgagaagauggaagcucugcagagaaaauacggcggggcccucguucgcaauccccugucccggaacucuacacacgagauguauugggugagcaacgcguccggaaauauugucucuagcgugaacaugaucuccagaaugcugauuaaucgcuuuaccaugaagcacaaaaaggccacguacgaaccugacguugaucucggcucugggacccggaacaucggaauugagagcgagacacccaaucuugacaucaucggcaaaagaauugaaaagaucaagcaggagcaugaaaccuccuggcacuaugaucaggaccauccguacaaaacaugggcuuaucacggcagcuacgagaccaagcaaacagggucugccuccagcauggugaacggagucgugcgccugcugaccaaaccuugggacgugauucccauggucacgcagauggcuaugacagauaccaccccuuucggccagcagcggguuuuuaaggaaaaaguggacacaagaacgcaagagcccaaggaggggaccaagaaacucaugaagaucacagccgaauggcuguggaaagagcuuggaaagaaaaagaccccucgcauguguacaagagaagaguucacccggaaagugcgcucuaaugcugcccugggcgcgauuuuuacagaugagaacaaguggaaguccgccagagaagcugucgaggacagcggguucugggaacucguggauaaagagcggaaucugcaccuggaaggaaagugcgagaccuguguuuauaacaugaugggcaaaagagagaagaaacucggcgaauuugggaaggccaagggaucucgggcuaucugguacauguggcugggcgcccgcuuccuugaguuugaagcccugggguuccucaaugaggaccauugguuuuccagagaaaacagccuguccggaguggagggcgaggggcuucacaaacugggcuacauucuccgggaugucagcaagaaagaaggaggcgcgauguaugcugacgauacggccgggugggacacccgcaucacacuggaggaucugaagaaugaagagauggugaccaaccauauggaaggagagcacagaaaacucgccgaggcuaucuuccggcugacauaccagaauaagguugugcgcguccagagacccaccccgcggggcacggugauggacauuaucucucgcagagaccagcgggggagcggacaaguugugacauauggccuuaacaccuucacaaacauggaagcccagcugauucgccagauggagggggaaggcgucuuuaaguccauccaacaucucaccgugacggaggagauugcugucaaaaauuggcuggaaagagugggacgggagcgccuuucuagaauggccaucagcggcgaugacugcguugugaagccucuggaugaccgguucgcguccgcccucaccgcucugaacgauauggggaaagucagaaaggacauccagcagugggaacccucucgcggauggaaugauuggacacaggugcccuuuugcagccaccacuuccaugagcugauuaugaaagacggccgggugcucguugugccuuguagaaaccaagaugaacugaucgggcgcgcccggauuucccagggagcuggcuggucucuuagagagaccgccugccugggaaagagcuacgcgcagauguggucccucauguauuuucaccgccgggaccugagacuugccgcuaaugccaucuguagcgcugucccgucucauugggugcccauuucccgcacaaccuggagcauccacgccacacacgaguggaugaccacggaagauaugcugacaguuuggaaccggguguggauccaggagaauccuuggauggaagacaagacccccgucgagucuugggaagagauuccuuaccucggcaaaagagaggaucaauggugcggaucccugaucggccugaccagccgcgcuacaugggccaagaacauucagaccgcgaucaaucaggugcggucccucauugggaacgaagaguauacagacuacaugcccucuaugaaaagauuccggagagaagaggaagaggccggaguccugugguga

SEQ ID NO: 19601 - RNA, 9876 nt, Artificial Sequence
  derived and/or modified CDS sequence (opt5) from DENV-2__KX380838__SS-prME
accgccggaaucauuaucaugaugauucccaccgugauggcuuuccaccugacgaccagaaacggggaaccucauaugaucgugagccggcaggaaaagggaaaaagccuccuguuuaagacggagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggguucugcgccaucccggcuucaccgugauggcugccauucuggcuuacacaaucgggaccaccuauuuucagagaguccucauuuucauccugcuuacagccguggcgccuuccaugacgaugcggugcauuggaaucucuaaccgcgacuuuguugaaggcgugagcgggggauccugggucgauauugugcuggagcacggcagcugugugaccacaauggccaaaaauaagcccacccucgacuucgaacugaucaagacagaggcuaaacacccugccacccuuagaaaguacugcaucgaagcuaaacugacgaacacaaccaccgccucucgguguccgacacagggggagcccucccucaaugaggaacaagauaagcgcuuugucugcaaacauagcaugguugacagaggauggggcaacggcugugggcuguucggaaagggcgggauugugaccugcgcgauguuuacaugcaagaaaaauauggagggaaagaucgugcagccugaaaaccuggaguauacgauugucaucacaccccacucuggcgaagagaaugccguggggaacgauacaggaaaacauggcaaggagauuaaaguuaccccucaguccagcaucacagaagcugagcucaccggcuacgggacggccaccauggaauguucuccccggacaggacuggacuucaaugagauggugcuucugcagauggaaaacaaggcuuggcucguccaccgccaaugguuucuggaucuuccgcugccuuggcuccccggcgccgacacccagggguccaacuggauccagaaagagacacuggugaccuucaagaauccucacgccaagaaacaggauguugugguccugggaagccaagagggcgcuaugcauacggcgcucacaggggccaccgaaauucagauguccucuggcaaccugcuuuuuacaggacaccugaagugcagacuccggauggacaaacugcagcuuaagggcaugagcuauuccauguguaccgggaaauucaagguggucaaggagaucgcugaaacccaacauggaacaauugugaucagaguucaguacgagggcgacgggagccccugcaaaauucccuucgagaucauggaucuggaaaagcgccacgugcucggacggcugaucacggucaauccuauugugaccgagaaagacucuccgguuaacaucgaagccgagcccccuuuuggcgauuccuacauuaucauugggguggaacccggccagcugaagcucagcugguucaaaaagggaucuagcaucggccagauguuugagacaaccaugagaggggccaagcgcauggcuauucugggagacacagccugggauuucggcucccuugggggagucuuuaccucuaucggcaaagcgcugcaucaaguguucggggcuaucuauggcgccgccuuuagcggaguguccuggacgaugaagauucucaucggcguugucauuacauggaucgggaugaauagccggucuaccucccugagcgugucucuggugcuugucggaauugugacccucuaccugggcguuauggugcaggcugacuccgggugugucgugagcuggaaaaacaaggagcugaaaugcggauccggcaucuucaucacagauaauguucacaccuggacagaacaguauaaguuucagccugagucucccagcaagcucgccuccgcuauucaaaaagcccacgaagaggggaucuguggcauuagaucugugacgcgccuggaaaaccuuauguggaagcagaucaccccggagcugaaucauauucucagcgagaacgaagucaaacugacaaucaugaccggagacaucaagggcauuaugcaggcggggaaacggucccugagaccucagcccacagagcuuaaguacagcuggaaagccuggggaaaggcuaagaugcucucuaccgaacugcacaaucauacguuccugaucgauggcccugagaccgccgaaugccccaacacaaaucgcgcuuggaacucccucgagguggaggacuauggguuuggaguuuucaccacaaauauuuggcugaaacuuaaggaacggcaagauguguuuugugacagcaaacugaugucugccgcgaucaaggacaacagagccguccacgcugauaugggcuacuggauugaguccgcccucaacgacaccuggaaaaucgaaaaggcuagcuucaucgaggugaagucuugccacuggccuaaaagccauacacugugguccaauggcgugcuggagagcgaaaugauuauccccaagaacuucgccgggccggucucucagcacaauuaucgcccuggauaccauacccagacggccggccccuggcaccuugggcggcucgagauggauuuugacuucugugaaggaacaaccguuguggugaccgaggauugcggcaacagagggcccucccugcggacaaccacggcuagcggaaaacugauuacagaauggugcugucgcuccugcacccucccuccgcugagauaccggggcgaggacggcuguugguaugggauggagaucagaccccuuaaggaaaaagaggaaaaucuggucaacucucucgugacagcgggacauggccagauugauaauuuuagccuggggguucugggaauggcccuuuuccucgaggaaaugcugcgcacccgggugggcacaaagcacgcuauccugcucgucgccguguccuuuguuacccugauuacggggaacaugucuuucagagaccuuggacgcgugauggucauggugggcgccaccaugacagaugacaucggcauggggguuaccuaccuggcucuccuggccgcguuuaaggugagaccuacauucgcugccggacugcuucugcggaaacucaccagcaaggagcugaugaugacgacaaucggcauuguccuccugucccaaucuaccauccccgagacaauucuugaacugaccgaugcccucgcucuggggaugauggugcugaaaaucgugcgcaauauggagaaguaucagcuugccgucaccauuauggcgacacugugcguuccuaacgcugugauccuccagaaugccuggaaagugagcuguacgauccuggccgucguguccguuagcccccuccugcuuaccucuucccaacagaaggcugacuggauuccucuggcccucacaaucaagggacugaaccccaccgcuauuuuucugacaacccuuagcagaacgucuaaaaagcgguccuggccgcugaaugaagccaucauggcggugggcauggucagcauucucgccucuucccugcucaaaaacgauaucccuaugacagggccccugguggcuggaggccuucugaccguuugcuacgugcugaccggccgcagcgccgaccucgagcuggaaagagcugccgacguccggugggaggagcaggccgaaaucuccgggagcucuccuauucuuagcaucacaauuuccgaggauggaucuaugagcaucaagaaugaagaggaggaacagacccugacaauucucauccgcacgggccugcucgugauuuccgggcuguuccccgucucuaucccgaucaccgcugcggccugguaucuuugggaggugaaaaagcaaagagcuggaguucugugggacgugccuucucccccucccgucggcaaagccgaacuggaggauggggccuaccggauuaagcagaagggaauccucggcuauucccagauuggcgcugggguguacaaagaaggaacauuucacaccauguggcauguuacacgcggcgccgugcugaugcacaaggggaaaagaaucgagcccuccugggcggacgucaagaaagaucuuauuagcuacggaggcggguggaagcuggagggagaauggaaggagggcgaagagguccaggugcucgcucuggaaccuggcaaaaacccgcgggccguucaaaccaagcccggacucuucaaaacgaacaccggaacaaucggcgccgucucccuggacuuuagcccugggaccucuggaucccccaucguggauaagaaaggcaagguggucgggcuuuauggaaauggcgugguuacaagaagcggcaccuacgugucugcuauugcccagacagagaaguccaucgaggacaacccugaaauugaggaugacaucuuccgcaaaaagcggcugacgauuauggaucugcaucccggggcgggaaaaaccaagagauaucucccugcuaucguccgcgaagccaucaaacggggccugagaacacuuauucuggccccgacccgcgugguugcugccgagauggaagaggcucuccgggggcugcccaucagauaccagaccccugccauucgcgcggagcacacaggacgggaaaucguggaccucaugugucaugccacguucaccaugagacugcuuagccccauucgggucccuaauuauaaccugaucauuauggaugaggcucacuuuacagaccccgccuccaucgcugcccgcggcuacaucucuaccagaguggaaaugggggaggccgcuggcauuuucaugacagcgaccccgccuggaagccgggaccccuuuccccaguccaaugccccuaucauggaugaggaacgcgagauucccgaaagaagcuggaacucuggccacgaguggguuacggacuucaaggggaagacagugugguuugucccuuccaucaaagcuggaaaugauauugccgccugccugcggaagaacggcaaaaaggugauccaacucagcagaaaaaccuucgacucugaauauaucaagacccgcacaaaugauugggacuuuguggucaccacagauauuagcgagaugggggcuaacuucaaggccgagcggguuaucgacccgagacgcuguaugaaacccgugauucugaccgauggagaagaacgggugauccuugcgggcccuaugcccgucacgcauuccucugcugcccagagacgcgggcgggugggcagaaauccuaagaacgaaaaugaccaguacauuuacaugggagagccccuggaaaacgaugaggacugcgcccacuggaaagaggcuaagaugcuccuggacaauaucaacacaccggaaggcaucauuccuagcauguuugagcccgaacgcgagaaaguugaugccaucgacggggaauauagacugcggggagaggcgcgcaagaccuucguggaucucaugagacggggcgaccuuccugucuggcuggccuaccgcguggcugccgaggggauuaacuaugcugauagacggugguguuuugacggaguuaaaaauaaccaaauccuggaagagaauguggaagucgagauuuggacaaaggagggcgaaagaaagaaacucaagccccgcuggcuggaugcccggaucuacuccgacccucuugcucugaaagaguucaaggaguucgccgcggggagaaaaucucucacccugaaccugauuacggagaugggccgccuccccaccuuuaugacacagaaggcccggaaugcucuugauaaccuggccgugcugcauaccgcugaagccggaggcagagccuauaaucacgcucucagcgagcugccggagacacuugaaacccugcuccugcugacacuccuugcgaccgucacaggcgggaucuuccuguuucugauguccgggaaggggaucggaaaaaugacacucggcaugugcugcauuaucaccgccagcauucugcuuugguacgcucagauccagccucacuggauugccgccucuaucauccuggaguucuuucucauugugcugcugauccccgaacccgagaagcaacggaccccucaggacaaccagcucacauauguugugauugcuauccuuaccguggucgccgcgacaauggccaaugaaaugggcuuccuggagaaaacgaagaaagauuuugggcugggauccauuaccacacagcaaccggacagcaacauccucgauaucgaccugcgccccgcuuccgccuggacccuuuacgcuguugccacaaccuucauuacgccuaugcugagacauucuaucgagaauagcuccgugaacgugucucucaccgcgauugccaaucaggcuacaguccugaugggccuggggaagggauggccccucagcaagauggacaucggcgugccucuucuggccauuggguguuacucccagguuaaccccaucacccugacagcugcccuccugcuucugguggcucacuaugccauuaucggaccuggccuccaggcgaaagccacccgggaagcucaaaagcgcgccgcugccggcaucaugaaaauuccggccgcggaugggaucacggucauugaccuggaucccaucccuuacgaccccaaguuugagaaacagcugggacaggugaugcuccuuguccugugcgugacacagguucugaugaugagaaccacaugggcucucugugaagcccugacccuugcuaccggcccuauuagcacacugugggaggggaaucccggacgguucuggaacacgaccaucgccgugucuauggccaauaucuuucgcggcuccuaucucgcuggggccggacugcuguucagcauuaugaagaacacagcgaacaccagacggggcacaggcaauaccggggaaacgcucggagagaaguggaaaaaccgccuuaaugcccugggcaagucugaguuucaaaucuacaaaaaguccgggauucaggaagucgauagaacacuggcuaaagagggaaucaagcggggcgaaaccgaccaucacgccgugagcagagggucugcuaaacuccgcugguucguugagcggaaccuggugaccccggagggaaaggucguggaucuuggcugcggcagagggggauggagcuauuacuguggcgggcugaagaaugugaaagaaguuaagggacucacaaaaggcgggccuggacaugaggaacccauucccauguccaccuauggcuggaaccugguccgccugcagucuggcguggacguguucuuuacaccucccgagaagugcgauacgcuccuuugugacaucggggaaagcuccccuaauccgaccgucgaggccggacggacacugagaguucugaaccucguggagaauuggcugaacaauaacacccaauucugcaucaaagugcuuaaucccuacaugccuagcgucauugaaaagauggaggcgcugcagcgcaaguacggcggggcccucgugcggaacccccuguccagaaauucuacacacgaaauguauuggguuagcaacgcuuccggaaacaucgugucuagcgucaauaugauuucccgcaugcugaucaaccgguuuaccaugaaacacaagaaagccacguacgagccugauguggaccucggcucugggaccagaaauauuggaaucgaaagcgagacacccaaccuugauaucauuggcaagcgcaucgagaaaauuaagcaggaacaugagaccuccuggcacuaugaccaggaccauccguacaagacaugggcuuaucacggcagcuacgaaaccaaacaaacagggucugccuccagcaugguuaauggagugguccggcugcugaccaagccuugggaugugauccccauggugacgcagauggcuaugacagacaccaccccuuucggccagcagagagucuuuaaagagaagguugauacacgcacgcaagaacccaaagaggggaccaagaagcucaugaaaauuacagccgaguggcuguggaaggaacuuggcaaaaagaaaaccccuagaauguguacacgggaggaguucacccgcaaggugagaucuaacgcggcccugggcgcuaucuuuacagacgagaauaaauggaaguccgcccgggaggcuguggaagauagcggguucugggagcucgucgacaaggaaagaaaccugcaccuggagggaaaaugcgaaaccuguguguauaauaugaugggcaagcgggagaaaaagcucggcgaguuugggaaagccaagggaucucgcgccauuugguacauguggcugggcgcgagauuccuugaauuugaggcucugggguuccucaacgaagaucauugguuuucccgggagaauagccuguccggaguugaaggcgaggggcuucacaagcugggcuacauccuccgcgacgugagcaaaaaggagggaggcgccauguaugccgaugacacggcugggugggauaccagaaucacacuggaagaccugaaaaacgaggaaauggucaccaaucauauggagggagaacaccggaagcucgccgaggcuauuuuccgccugacauaccagaacaaagugguuagagugcagcggcccaccccgcgcggcacggucauggacaucauuucuagacgggaucagcgcgggagcggacaagugguuacauauggccuuaauaccuucacaaacauggaggcccagcugaucagacagauggaaggggagggcguguuuaaguccauucaacaucucaccgucacggaagagaucgcggugaagaacuggcuggagcgggucggacgcgaaagacuuucucggauggccaucagcggcgacgauugcgugguuaaaccucuggacgauagauucgcuuccgcccucaccgcucugaaugacauggggaaggugcgcaaagauauucagcagugggagcccucucggggauggaacgacuggacacagguccccuuuugcagccaccacuuccaugaacugaucaugaaggauggcagagugcucgugguuccuugucgcaaucaagacgagcugauugggcgggccagaaucucccagggagcgggcuggucucuucgcgaaaccgccugccuggggaaaagcuacgcucagauguggucccucauguauuuucaccggagagaucugcgccuugccgcuaacgccauuuguagcgcugugccgucucauuggguccccaucucccggacaaccuggagcauccacgccacacacgaguggaugaccacggaggacaugcugacaguguggaauagaguuuggauucaggaaaacccuuggauggaggauaagacccccguggaaucuugggaggaaaucccuuaccucggcaagcgcgaggaccaauggugcggaucccugauuggccugaccagccgggcgacaugggccaaaaauauccagaccgcuauuaaccaggucagaucccucaucgggaaugaggaauauacagacuacaugcccucuaugaagcgguucagacgcgaggaagaggaagccggagugcugugguga

SEQ ID NO: 19602 - RNA, 9876 nt, Artificial Sequence
  derived and/or modified CDS sequence (opt5) from DENV-2__KM279515__SS-prME
accgccggaaucauuaucaugaugauucccaccgugauggcuuuccaccugacgaccagaaacggggaaccucauaugaucgugagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacgcucugggacggcugaucacggucaaucccauugugaccgagaaagacucuccuguuaacaucgaagccgagccgcccuuuggcgauuccuacauuaucauugggguggaaccuggccagcucaagcugagcugguucaaaaagggaucuagcaucggccagauguuugagacaaccaugagaggggccaagcgcauggcuauucuuggagacacagccugggauuucggcucccucgggggagucuuuaccucuaucggcaaagcgcuccaucaaguguucggggcuaucuauggcgccgccuuuagcggaguguccuggacgaugaagauucugaucggcguugucauuacauggaucgggaugaauagccggucuaccucccugagcgugucucuugugcucgucggagugguuacccuguaccugggcgugaugguccaggcugacuccgggugugugguuagcuggaaaaacaaggagcucaaaugcggauccggcauuuucaucacagauaaugugcacaccuggacagaacaguauaaguuucagcccgagucuccuagcaagcuggccuccgcuauccaaaaagcccacgaagaggggauuuguggcaucagaucugucacgcgccuugaaaaccugauguggaagcagauuacccccgagcucaaucauauccugacagagaacgaagugaaacugaccauuaugacaggagacaucaagggcaucaugcaggcggggaaacggagccuuagaccgcagccuaccgagcucaaguacuccuggaaagccuggggaaaggcuaagaugcugagcacggaacugcacaaucauaccuuccucauugauggccccgagacagccgaaugcccuaacaccaaucgcgcuuggaacucucuggagguugaggacuauggguuuggaguguucacaaccaauaucuggcuuaaacugaaggaacggcaagaugucuuuugugacuccaaacucaugagcgccgcgauuaaggacaacagagccgugcacgcugauaugggcuacuggaucgagucugcccugaacgacacauggaaaauugaaaaggcuuccuucaucgaggucaagagcugccacuggcccaaaucucauacccuguggagcaauggcguccuugaguccgaaaugaucauuccuaagaacuucgccgggcccguuagccagcacaauuaucgcccgggauaccauacgcagacagccggcccuuggcaccucgggcggcuggagauggauuuugacuucugugaaggaaccaccgugguggucacagaggauugcggcaacagagggcccucucugcggaccacgacagcuuccggaaaacucaucaccgaauggugcugucgcagcugcacacugcccccucuuagauaccggggcgaggacggcuguugguaugggauggagauuagaccgcugaaggaaaaagaggaaaaucucgugaacucccugguuaccgcgggacauggccagaucgauaauuuuucucugggggugcuuggaauggcccucuuccuggaggaaaugcugcgcacacgggucggcaccaagcacgcuauucuccugguggccguuagcuuugugacgcuuaucaccgggaacauguccuucagagaccugggacgcgucauggugaugguuggcgccacaaugaccgaugacauuggcaugggggugacauaccucgcucugcuggccgcguuuaaggucagacccaccuucgcugccggacuucugcuccggaaacugacgucuaaggagcucaugaugacaaccaucggcaucgugcugcuuagccaauccacaauuccugagucuauccuggaacucaccgaugcccuggcucuggggaugauggugcuuaaaauuguccgcaauauggagaaguaucagcuggccguuaccaucauggcgauucucugcgugcccaacgcugugauccugcagaaugccuggaaagucagcuguacaacgcucgccgugguuuccgugagcccucugcuucugaccucuucccaacagaaggcugacuggaucccccucgcccugacaauuaagggacugaacccuaccgcuaucuuucuuacaacccugagcagaacgucuaaaaagcgguccuggccccucaaugaagccauuauggcggucggcauggugagcauccuggccucuucccuccugaaaaacgauauuccgaugacagggccucuuguugcuggaggccugcugaccgugugcuacguccucaccggccgcagcgccgaccuggagcuugaaagagcugccgacgugcggugggaggagcaggccgaaaucuccgggagcucucccauccugagcauuacaaucuccgaggauggaucuaugagcauuaagaaugaagaggaggaacagacccucacaauccugauucgcacgggccuccuggucaucuccgggcuuuucccugugucuauucccaucaccgcugcggccugguaucugugggagguuaaaaagcaaagagcuggagugcugugggacgucccgagcccucccccugugggcaaagccgaacucgaggauggggccuaccggaucaagcagaagggcauucugggcuauucccagaucggcgcugggguuuacaaagaaggaacauuucacaccauguggcaugugacacgcggcgccguccuuaugcacaaggggaaaagaauugagcccucuugggcggacgugaagaaagaucugaucagcuacggaggcggguggaagcucgagggagaauggaaggagggcgaagaggugcagguucuggcucucgaacccggcaaaaacccucgggccguccaaaccaagccggggcuguucaaaacgaacaccggaacaauuggcgccgugucccuugacuuuagccccgggaccucuggauccccuaucguggauaagaaaggcaaggucguggggcuguauggaaauggcguugugacaagaagcggcaccuacgucucugcuaucgcccagacagagaaguccauugaggacaaccccgaaaucgaggaugacauuuuccgcaaaaagcggcugacgaucauggaucuccauccuggggcgggaaaaaccaagagauaucugcccgcuauugugcgcgaagccaucaaacggggccuuagaacacugauccucgccccuacccgcguuguggcugccgagauggaagaggcucugcgggggcucccgauuagauaccagacccccgccauccgcgcggagcacacaggacgggaaauugucgaccugaugugucaugccacguucaccaugagacuucugagcccuauccgggugcccaauuauaaccugauuaucauggaugaggcucacuuuacagacccugccuccauugcugcccgcggcuacaucucuaccagaguugaaaugggggaggccgcuggcaucuucaugacagcgacacccccgggaagccgggacccuuuuccccaguccaaugcccccauuauggaugaggaacgcgagaucccugaaagaagcuggaacucuggccacgagugggugacggacuucaaggggaagacagucugguuugugcccuccauuaaagcuggaaaugauaucgccgccugccuccggaagaacggcaaaaaggugauucaacugagcagaaaaaccuucgacucugaauauaucaagacccgcacaaaugauugggacuuugucguuaccacagauaucagcgagaugggggcuaacuucaaggccgagcgggugauugacccuagacgcuguaugaaaccggugauccuuaccgauggagaggaacgggucauucuggcgggccccaugccugugacgcauuccucugcugcccagagacgcgggcggguuggcagaaaucccaagaacgaaaaugaccaguacaucuacaugggagagccucucgaaaacgaugaggacugcgcccacuggaaagaggcuaagaugcugcuggacaauauuaacacacccgaaggcaucaucccgagcauguuugagccugaacgcgagaaaguggaugccauugacggggaauauagacuccggggagaggcgcgcaagaccuucgucgaucuuaugagacggggcgaccugcccguguggcuggccuaccgcguugcugccgaggggaucaacuaugcugauagacggugguguuuugacggagugaaaaauaaccaaauucucgaagagaaugucgaaguggagaucuggacaaaggagggcgaaagaaagaaacugaagccucgcuggcuugaugcccggauuuacuccgacccccuggcucucaaagaguucaaggaguucgccgcggggagaaaaucucugacccugaaccucaucacggagaugggccgccuuccuaccuuuaugacacagaaggccaagaaugcucuggauaaccuggccguccuccauaccgcugaagccggaggccgggccuauaaucacgcucugagcgagcuucccgagacacuggaaacccuccugcugcucacacuucuggcgaccgugacagggggaauuuuccuguuucucauguccggcaaagggaucggaaagaugacacugggcaugugcugcaucauuaccgccagcauccuucugugguacgcucagauucagccgcacuggaucgccgccucuauuauccucgaguucuuucugaucguucugcucauuccugaacccgagaaacaaagaacaccccaggacaaccagcuuacauauguggugaucgcuauucugaccgucguugccgcgacaauggccaaugaaaugggcuuccuggagaagacgaaaaaggauuuugggcucggauccaucaccacacagcaaccugagagcaacauucuggacaucgaucuucggccggcuuccgccuggacccuguacgcuguggccacaaccuucaucacgcccaugcuccgccauucuauugaaaauagcuccgugaacgucucucugaccgcgaucgccaaucaggcuacagugcugaugggccucgggaagggauggccucuuagcaaaauggacauuggcguuccccugcuggccaucggguguuacucccaggugaacccuauuacccucacagcugcccugcuucugcucgucgcucacuaugccaucauuggacccggccugcaggcgaaggccaccagagaggcucaaaaacgggccgcugccggcaucaugaagaauccuacgguggacgggaugacagucaucgaucuggacccgauucccuacgauccuaaauuugaaaagcagcucggacaggugaugcuucugguucugugcgugacccagguccucaugaugcgcacaaccugggcccugugugaggcgcuuacccuggcuacaggccccaucagcacgcucugggaagggaacccuggaagauucuggaauaccacaauugccgugucuauggcuaacaucuuucggggcuccuaucuggccggggccggacugcuguucagcauuaugaagaacaccgcuaauacacgcagaggcaccggcaacacgggggagacacuuggagagaaauggaagaaucggcugaacgcccugggcaaaucugaauuucaaaucuacaagaaauccgggauccaggagguugaccgcacccucgcgaaggaaggaauuaaaagaggcgagaccgaucaucacgccgugagccgggggucugcuaagcugagaugguucgucgagcgcaaucuugugacacccgaaggaaaggugguugaccugggcugcggcagagggggauggagcuauuacuguggcgggcucaaaaacgucaaggaggugaaaggacugaccaagggcgggccgggacaugaagaaccuauccccauguccacauauggcuggaaucuggugagacuccagucuggcgucgauguuuucuuuacgcccccugaaaaaugcgacacccuucugugugauauuggggagagcucccccaacccuacaguggaggccggacgcacccugcgggugcucaaucuggucgaaaacuggcuuaauaacaauacacaauucugcaucaaggugcugaacccguacaugcccagcguuauugagaagauggaagcucuccagagaaaauacggcggggcccuggugcgcaauccucugucccggaacucuacccacgagauguauugggucagcaacgcguccggaaauaucgugucuagcguuaacaugaucuccagaaugcucauuaaucgcuuuacgaugcggcacaagaaagccaccuacgaacccgacguggaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggcuuaucacggcagcuacgagacaaaacaaaccgggucugccuccagcauggucaacggaguggugcggcugcucacgaagccgugggacgucauuccuaugguuacacagauggcuaugaccgauaccacacccuucggccagcagagaguguuuaaagaaaagguggacacgcgcacccaagagccuaaagaggggacaaagaagcugaugaaaaucaccgccgaauggcuuuggaaggagcugggcaaaaagaaaacacccagaauguguacccgggaagaguucacacgcaaggucagaucuaaugcugcccucggcgcgauuuuuaccgaugagaacaaauggaaguccgcccgggaagcuguggaggacagcggguucugggaacugguugauaaggagagaaaucugcaccucgaaggaaaaugcgagacguguguguauaacaugaugggcaagcgggagaaaaagcugggcgaauuugggaaagccaagggaucucgcgcuaucugguacauguggcuuggcgccagauuccuggaguuugaagcccucggguuccugaaugaggaccauugguuuucccgggaaaacagccuuuccggagucgagggcgaggggcugcacaagcucggcuacauucugcgcgaugugagcaaaaaggaaggaggcgcgauguaugcugacgauaccgccgggugggacacaagaaucacccuggaggaucucaaaaaugaagagaugguuacaaaccauauggaaggagagcacaagaaacuggccgaggcuauuuucaaacuuaccuaccagaauaaggugguccgggugcagcgcccuacgcccagaggcacaguuauggacaucaucucucggcgcgaccagagagggagcggacaaguggucaccuauggccugaacacauucaccaacauggaagcccagcucauucggcagauggagggggaaggcguguuuaaauccauccaacagcugacggucaaggaggagauugcugugaaaaauuggcuuauccgcguuggaagagaacggcugucucgcauggccauuagcggcgaugacugcguggucaagccgcucgaugacagauucgcguccgcccugaccgcucugaacgauauggggaaagugcggaaggacauccagcagugggagccuucuagaggauggaaugauuggacacaagugcccuuuugcagccaucacuuccacgaacucaucaugaaggacggccgcguucuggugguccccugucggaaccaggaugagcuuauugggagagcccgcaucucccagggagcuggcuggucucugcgggaaaccgccugccucgggaaaagcuacgcgcagauguggucccugauguauuuucauagacgcgaccuucggcuggccgcuaaugccauuuguagcgcugugccuucucacuggaucccgacauccagaaccacauggagcauucaugccacccacgaguggaugacgacagaggauaugcucaccguuuggaaccgcguguggauccaagaaaaucccuggauggaggacaagaccccugucgaaacaugggaggaaauccccuaccugggcaaacgggaggaucaguggugcggaucucugauuggccucaccuccagagcuacaugggccaagaacauccagacggcgauuaaucaggugcgcagccugaucgggaacgaggaauauaccgacuacaugccuuccaugaaacgguucagacgggaggaagaggaagccggaguccuuugguga

SEQ ID NO: 19603 - RNA, 9876 nt, Artificial Sequence
  derived and/or modified CDS sequence (opt5) from DENV-2__KM279516__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagaauauccuggaacucaccgaugcccuggcccuggggaugaugguccuuaaaauuguucgcaacauggagaaguaucagcuggcugugaccaucauggccauucucugcgugcccaaugcggucauccugcagaacgcuuggaaagugucuuguacaacgcucgccguugugagcgucuccccucugcuucugaccagcucucaacagaaggccgacuggaucccccucgcucugacaauuaagggacugaauccuaccgccaucuuucuuacaacccuguccagaacgagcaaaaagcggucuuggccccucaacgaagcuauuauggccgugggcaugguuuccauccuggcgagcucucuccugaaaaaugauauuccgaugacagggccucuuguggccggaggccugcugaccgucugcuacgugcucaccggccgcuccgcugaccuggagcuugaaagagccgcugacguccggugggaggagcaggccgaaaucagcggguccagccccauccugucuauuacaaucagcgaggauggauccaugucuauuaagaacgaagaggaggaacagacccucacaauccugauucgcacgggccuccuggugaucagcgggcuuuucccuguuuccauucccaucaccgccgcugcgugguaucugugggaggugaaaaagcaaagagccggaguccugugggacgugccgucuccucccccuguuggcaaagcugaacucgaggauggggccuaccggaucaagcagaagggcauucugggcuauagccagaucggcgccgggguguacaaagaaggaacauuucacaccauguggcaugucacacgcggcgcugugcuuaugcacaaggggaaaagaauugagcccuccugggccgacgugaagaaagaucugaucucuuacggaggcggguggaagcucgagggagaauggaaggagggcgaagagguucagguccuggcgcucgaacccggcaaaaacccucgggcugugcaaaccaagccggggcuguucaaaacgaauaccggaacaauuggcgccgugagccuugacuuuucccccgggaccagcggaucuccuaucgucgauaagaaaggcaaggugguugggcuguauggaaacggcguggucacaagauccggcaccuacgugagcgccaucgcucagacagagaagucuauugaggacaaucccgaaaucgaggaugacauuuuccgcaaaaagcggcugacgaucauggaucuccauccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucuguccccuauccggguucccaacuauaaucugauuaucauggaugaggcccacuuuacagacccugcuagcauugccgcucgcggcuacaucuccaccagaguggaaaugggggaggccgccggcaucuucaugacagcuacacccccgggaucucgggacccuuuuccccagagcaacgcgcccauuauggaugaggaacgcgagaucccugaaagauccuggaauagcggccacgagugggucacggacuucaaggggaagacagugugguuugugcccucuauuaaagccggaaacgauaucgcugccugccuccggaagaauggcaaaaaggucauucaacuguccagaaaaaccuucgacagcgaauauaucaagacccgcacaaacgauugggacuuuguugugaccacagauaucucugagaugggggccaauuucaaggcugagcgggugauugacccuagacgcuguaugaaaccggucauccuuaccgauggagaggaacgggugauucuggccggccccaugccuguuacgcauagcuccgcggcucagagacgcgggcgggugggcagaaaccccaagaaugaaaacgaccaguacaucuacaugggagagccucucgaaaaugaugaggacugcgcccacuggaaagaggccaagaugcugcuggacaacauuaacacacccgaaggcaucaucccgucuauguuugagccugaacgcgagaaagucgaugcuauugacggggaauauagacuccggggagaggcccgcaagaccuucguggaucuuaugagacggggcgaccugcccguuuggcuggcguaccgcguggccgcugaggggaucaauuaugccgauagacggugguguuuugacggagucaaaaacaaucaaauucucgaagagaacguggaagucgagaucuggacaaaggagggcgaaagaaagaaacugaagccucgcuggcuugaugcucggauuuacagcgacccccuggcccucaaagaguucaaggaguucgcugccgggagaaaaucccugacccugaaucucaucacggagaugggccgccuuccuaccuuuaugacacagaaggcgaagaacgcccuggauaaucuggcugugcuccauaccgccgaagcuggaggccgggccuauaaccacgcccugucugagcuucccgagacacuggaaacccuccugcugcucacacuucuggcuaccguuacagggggaauuuuccuguuucucaugagcggcaaagggaucggaaagaugacacugggcaugugcugcaucauuaccgcguccauccuucugugguacgcccagauucagccgcacuggaucgcugccagcauuauccucgaguucuuucugaucgugcugcucauuccugaacccgagaaacaaagaacaccccaggacaaucagcuuacauauguggucaucgccauucugaccguuguggcugccacaauggcgaacgaaaugggcuuccuggagaagacgaaaaaggauuuugggcucggaucuaucaccacacagcaaccugaguccaauauucuggacaucgaucuucggccggccagcgcuuggacccuguacgccguggcuacaaccuucaucacgcccaugcuccgccauuccauugaaaacucuagcgucaaugugucccugaccgccaucgcgaaccaggccacaguucugaugggccucgggaagggauggccucuuucuaaaauggacauuggcgugccccugcuggcuaucggguguuacagccaggucaauccuauuacccucacagccgcucugcuucugcucguggcccacuaugcuaucauuggacccggccugcaggccaaggcgaccagagaggcccaaaaacgggcugccgcuggcaucaugaagaacccuacggucgacgggaugacagugaucgaucuggacccgauucccuacgauccuaaauuugaaaagcagcucggacagguuaugcuucuggugcugugcgucacccaggugcucaugaugcgcacaaccugggcccugugugaggcccuuacccuggcgacaggccccaucuccacgcucugggaagggaauccuggaagauucuggaacaccacaauugcuguuagcauggccaacaucuuucggggcucuuaucuggcuggggccggacuccuguucuccauuaugaagaauaccgccaacacacgcagaggcaccggcaauacgggggagacacuuggagagaaauggaagaaccggcugaaugcucugggcaaaagcgaauuucaaaucuacaagaaaucugggauccaggagguggaccgcacccucgccaaggaaggaauuaaaagaggcgagaccgaucaucacgcggucucccgggggagcgccaagcugagaugguucguggagcgcaaccuugugacacccgaaggaaagguugucgaccugggcugcggcagagggggauggucuuauuacuguggcgggcucaaaaaugugaaggaggugaaaggacugaccaagggcgggccgggacaugaagaaccuauccccaugagcacauauggcuggaaccuggucagacuccaguccggcguugauguguucuuuacgcccccugaaaaaugcgacacccuucugugugauauuggggagucuagccccaauccuacaguggaggcuggacgcacccugcggguccucaaccugguggaaaauuggcuuaacaauaacacacaauucugcaucaagguucugaauccguacaugcccuccgugauugagaagauggaagcccuccagagaaaauacggcggggcucugguccgcaacccucugagccggaacuccacccacgagauguauugggugucuaaugccagcggaaacaucguuuccucugugaauaugaucagcagaaugcucauuaaccgcuuuacgaugcggcacaagaaagcgaccuacgaacccgacgucgaucuuggcuccgggacaagaaauaucggaauugagucugagaccccuaaccuggacaucauuggcaagcgcaucgagaagaucaagcaggagcaugaaacaagcuggcacuaugaucaggaccaucccuacaagaccugggccuaucacggcuccuacgagacaaaacaaaccgggagcgcuucuuccauggugaauggagugguccggcugcucacgaagccgugggacguuauuccuauggugacacagauggccaugaccgauaccacacccuucggccagcagagaguguuuaaagaaaaggucgacacgcgcacccaagagccuaaagaggggacaaagaagcugaugaaaaucaccgcugaauggcuuuggaaggagcugggcaaaaagaaaacacccagaauguguacccgggaagaguucacacgcaaggugagaagcaacgccgcucucggcgccauuuuuaccgaugagaauaaauggaagucugcgcgggaagccguugaggacuccggguucugggaacugguggauaaggagagaaaccugcaccucgaaggaaaaugcgagacgugugucuauaauaugaugggcaagcgggagaaaaagcugggcgaauuugggaaagcuaagggaagccgcgccaucugguacauguggcuuggcgcuagauuccuggaguuugaagcccucggguuccugaacgaggaccauugguuuucucgggaaaauucccuuagcggaguggagggcgaggggcugcacaagcucggcuacauucugcgcgauguuuccaaaaaggaaggaggcgccauguaugcggacgauaccgcugggugggacacaagaaucacccuggaggaucucaaaaacgaagagauggugacaaaucauauggaaggagagcacaagaaacuggccgaggccauuuucaaacuuaccuaccagaacaaggucgugcggguucagcgcccuacgcccagaggcacagugauggacaucaucagccggcgcgaccagagagggucuggacaagucgugaccuauggccugaacacauucaccaauauggaagcucagcucauucggcagauggagggggaaggcgucuuuaaaagcauccaacagcugacggugaaggaggagauugccguuaaaaacuggcuuauccgcgugggaagagaacggcugucccgcauggcuauuucuggcgaugacugcgucgugaagccgcucgaugacagauucgccagcgcgcugaccgcccugaaugauauggggaaagugcggaaggacauccagcagugggagccuuccagaggauggaacgauuggacacaaguucccuuuugcucucaucacuuccacgaacucaucaugaaggacggccgcgugcuggucgugcccugucggaaucaggaugagcuuauugggagagcucgcaucagccagggagccggcuggucccugcgggaaaccgcuugccucgggaaaucuuacgcccagauguggagccugauguauuuucauagacgcgaccuucggcuggcggccaacgcuauuuguuccgccguuccuagccacuggaucccgacaucuagaaccacaugguccauucaugcuacccacgaguggaugacgacagaggauaugcucaccguguggaaucgcgucuggauccaagaaaaccccuggauggaggacaagaccccuguggaaagcugggaggaaauccccuaccugggcaaacgggaggaucaguggugcggaucucugauuggccucacauccagagccaccugggcuaagaauauccagacagccauuaaccagguccgcagccugaucgggaaugaggaauauacggacuacaugccuuccaugaaacgguucagacgggaggaagaggaagcgggagugcuuugguga

SEQ ID NO: 19604 - RNA, 9876 nt, Artificial Sequence
  derived and/or modified CDS sequence (opt5) from DENV-2__KM279517__SS-prME
accgccggaaucauuaucaugaugauucccaccgugauggcuuuccaccugacgaccagaaacggggaaccucauaugaucgucucccggcaggaaaagggaaaaucccuccuguuuaagacggagaauggaguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccucccaagcuggcuagcgccauccaaaaagcucacgaagaggggauuuguggcaucagauccgugacgcgccuugaaaaccugauguggaagcagauuaccccggagcucaaucauauccugacagagaacgaaguuaaacugaccauuaugacaggagacaucaagggcaucaugcaggccgggaaacggucucuuagaccucagcccaccgagcucaaguacagcuggaaagcguggggaaaggccaagaugcuguccacggaacugcacaaucauaccuuccucauugauggcccugagacagcugaaugccccaacaccaaucgcgccuggaacagccuggagguggaggacuauggguuuggagucuucacaaccaauaucuggcuuaaacugaaggaacggcaagauguguuuugugacucuaaacucauguccgcugccauuaaggacaacagagcggugcacgccgauaugggcuacuggaucgagagcgcucugaacgacacauggaaaauugaaaaggccucuuucaucgaggucaaguccugccacuggccuaaaagccauacccuguggucuaauggcguucuugagagcgaaaugaucauucccaagaacuucgcugggccggugucccagcacaauuaucgcccuggauaccauacgcagacagccggccccuggcaccucgggcggcuggagauggauuuugacuucugugaaggaaccaccguggucgugacagaggauugcggcaacagagggcccagccugcggaccacgacagccucuggaaaacucaucaccgaauggugcugucgcuccugcacacugccuccgcuuagauaccggggcgaggacggcuguugguaugggauggagauuagaccccugaaggaaaaagaggaaaaucucguuaacagccuggugaccgcuggacauggccagaucgauaauuuuucccuggggguccuuggaauggcgcuguuccuggaggaaaugcugcgcacacgggugggcaccaagcacgccauucuccugguugcugugucuuuugucacgcuuaucaccgggaacaugagcuucagagaccugggacgcgugaugguuauggugggcgccacaaugaccgaugacauuggcaugggggucacauaccucgcccugcuggcugccuuuaaggugagaccuaccuucgcggcuggacuucugcuccggaaacugacguccaaggagcucaugaugacaaccaucggcaucgugcugcuuucucaaagcacaauucccgaguccauccuggaacucaccgaugcccuggcccuggggaugaugguccuuaaaauuguucgcaauauggagaaguaucagcuggcugugaccaucauggccauucucugcgugccuaacgcggucauccugcagaaugcuuggaaagugucuuguacaacgcucgccguugugagcgucagcccccugcuucugaccagcucucaacagaaggccgacuggaucccucucgcucugacaauuaagggacugaaccccaccgccaucuuucuuacaacccuguccagaacgagcaaaaagcggucuuggccgcucaaugaagcuauuauggccgugggcaugguuuccauccuggcgagcucucuccugaaaaacgauauuccuaugacagggccccuuguggccggaggccugcugaccgucugcuacgugcucaccggccgcuccgcugaccuggagcuugaaagagccgcugacguccggugggaggagcaggccgaaaucagcggguccagcccuauccugucuauuacaaucagcgaggauggauccaugucuauuaagaaugaagaggaggaacagacccucacaauccugauucgcacgggccuccuggugaucagcgggcuuuuccccguuuccauuccgaucaccgccgcugcgugguaucugugggaggugaaaaagcaaagagccggaguccugugggacgugccuucucccccucccguuggcaaagcugaacucgaggauggggccuaccggaucaagcagaagggcauucugggcuauagccagaucggcgccgggguguacaaagaaggaacauuucacaccauguggcaugucacacgcggcgcugugcuuaugcacaaggggaaaagaauugagcccuccugggccgacgugaagaaagaucugaucucuuacggaggcggguggaagcucgagggagaauggaaggagggcgaagagguucagguccuggcgcucgaaccuggcaaaaacccgcgggcugugcaaaccaagcccgggcuguucaaaacgaacaccggaacaauuggcgccgugagccuugacuuuuccccugggaccagcggaucucccaucgucgauaagaaaggcaaggugguugggcuguauggaaauggcguggucacaagauccggcaccuacgugagcgccaucgcucagacagagaagucuauugaggacaacccugaaaucgaggaugacauuuuccgcaaaaagcggcugacgaucauggaucuccaucccggggccggaaaaaccaagagauaucugccugcgauuguucgcgaagcuaucaaacggggccuuagaacacugauccucgccccgacccgcguggucgccgcugagauggaagaggcccugcgggggcuccccauuagauaccagaccccugcuauccgcgccgagcacacaggacgggaaauuguggaccugaugugucaugcgacguucaccaugagacuucugucccccauccggguuccuaauuauaaccugauuaucauggaugaggcccacuuuacagaccccgcuagcauugccgcucgcggcuacaucuccaccagaguggaaaugggggaggccgccggcaucuucaugacagcuaccccgccuggaucucgggaccccuuuccccagagcaaugcgccuauuauggaugaggaacgcgagauccccgaaagauccuggaacagcggccacgagugggucacggacuucaaggggaagacagugugguuugugccuucuauuaaagccggaaaugauaucgcugccugccuccggaagaacggcaaaaaggucauucaacuguccagaaaaaccuucgacagcgaauauaucaagacccgcacaaaugauugggacuuuguugugaccacagauaucucugagaugggggccaacuucaaggcugagcgggugauugacccgagacgcuguaugaaacccgucauccuuaccgauggagaggaacgggugauucuggccggcccuaugcccguuacgcauagcuccgcggcucagagacgcgggcgggugggcagaaauccuaagaacgaaaaugaccaguacaucuacaugggagagccccucgaaaacgaugaggacugcgcccacuggaaagaggccaagaugcugcuggacaauauuaacacaccggaaggcaucaucccuucuauguuugagcccgaacgcgagaaagucgaugcuauugacggggaauauagacuccggggagaggcccgcaagaccuucguggaucuuaugagacggggcgaccugccuguuuggcuggcguaccgcguggccgcugaggggaucaacuaugccgauagacggugguguuuugacggagucaaaaauaaccaaauucucgaagagaauguggaagucgagaucuggacaaaggagggcgaaagaaagaaacugaagccccgcuggcuugaugcucggauuuacagcgacccucuggcccucaaagaguucaaggaguucgcugccgggagaaaaucccugacccugaaccucaucacggagaugggccgccuucccaccuuuaugacacagaaggcgaagaaugcccuggauaaccuggcugugcuccauaccgccgaagcuggaggccgggccuauaaucacgcccugucugagcuuccggagacacuggaaacccuccugcugcucacacuucuggcuaccguuacagggggaauuuuccuguuucucaugagcggcaaagggaucggaaagaugacacugggcaugugcugcaucauuaccgcguccauccuucugugguacgcccagauucagccucacuggaucgcugccagcauuauccucgaguucuuucugaucgugcugcucauucccgaacccgagaaacaaagaaccccucaggacaaccagcuuacauauguggucaucgccauucugaccguuguggcugccacaauggcgaaugaaaugggcuuccuggagaagacgaaaaaggauuuugggcucggaucuaucaccacacagcaaccggaguccaacauucuggacaucgaucuucggcccgccagcgcuuggacccuguacgccguggcuacaaccuucaucacgccuaugcuccgccauuccauugaaaauucuagcgucaacgugucccugaccgccaucgcgaaucaggccacaguucugaugggccucgggaagggauggccccuuucuaaaauggacauuggcgugccucugcuggcuaucggguguuacagccaggucaaccccauuacccucacagccgcucugcuucugcucguggcccacuaugcuaucauuggaccuggccugcaggccaaggcgaccagagaggcccaaaaacgggcugccgcuggcaucaugaagaauccgacggucgacgggaugacagugaucgaucuggaccccauuccuuacgaucccaaauuugaaaagcagcucggacagguuaugcuucuggugcugugcgucacccaggugcucaugaugcgcacaaccugggcccugugugaggcccuuacccuggcgacaggcccuaucuccacgcucugggaagggaaccccggaagauucuggaauaccacaauugcuguuagcauggccaacaucuuucggggcucuuaucuggcuggggccggacuccuguucuccauuaugaagaacaccgccaauacacgcagaggcaccggcaacacgggggagacacuuggagagaaauggaagaaucggcugaacgcucugggcaaaagcgaauuucaaaucuacaagaaaucugggauccaggagguggaccgcacccucgccaaggaaggaauuaaaagaggcgagaccgaucaucacgcggucucccgggggagcgccaagcugagaugguucguggagcgcaaucuugugacaccggaaggaaagguugucgaccugggcugcggcagagggggauggucuuauuacuguggcgggcucaaaaacgugaaggaggugaaaggacugaccaagggcgggccuggacaugaagaacccauccccaugagcacauauggcuggaaucuggucagacuccaguccggcguugauguguucuuuacgccucccgaaaaaugcgacacccuucugugugauauuggggagucuagcccuaacccgacaguggaggcuggacgcacccugcggguccucaaucugguggaaaacuggcuuaauaacaauacacaauucugcaucaagguucugaaccccuacaugccuuccgugauugagaagauggaaacccuccagagaaaauacggcggggcccugguccgcaauccccugagccggaacuccacgcacgagauguauugggugucuaacgcuagcggaaauaucguuuccucugugaacaugaucagcagaaugcucauuaaucgcuuuaccaugcggcacaagaaagccacauacgaaccugacgucgaucuuggcuccgggaccagaaacaucggaauugagucugagacacccaaucuggacaucauuggcaagcgcaucgagaagaucaagcaggagcaugaaaccagcuggcacuaugaucaggaccauccguacaagacaugggcguaucacggcuccuacgagaccaaacaaacggggagcgccucuuccauggugaacggagugguccggcugcucacaaagccuugggacguuauucccauggugacccagauggcuaugaccgauacaacgccuuucggccagcagagaguguuuaaagaaaaggucgacacccgcacacaagagcccaaagaggggaccaagaagcugaugaaaaucacagccgaauggcuuuggaaggagcugggcaaaaagaaaaccccuagaauguguacacgggaagaguucacccgcaaggugagaagcaaugcugcccucggcgcuauuuuuacggaugagaacaaauggaagucugcccgggaagcgguugaggacuccggguucugggaacugguggauaaggagagaaaucugcaccucgaaggaaaaugcgagaccugugucuauaacaugaugggcaagcgggagaaaaagcugggcgaauuugggaaagccaagggaagccgcgcuaucugguacauguggcuuggcgccagauuccuggaguuugaagcucucggguuccugaaugaggaccauugguuuucucgggaaaacucccuuagcggaguggagggcgaggggcugcacaagcucggcuacauucugcgcgauguuuccaaaaaggaaggaggcgccauguaugccgacgauacagcggggugggacaccagaaucacacuggaggaucucaaaaaugaagagauggugaccaaccauauggaaggagagcacaagaaacuggcugaggccauuuucaaacuuacguaccagaauaaggucgugcggguucagcgccccacaccgagaggcaccgugauggacaucaucagccggcgcgaccagagagggucuggacaagucgugacauauggccugaacaccuucacgaacauggaagcccagcucauucggcagauggagggggaaggcgucuuuaaaagcauccaacagcugaccgugaaggaggagauugcuguuaaaaauuggcuuauccgcgugggaagagaacggcugucccgcauggccauuucuggcgaugacugcgucgugaagccucucgaugacagauucgcuagcgcccugacagcgcugaacgauauggggaaagugcggaaggacauccagcagugggagcccuccagaggauggaaugauuggacccaaguucccuuuugcucucaucacuuccacgaacucaucaugaaggacggccgcgugcuggucgugccuugucggaaccaggaugagcuuauugggagagcccgcaucagccagggagcuggcuggucccugcgggaaacagccugccucgggaaaucuuacgcucagauguggagccugauguauuuucauagacgcgaccuucggcuggccgcgaaugccauuuguuccgcuguuccgagccacuggauccccaccucuagaacaaccugguccauucaugccacgcacgaguggaugacaaccgaggauaugcucaccguguggaaccgcgucuggauccaagaaaauccuuggauggaggacaagacacccguggaaagcugggaggaaaucccuuaccugggcaaacgggaggaucaguggugcggaucucugauuggccucaccuccagagcuacaugggccaagaacauccagacggcuauuaaucagguccgcagccugaucgggaacgaggaauauaccgacuacaugcccuccaugaaacgguucagacgggaggaagaggaagccggagugcuuugguga

SEQ ID NO: 19605 - RNA, 9876 nt, Artificial Sequence
  derived and/or modified CDS sequence (opt5) from DENV-2__KM279518__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauucucugcgugcccaacgcggucauccugcagaaugcuuggaaagugagcuguacaacgcucgccguuguguccgucagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcaaagagccggaguccugugggacgugccgagcccucccccuguuggcaaagcugaacucgaggauggggccuaccggaucaagcagaagggcauucugggcuauucccagaucggcgccgggguguacaaagaaggaacauuucacaccauguggcaugucacacgcggcgcugugcuuaugcacaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcaaaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucagacagagaaguccauugaggacaaccccgaaaucgaggaugacauuuuccgcaaaaagcggcugacgaucauggaucuccauccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaauuauaaccugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaaugcgcccauuauggaugaggaacgcgagaucccugaaagaagcuggaacucuggccacgagugggucacggacuucaaggggaagacagugugguuugugcccuccauuaaagccggaaaugauaucgcugccugccuccggaagaacggcaaaaaggucauucaacugagcagaaaaaccuucgacucugaauauaucaagacccgcacaaaugauugggacuuuguugugaccacagauaucagcgagaugggggccaacuucaaggcugagcgggugauugacccuagacgcuguaugaaaccggucauccuuaccgauggagaggaacgggugauucuggccggccccaugccuguuacgcauuccucugcggcucagagacgcgggcgggugggcagaaaucccaagaacgaaaaugaccaguacaucuacaugggagagccucucgaaaacgaugaggacugcgcccacuggaaagaggccaagaugcugcuggacaauauuaacacacccgaaggcaucaucccgagcauguuugagccugaacgcgagaaagucgaugcuauugacggggaauauagacuccggggagaggcccgcaagaccuucguggaucuuaugagacggggcgaccugcccguuuggcuggcguaccgcguggccgcugaggggaucaacuaugccgauagacggugguguuuugacggagucaaaaauaaccaaauucucgaagagaauguggaagucgagaucuggacaaaggagggcgaaagaaagaaacugaagccucgcuggcuugaugcucggauuuacuccgacccccuggcccucaaagaguucaaggaguucgcugccgggagaaaaucucugacccugaaccucaucacggagaugggccgccuuccuaccuuuaugacacagaaggcgaagaaugcccuggauaaccuggcugugcuccauaccgccgaagcuggaggccgggccuauaaucacgcccugagcgagcuucccgagacacuggaaacccuccugcugcucacacuucuggcuaccguuacagggggaauuuuccuguuucucauguccggcaaagggaucggaaagaugacacugggcaugugcugcaucauuaccgcgagcauccuucugugguacgcccagauucagccgcacuggaucgcugccucuauuauccucgaguucuuucugaucgugcugcucauuccugaacccgagaaacaaagaacaccccaggacaaccagcuuacauauguggucaucgccauucugaccguuguggcugccacaauggcgaaugaaaugggcuuccuggagaagacgaaaaaggauuuugggcucggauccaucaccacacagcaaccugagagcaacauucuggacaucgaucuucggccggccuccgcuuggacccuguacgccguggcuacaaccuucaucacgcccaugcuccgccauucuauugaaaauagcuccgucaacgugucucugaccgccaucgcgaaucaggccacaguucugaugggccucgggaagggauggccucuuagcaaaauggacauuggcgugccccugcuggcuaucggguguuacucccaggucaacccuauuacccucacagccgcucugcuucugcucguggcccacuaugcuaucauuggacccggccugcaggccaaggcgaccagagaggcccaaaaacgggcugccgcuggcaucaugaagaauccuacggucgacgggaugacagugaucgaucuggacccgauucccuacgauccuaaauuugaaaagcagcucggacagguuaugcuucuggugcugugcgucacccaggugcucaugaugcgcacaaccugggcccugugugaggcccuuacccuggcgacaggccccaucagcacgcucugggaagggaacccuggaagauucuggaauaccacaauugcuguuucuauggccaacaucuuucggggcuccuaucuggcuggggccggacuccuguucagcauuaugaagaacaccgccaauacacgcagaggcaccggcaacacgggggagacacuuggagagaaauggaagaaucggcugaacgcucugggcaaaucugaauuucaaaucuacaagaaauccgggauccaggagguggaccgcacccucgccaaggaaggaauuaaaagaggcgagaccgaucaucacgcggucagccgggggucugccaagcugagaugguucguggagcgcaaucuugugacacccgaaggaaagguugucgaccugggcugcggcagagggggauggagcuauuacuguggcgggcucaaaaacgugaaggaggugaaaggacugaccaagggcgggccgggacaugaagaaccuauccccauguccacauauggcuggaaucuggucagacuccagucuggcguugauguguucuuuacgcccccugaaaaaugcgacacccuucugugugauauuggggagagcucccccaacccuacaguggaggcuggacgcacccugcggguccucaaucugguggaaaacuggcuuaauaacaauacacaauucugcaucaagguucugaacccguacaugcccagcgugauugagaagauggaagcccuccagagaaaauacggcggggcucugguccgcaauccucugucccggaacucuacccacgagauguauugggugagcaacgccuccggaaauaucguuucuagcgugaacaugaucuccagaaugcucauuaaucgcuuuacgaugcggcacaagaaagcgaccuacgaacccgacgucgaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggccuaucacggcagcuacgagacaaaacaaaccgggucugcuuccagcauggugaacggagugguccggcugcucacgaagccgugggacguuauuccuauggugacacagauggccaugaccgauaccacacccuucggccagcagagaguguuuaaagaaaaggucgacacgcgcacccaagagccuaaagaggggacaaagaagcugaugaaaaucaccgcugaauggcuuuggaaggagcugggcaaaaagaaaacacccagaauguguacccgggaagaguucacacgcaaggugagaucuaaugccgcucucggcgccauuuuuaccgaugagaacaaauggaaguccgcgcgggaagccguugaggacagcggguucugggaacugguggauaaggagagaaaucugcaccucgaaggaaaaugcgagacgugugucuauaacaugaugggcaagcgggagaaaaagcugggcgaauuugggaaagcuaagggaucucgcgccaucugguacauguggcuuggcgcuagauuccuggaguuugaagcccucggguuccugaaugaggaccauugguuuucccgggaaaacagccuuuccggaguggagggcgaggggcugcacaagcucggcuacauucugcgcgauguuagcaaaaaggaaggaggcgccauguaugcggacgauaccgcugggugggacacaagaaucacccuggaggaucucaaaaaugaagagauggugacaaaccauauggaaggagagcacaagaaacuggccgaggccauuuucaaacuuaccuaccagaauaaggucgugcggguucagcgccagacgccuagaggcacagugauggacaucaucucucggcgcgaccaaagagggagcggacaggucgugaccuauggccugaacacauucaccaacauggaagcucagcucauucggcaaauggagggggaaggcgucuuuaaauccauccagcagcugacggugaaggaggagauugccguuaaaaauuggcuuauccgcgugggaagagaacggcugucucgcauggcuauuagcggcgaugacugcgucgugaagccccucgaugacagauucgccuccgcgcugaccgcccugaacgauauggggaaagugcggaaggacauccagcaaugggagccgucuagaggauggaaugauuggacacagguuccuuuuugcagccaucacuuccacgaacucaucaugaaggacggccgcgugcuggucgugcccugucggaaccaggaugagcuuauugggagagcucgcaucucccagggagccggcuggucucugcgggaaaccgcuugccucgggaaaagcuacgcccaaauguggucccugauguauuuucauagacgcgaccuucggcuggcggccaaugcuauuuguagcgccguucccucucacuggaucccuacauccagaaccacauggagcauucaugcuacccacgaguggaugacgacagaggauaugcucaccguguggaaccgcgucuggauccaggaaaauccguggauggaggacaagacccccguggaaucuugggaggaaaucccuuaccugggcaaacgggaggaucaguggugcggaucccugauuggccucacaagcagagccaccugggcuaagaacauccagacagccauuaaucaaguccgcucccugaucgggaacgaggaauauacggacuacaugcccucuaugaaacgguucagacgggaggaagaggaagcgggagugcuuugguga

SEQ ID NO: 19606 - RNA, 9876 nt, Artificial Sequence
  derived and/or modified CDS sequence (opt5) from DENV-2__KM279519__SS-prME
accgccggaaucauuaucaugaugauucccaccgugauggcuuuccaccugacgaccagaaacggggagccucauaugaucgucagccggcaggaaaagggaaaaucccuccuguuuaagaccgagaauggcguuaacaugugcacccuuauggccauggaccugggggaacucugugaggauaccauuaccuacaauugcccgcugcuuagacaaaacgaacccgaggacaucgauuguuggugcaauucuacgagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauucucugcgugcccaacgcggucauccugcagaaugcuuggaaagugagcuguacaacgcucgccguuguguccgucagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcaaagagccggaguccugugggacgugccgagcccucccccuguuggcaaagcugaacucgaggauggggccuaccggaucaagcagaagggcauucugggcuauucccagaucggcgccgggguguacaaagaaggaacauuucacaccauguggcaugucacacgcggcgcugugcuuaugcacaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcaaaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucagacagagaaguccauugaggacaaccccgaaaucgaggaugacauuuuccgcaaaaagcggcugacgaucauggaucuccauccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaauuauaaccugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaaugcgcccauuauggaugaggaaaaggagaucccugaacgcagcuggaacucuggccacgagugggucacggacuucaaggggaaaacagugugguuugugcccuccauuaaggccggaaaugauaucgcugccugccuccgcaagaacggcaagaaagucauucaacugagccggaagaccuucgacucugaauauaucaagaccagaacaaaugauugggacuuuguugugaccacagauaucagcgagaugggggccaacuucaaagcugagcgcgugauugacccucggagauguaugaagccggucauccuuaccgauggagaggaacgcgugauucuggccggccccaugccuguuacgcauuccucugcggcucagcggagagggcgcgugggccggaaucccaaaaacgaaaaugaccaguacaucuacaugggagagccucucgaaaacgaugaggacugcgcccacuggaaggaggccaaaaugcugcuggacaauauuaacacacccgaaggcaucaucccgagcauguuugagccugaaagagagaaggucgaugcuauugacggggaauaucgccucagaggagaggcccggaaaaccuucguggaucuuaugcgcagaggcgaccugcccguuuggcuggcguaccggguggccgcugaggggaucaacuaugccgaucgcagaugguguuuugacggagucaagaauaaccaaauucucgaagagaauguggaagucgagaucuggacaaaggagggcgaacggaaaaagcugaaaccuagauggcuugaugcucgcauuuacuccgacccccuggcccucaaggaguucaaagaguucgcugccgggcggaagucucugacccugaaccucaucacggagaugggcagacuuccuaccuuuaugacacagaaggcgaaaaaugcccuggauaaccuggcugugcuccauaccgccgaagcuggaggccgcgccuauaaucacgcccugagcgagcuucccgagacacuggaaacccuccugcugcucacacuucuggcuaccguuacagggggaauuuuccuguuucucauguccggcaaggggaucggaaaaaugacacugggcaugugcugcaucauuaccgcgagcauccuucugugguacgcccagauucagccgcacuggaucgcugccucuauuauccucgaguucuuucugaucgugcugcucauuccugaacccgagaagcaacggacaccccaggacaaccagcuuacauauguggucaucgccauucugaccguuguggcugccacaauggcgaaugaaaugggcuuccuggagaaaacgaagaaggauuuugggcucggauccaucaccacacagcaaccugagagcaacauucuggacaucgaucuuagaccggccuccgcuuggacccuguacgccguggcuacaaccuucaucacgcccaugcuccggcauucuauugaaaauagcuccgucaacgugucucugaccgccaucgcgaaucaggccacaguucugaugggccucgggaaaggauggccucuuagcaagauggacauuggcgugccccugcuggcuaucggguguuacucccaggucaacccuauuacccucacagccgcucugcuucugcucguggcccacuaugcuaucauuggacccggccugcaggccaaagcgacccgcgaggcccaaaagagagcugccgcuggcaucaugaaaaauccuacggucgacgggaugacagugaucgaucuggacccgauucccuacgauccuaaguuugaaaagcagcucggacagguuaugcuucuggugcugugcgucacccaggugcucaugaugcggacaaccugggcccugugugaggcccuuacccuggcgacaggccccaucagcacgcucugggaagggaacccuggacgcuucuggaauaccacaauugcuguuucuauggccaacaucuuuagaggcuccuaucuggcuggggccggacuccuguucagcauuaugaaaaacaccgccaauacacggcgcggcaccggcaacacgggggagacacuuggagagaaguggaaaaauagacugaacgcucugggcaagucugaauuucaaaucuacaaaaaguccgggauccaggagguggaccggacccucgccaaagaaggaauuaagcgcggcgagaccgaucaucacgcggucagcagagggucugccaagcugcggugguucguggagagaaaucuugugacacccgaaggaaaaguugucgaccugggcugcggccgcgggggauggagcuauuacuguggcgggcucaagaacgugaaagaggugaagggacugaccaaaggcgggccgggacaugaagaaccuauccccauguccacauauggcuggaaucugguccggcuccagucuggcguugauguguucuuuacgcccccugaaaagugcgacacccuucugugugauauuggggagagcucccccaacccuacaguggaggcuggaagaacccugcgcguccucaaucugguggaaaacuggcuuaauaacaauacacaauucugcaucaagguucugaacccguacaugcccagcgugauugagaaaauggaagcccuccagcggaaguacggcggggcucuggucagaaauccucugucccgcaacucuacccacgagauguauugggugagcaacgccuccggaaauaucguuucuagcgugaacaugaucucccggaugcucauuaauagauuuacgaugcgccacaaaaaggcgaccuacgaacccgacgucgaucuuggcucugggacacggaacaucggaauugagagcgagaccccuaaucuggacaucauuggcaaaagaaucgaaaagaucaagcaggagcaugaaacauccuggcacuaugaucaggaccaucccuacaaaaccugggccuaucacggcagcuacgagacaaagcaaaccgggucugcuuccagcauggugaacggagugguccgccugcucacgaaaccgugggacguuauuccuauggugacacagauggccaugaccgauaccacacccuucggccagcagcggguguuuaaggaaaaagucgacacgagaacccaagagccuaaggaggggacaaagaaacugaugaagaucaccgcugaauggcuuuggaaagagcugggaaagaaaaagacaccccgcauguguaccagagaagaguucacacggaaagugcgcucuaaugccgcucucggcgccauuuuuaccgaugagaacaaguggaaguccgcgagagaagccguugaggacagcggguucugggaacugguggauaaagagcggaaucugcaccucgaaggaaagugcgagacgugugucuauaacaugaugggcaaaagagagaagaaacugggcgaauuugggaaggcuaagggaucucgggccaucugguacauguggcuuggcgcucgcuuccuggaguuugaagcccucggguuccugaaugaggaccauugguuuuccagagaaaacagccuuuccggaguggagggcgaggggcugcacaaacucggcuacauucugcgggauguuagcaagaaagaaggaggcgccauguaugcggacgauaccgcugggugggacacacgcaucacccuggaggaucucaagaaugaagagauggugacaaaccauauggaaggagagcacaaaaagcuggccgaggccauuuucaaacuuaccuaccagaauaaagucgugagaguucagcggccuacgccccgcggcacagugauggacaucaucucuagacgggaccagcgcgggagcggacaagucgugaccuauggccugaacacauucaccaacauggaagcucagcucauuagacagauggagggggaaggcgucuuuaaguccauccaacagcugacggugaaagaggagauugccguuaagaauuggcuuauccgggugggacgcgaaagacugucucggauggcuauuagcggcgaugacugcgucgugaaaccgcucgaugaccgcuucgccuccgcgcugaccgcccugaacgauauggggaaggugagaaaggacauccagcagugggagccuucucggggauggaaugauuggacacaaguucccuuuugcagccaucacuuccacgaacucaucaugaaagacggcagagugcuggcuguccccugucgcaaccaggaugagcuuauugggcgggccagaaucucccagggagcuggcuggucucugcgcgaaaccgccugccucggaaagagcuacgcgcagauguggucccugauguauuuucaucggagagaccuucgccuggccgcuaaugccauuuguagcgcugugccuucucacuggaucccgacaucccggaccacauggagcauucaugccacccacgaguggaugacgacagaggauaugcucaccguuuggaacagaguguggauccaagaaaaucccuggauggaggacaaaaccccugucgaaucuugggaggaaauccccuaccugggcaagcgcgaggaucaguggugcggaucccugauuggccucacaagccgggcuaccugggccaaaaacauccagacagcgauuaaucaggugagaucccugaucgggaacgaggaauauacggacuacaugccuucuaugaagcgcuuccggagagaggaagaggaagccggaguccuuugguga

SEQ ID NO: 19607 - RNA, 9876 nt, Artificial Sequence
  derived and/or modified CDS sequence (opt5) from DENV-2__KM279520__SS-prME
accgccggcaucauuaucaugaugauucccaccgugauggcuuuccaccugacgaccagaaacggggagccucauaugaucgugagccggcaggaaaagggaaaaucccuccuguuuaagaccgagaauggcguuaacaugugcacccuuauggccauggaccugggggaacucugugaggauacgauuaccuacaauugcccgcugcuuagacaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccagaaauaaacccacccucgacuucgaacugauuaagacagaggcuaagcaccuugccacccugcggaaauacugcguggaagcuaagcucacgaacacaaccaccgccucucgcuguccuacacagggggagccgucccugaaugaggaacaagauaaaagauuugugugcaagcauagcauggucgaccggggauggggcaacggcugugggcuguucggaaaaggcgggaucguuaccugcgcgauguuuacaugcaagaagaauauggagggaaaaguggugcagcccgaaaaccucgaguauacgauugucaucaccccucacucuggcgaagagaaugccguggggaacgauacaggaaagcauggcaaagagauuaagguuacaccccaguccagcaucacagaagcugagcugaccggcuacgggacggugaccauggaauguucuccucgcacaggacuugacuucaaugagaugguccugcuccagauggaaaacaaagccuggcuggugcacagacaaugguuucuugaucugccccucccguggcugccuggcgcugacacccagggguccaacuggauccagaaggagacacugguuaccuucaaaaauccccacgccaagaagcaggauguggucgugcucggaagccaagagggcgccaugcauacggcucugacaggggcgaccgaaauucagauguccucuggcaaccuucuguuuacaggacaccucaaaugccggcugagaauggacaaacuucagcugaaaggcaugagcuauuccauguguaccgggaaguucaaagucgugaaggagaucgccgaaacccaacauggaacaauuguuauccgcgugcaguacgagggcgacgggagcccuugcaagauucccuucgagaucauggaucucgaaaaacggcacgcucugggaagacugaucacggucaaucccauugugaccgagaaggacucuccuguuaacaucgaagccgagccgcccuuuggcgauuccuacauuaucauugggguggaaccuggccagcucaaacugagcugguucaagaaaggaucuagcaucggccagauguuugagacaaccaugcgcggggccaagcggauggcuauucuuggagacacagccugggauuucggcucccucggaggggucuuuaccucuaucggcaaggcgcuccaucaaguguucggggcuaucuauggcgccgccuuuagcggaguguccuggacgaugaaaauucugaucggcguugucauuacauggaucgggaugaauagcagaucuaccucccugagcgugucucuugugcucgucggagugguuacccuguaccugggcgugaugguccaggcugacuccgggugugugguuagcuggaagaacaaagagcucaagugcggauccggcauuuucaucacagauaaugugcacaccuggacagaacaguauaaauuucagcccgagucuccuagcaagcuggccuccgcuauccaaaaggcccacgaagaggggauuuguggcauccgcucugucacgcggcuugaaaaccugauguggaaacagauuacccccgagcucaaucauauccugacagagaacgaagugaagcugaccauuaugacaggagacaucaaaggcaucaugcaggcggggaagagaagccuucgcccgcagccuaccgagcucaaauacuccuggaaggccuggggaaaagcuaagaugcugagcacggaacugcacaaucauaccuuccucauugauggccccgagacagccgaaugcccuaacaccaaucgggcuuggaacucucuggagguugaggacuauggguuuggaguguucacaaccaauaucuggcuuaagcugaaagaaagacaagaugucuuuugugacuccaagcucaugagcgccgcgauuaaagacaaccgcgccgugcacgcugauaugggcuacuggaucgagucugcccugaacgacacauggaagauugaaaaggcuuccuucaucgaggucaagagcugccacuggcccaagucucauacccuguggagcaauggcguccuugaguccgaaaugaucauuccuaaaaacuucgccgggcccguuagccagcacaauuaucggccgggauaccauacgcagacagccggcccuuggcaccucgggagacuggagauggauuuugacuucugugaaggaaccaccgugguggucacagaggauugcggcaaccgggggcccucucugcgcaccacgacagcuuccggaaagcucaucaccgaauggugcuguagaagcugcacacugcccccucuucgguacagaggcgaggacggcuguugguaugggauggagauucgcccgcugaaagaaaaggaggaaaaucucgugaacucccugguuaccgcgggacauggccagaucgauaauuuuucucugggggugcuuggaauggcccucuuccuggaggaaaugcugcggacaagagucggcaccaaacacgcuauucuccugguggccguuagcuuugugacgcuuaucaccgggaacauguccuuccgcgaccugggaagagucauggugaugguuggcgccacaaugaccgaugacauuggcaugggggugacauaccucgcucugcuggccgcguuuaagguccggcccaccuucgcugccggacuucugcuccgcaagcugacgucuaaagagcucaugaugacaaccaucggcaucgugcugcuuagccaauccacaauuccugagucuauccuggaacucaccgaugcccuggcucuggggaugauggugcuuaagauugucagaaauauggagaaauaucagcuggccguuaccaucauggcgauucucugcgugcccaacgcugugauccugcagaaugccuggaaggucagcuguacaacgcucgccgugguuuccgugagcccucugcuucugaccucuucccaacagaaagcugacuggaucccccucgcccugacaauuaagggacugaacccuaccgcuaucuuucuuacaacccugagccggacgucuaagaaacgcuccuggccccucaaugaagccauuauggcggucggcauggugagcauccuggccucuucccuccugaagaacgauauuccgaugacagggccucuuguugcuggaggccugcugaccgugugcuacguccucaccggcagaagcgccgaccuggagcuugaacgggcugccgacgugcgcugggaggagcaggccgaaaucuccgggagcucucccauccugagcauuacaaucuccgaggauggaucuaugagcauuaaaaaugaagaggaggaacagacccucacaauccugauuagaacgggccuccuggucaucuccgggcuuuucccugugucuauucccaucaccgcugcggccugguaucugugggagguuaagaaacaacgggcuggagugcugugggacgucccgagcccucccccugugggcaaggccgaacucgaggauggggccuaccgcaucaaacagaaggggauucugggcuauucccagaucggcgcugggguuuacaaggaaggaacauuucacaccauguggcaugugacaagaggcgccguccuuaugcacaaagggaagcggauugagcccucuugggcggacgugaaaaaggaucugaucagcuacggaggcggguggaaacucgagggagaauggaaggagggcgaagaggugcagguucuggcucucgaacccggcaagaacccuagagccguccaaaccaaaccggggcuguucaagacgaacaccggaacaauuggcgccgugucccuugacuuuagccccgggaccucuggauccccuaucguggauaaaaagggcaaagucguggggcuguauggaaauggcguugugacacgcagcggcaccuacgucucugcuaucgcccagacagagaaguccauugaggacaaccccgaaaucgaggaugacauuuuccggaagaaaagacugacgaucauggaucuccauccuggggcgggaaagaccaaacgcuaucugcccgcuauugugcgggaagccaucaagagaggccuucgcacacugauccucgccccuacccggguuguggcugccgagauggaagaggcucugagagggcucccgauucgcuaccagacccccgccauccgggcggagcacacaggaagagaaauugucgaccugaugugucaugccacguucaccaugcggcuucugagcccuauccgcgugcccaauuauaaccugauuaucauggaugaggcucacuuuacagacccugccuccauugcugccagaggcuacaucucuacccggguugaaaugggggaggccgcuggcaucuucaugacagcgacacccccgggaagccgcgacccuuuuccccaguccaaugcccccauuauggaugaggaaagagagaucccugaacggagcuggaacucuggccacgagugggugacggacuucaaagggaagacagucugguuugugcccuccauuaaggcuggaaaugauaucgccgccugccuccgcaaaaacggcaagaaagugauucaacugagccgcaagaccuucgacucugaauauaucaaaacccggacaaaugauugggacuuugucguuaccacagauaucagcgagaugggggcuaacuucaaggccgagagagugauugacccucgccgguguaugaagccggugauccuuaccgauggagaagagagagucauucuggcgggccccaugccugugacgcauuccucugcugcccagcgccgggggagaguuggccgcaaucccaaaaacgaaaaugaccaguacaucuacaugggagagccucucgaaaacgaugaggacugcgcccacuggaaggaggcuaaaaugcugcuggacaauauuaacacacccgaaggcaucaucccgagcauguuugagccugaaagagagaagguggaugccauugacggggaauaucggcuccgcggagaggcgagaaaaaccuucgucgaucuuaugcggcgcggcgaccugcccguguggcuggccuacagaguugcugccgaggggaucaacuaugcugaucggagaugguguuuugacggagugaagaauaaccaaauucucgaagagaaugucgaaguggagaucuggacaaaagagggcgaacgcaagaagcugaaaccucgguggcuugaugccagaauuuacuccgacccccuggcucucaaggaguucaaagaguucgccgcggggcgcaagucucugacccugaaccucaucacggagaugggccggcuuccuaccuuuaugacacagaaagccaagaaugcucuggauaaccuggccguccuccauaccgcugaagccggaggcagagccuauaaucacgcucugagcgagcuucccgagacacuggaaacccuccugcugcucacacuucuggcgaccgugacagggggaauuuuccuguuucucauguccggcaaggggaucggaaaaaugacacugggcaugugcugcaucauuaccgccagcauccuucugugguacgcucagauucagccgcacuggaucgccgccucuauuauccucgaguucuuucugaucguucugcucauuccugaacccgagaagcaacggacaccccaggacaaccagcuuacauauguggugaucgcuauucugaccgucguugccgcgacaauggccaaugaaaugggcuuccuggagaaaacgaagaaagauuuugggcucggauccaucaccacacagcaaccugagagcaacauucuggacaucgaucuucgcccggcuuccgccuggacccuguacgcuguggccacaaccuucaucacgcccaugcucagacauucuauugaaaauagcuccgugaacgucucucugaccgcgaucgccaaucaggcuacagugcugaugggccucgggaagggauggccucuuagcaagauggacauuggcguuccccugcuggccaucggguguuacucccaggugaacccuauuacccucacagcugcccugcuucugcucgucgcucacuaugccaucauuggacccggccugcaggcgaaagccacccgggaggcucaaaagcgcgccgcugccggcaucaugaaaaauccuacgguggacgggaugacagucaucgaucuggacccgauucccuacgauccuaaguuugaaaaacagcucggacaggugaugcuucugguucugugcgugacccagguccucaugaugagaacaaccugggcccugugugaggcgcuuacccuggcuacaggccccaucagcacgcucugggaagggaacccuggacgguucuggaauaccacaauugccgugucuauggcuaacaucuuucgcggcuccuaucuggccggggccggacugcuguucagcauuaugaagaacaccgcuaauacaagacggggcaccggcaacacgggggagacacuuggagagaaguggaaaaaucgccugaacgcccugggcaagucugaauuucaaaucuacaaaaaguccgggauccaggagguugacagaacccucgcgaaagaaggaauuaagcggggcgagaccgaucaucacgccgugagcagagggucugcuaaacugcgcugguucgucgagcggaaucuugugacacccgaaggaaaggugguugaccugggcugcggcagagggggauggagcuauuacuguggcgggcucaagaacgucaaagaggugaagggacugaccaaaggcgggccgggacaugaagaaccuauccccauguccacauauggcuggaaucuggugcgccuccagucuggcgucgauguuuucuuuacgcccccugaaaagugcgacacccuucugugugauauuggggagagcucccccaacccuacaguggaggccggacggacccugagagugcucaaucuggucgaaaacuggcuuaauaacaauacacaauucugcaucaaagugcugaacccguacaugcccagcguuauugagaagauggaagcucuccagcgcaaguacggcggggcccuggugcggaauccucuguccagaaacucuacccacgagauguauugggucagcaacgcguccggaaauaucgugucuagcguuaacaugaucucccgcaugcucauuaaucgguuuacgaugagacacaaaaaggccaccuacgaacccgacguggaucuuggcucugggacacgcaacaucggaauugagagcgagaccccuaaucuggacaucauuggcaaacggaucgaaaagaucaaacaggagcaugaaacauccuggcacuaugaucaggaccaucccuacaagaccugggcuuaucacggcagcuacgagacaaagcaaaccgggucugccuccagcauggucaacggaguggugagacugcucacgaaaccgugggacgucauuccuaugguuacacagauggcuaugaccgauaccacacccuucggccagcagcgcguguuuaaggaaaaaguggacacgagaacccaagagccuaaggaggggaccaaaaagcugaugaagaucaccgccgaauggcuuuggaaagagcugggaaagaaaaagacaccccggauguguacccgcgaagaguucacaagaaaaguccggucuaaugcugcccucggcgcgauuuuuaccgaugagaacaaguggaaauccgccagagaagcuguggaggacagcggguucugggaacugguugauaaggagcggaaucugcaccucgaaggaaagugcgagacguguguguauaacaugaugggcaaacgcgagaagaaacugggcgaauuugggaaggccaaaggaucuagagcuaucugguacauguggcuuggcgcccgguuccuggaguuugaagcccucggguuccugaaugaggaccauugguuuucccgcgaaaacagccuuuccggagucgagggcgaggggcugcacaagcucggcuacauucugagagaugugagcaagaaagaaggaggcgcgauguaugcugacgauaccgccgggugggacacacggaucacccuggaggaucucaagaaugaagagaugguuacaaaccauauggaaggagagcacaaaaagcuggccgaggcuauuuucaaacuuaccuaccagaauaaggugguccgcgugcagagaccuacgccccggggcacaguuauggacaucaucucucgcagagaccagcgggggagcggacaaguggucaccuauggccugaacacauucaccaacauggaagcccagcucauucgccagauggagggggaaggcguguuuaaguccauccaacagcugacggucaaagaggagauugcugugaagaauuggcuuaucagaguuggacgggaacgccugucuagaauggccauuagcggcgaugacugcguggucaaaccgcucgaugaccgguucgcguccgcccugaccgcucugaacgauauggggaaggugagaaaagacauccagcagugggagccuucucgcggauggaaugauuggacacaagugcccuuuugcagccaucacuuccacgaacucaucaugaaggacggccggguucuggugguccccuguagaaaccaggaugagcuuauugggcgcgcccggaucucccagggagcuggcuggucucugagagaaaccgccugccucggaaagagcuacgcgcagauguggucccugauguauuuucaucgccgggaccuuagacuggccgcuaaugccauuuguagcgcugugccuucucacuggaucccgacaucccgcaccacauggagcauucaugccacccacgaguggaugacgacagaggauaugcucaccguuuggaaccggguguggauccaagaaaaucccuggauggaggacaaaaccccugucgaaacaugggaggaaauccccuaccugggcaagagagaggaucaguggugcggaucucugauuggccucaccucccgcgcuacaugggccaaaaacauccagacggcgauuaaucaggugcggagccugaucgggaacgaggaauauaccgacuacaugccuuccaugaagagauuccggagagaggaagaggaagccggaguccuuugguga

SEQ ID NO: 19608 - RNA, 9876 nt, Artificial Sequence
  derived and/or modified CDS sequence (opt5) from DENV-2__KM279521__SS-prME
accgccggaaucauuaucaugaugauucccaccgugauggcuuuccaccugacgaccagaaacggggaaccucauaugaucgucagccggcaggaaaagggaaaaucccuccuguuuaagacagagaauggaguuaacaugugcacccuuauggccauggaccugggggaacucugugaggauaccauuaccuacaauugcccccugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuacagugaacaucgaagcugagccuccguuuggcgauuccuacauuaucauuggggucgaacccggccagcucaagcugagcugguucaaaaagggaucuagcaucggccagauguuugagaccacaaugagaggggccaagcgcauggccauucuuggagacaccgcuugggauuucggcucccucgggggaguguuuacgucuaucggcaaagcccuccaucaaguguucggggcgaucuauggcgcugccuuuagcggaguuuccuggacaaugaagauucugaucggcgucgugauuaccuggaucgggaugaauagccggucuaccucccugagcgugucucuuguccucgugggaguugugacacuguaccugggcgucauggugcaggccgacuccggguguguugugagcuggaaaaacaaggagcucaaaugcggauccggcauuuucaucaccgauaauguccacacauggacggaacaguauaaguuucagccugagucucccagcaagcuggcuuccgccauccaaaaagcucacgaagaggggauuuguggcaucagaucugugacccgccuugaaaaccugauguggaagcagauuacaccugagcucaaucauauccugaccgagaacgaaguuaaacugacaauuaugaccggagacaucaagggcaucaugcaggccgggaaacggagccuuagaccccagccgacggagcucaaguacuccuggaaagcguggggaaaggccaagaugcugagcaccgaacugcacaaucauacauuccucauugauggcccugagaccgcugaaugccccaacacaaaucgcgccuggaacucucuggagguggaggacuauggguuuggagucuucaccacaaauaucuggcuuaaacugaaggaacggcaagauguguuuugugacuccaaacucaugagcgcugccauuaaggacaacagagcggugcacgccgauaugggcuacuggaucgagucugcucugaacgacaccuggaaaauugaaaaggccuccuucaucgaggucaagagcugccacuggccuaaaucucauacgcuguggagcaauggcguucuugaguccgaaaugaucauucccaagaacuucgcugggccugugagccagcacaauuaucgccccggauaccauacacagaccgccggcccguggcaccucgggcggcuggagauggauuuugacuucugugaaggaaccacaguggucgugaccgaggauugcggcaacagagggccuucucugcggacgacaaccgccuccggaaaacucaucacagaauggugcugucgcagcugcacccugccgccccuuagauaccggggcgaggacggcuguugguaugggauggagauuagaccucugaaggaaaaagaggaaaaucucguuaacucccuggugacagcuggacauggccagaucgauaauuuuucucuggggguccuuggaauggcgcuguuccuggaggaaaugcugcgcacccgggugggcacgaagcacgccauucuccugguugcugugagcuuugucacccuuaucacagggaacauguccuucagagaccugggacgcgugaugguuauggugggcgccaccaugacagaugacauuggcaugggggucaccuaccucgcccugcuggcugccuuuaaggugagaccgacguucgcggcuggacuucugcuccggaaacugacaucuaaggagcucaugaugaccacaaucggcaucgugcugcuuagccaauccaccauucccgagucuauccuggaacucaccgaugcccuggcccuggggaugaugguccuuaaaauuguucgcaauauggagaaguaucagcuggcugugacaaucauggccauucucugcgugccuaacgcggucauccugcagaaugcuuggaaagugagcuguacgacccucgccguuguguccgucagcccccugcuucugacaucuucccaacagaaggccgacuggaucccucucgcucugaccauuaagggacugaaccccacagccaucuuucuuaccacgcugagcagaacaucuaaaaagcgguccuggccucucaaugaagcuauuauggccgugggcaugguuagcauccuggcgucuucccuccugaaaaacgauauucccaugaccgggccgcuuguggccggaggccugcugaccgucugcuacgugcucacaggccgcagcgcugaccuggagcuugaaagagccgcugacguccggugggaggagcaggccgaaaucuccgggagcucuccuauccugagcauuaccaucuccgaggauggaucuaugagcauuaagaaugaagaggaggaacagacacucacgauccugauucgcaccggccuccuggugaucuccgggcuuuuccccguuucuauuccuaucacagccgcugcgugguaucugugggaggugaaaaagcaaagagccggaguccugugggacgugcccagcccgccucccguuggcaaagcugaacucgaggauggggccuaccggaucaagcagaagggcauucugggcuauucccagaucggcgccgggguguacaaagaaggaaccuuucacacaauguggcaugucacccgcggcgcugugcuuaugcacaaggggaaaagaauugagccuucuugggccgacgugaagaaagaucugaucagcuacggaggcggguggaagcucgagggagaauggaaggagggcgaagagguucagguccuggcgcucgaacccggcaaaaacccccgggcugugcaaacgaagccugggcuguucaaaaccaacacaggaaccauuggcgccgugucccuugacuuuagcccggggacaucuggaucccccaucgucgauaagaaaggcaaggugguugggcuguauggaaauggcguggucaccagaagcggcacauacgugucugccaucgcucagacggagaaguccauugaggacaacccugaaaucgaggaugacauuuuccgcaaaaagcggcugaccaucauggaucuccaucccggggccggaaaaacaaagagauaucugccugcgauuguucgcgaagcuaucaaacggggccuuagaacccugauccucgcccccacccgcguggucgccgcugagauggaagaggcccugcgggggcucccuauuagauaccagacaccggcuauccgcgccgagcacacgggacgggaaauuguggaccugaugugucaugcgaccuucacaaugagacuucugagccccauccggguuccuaauuauaaccugauuaucauggaugaggcccacuuuaccgaccccgcuuccauugccgcucgcggcuacaucucuacaagaguggaaaugggggaggccgccggcaucuucaugaccgcuacgccucccggaagccgggacccguuuccucaguccaaugcgcccauuauggaugaggaacgcgagauccccgaaagaagcuggaacucuggccacgagugggucacagacuucaaggggaagaccgugugguuugugccuuccauuaaagccggaaaugauaucgcugccugccuccggaagaacggcaaaaaggucauucaacugagcagaaaaaccuucgacucugaauauaucaagacacgcaccaaugauugggacuuuguugugacaaccgauaucagcgagaugggggccaacuucaaggcugagcgggugauugaccccagacgcuguaugaaaccugucauccuuacggauggagaggaacgggugauucuggccggcccgaugcccguuacacauuccucugcggcucagagacgcgggcgggugggcagaaauccuaagaacgaaaaugaccaguacaucuacaugggagagccccucgaaaacgaugaggacugcgcccacuggaaagaggccaagaugcugcuggacaauauuaacaccccugaaggcaucauccccagcauguuugagccggaacgcgagaaagucgaugcuauugacggggaauauagacuccggggagaggcccgcaagacauucguggaucuuaugagacggggcgaccugccuguuuggcuggcguaccgcguggccgcugaggggaucaacuaugccgauagacggugguguuuugacggagucaaaaauaaccaaauucucgaagagaauguggaagucgagaucuggaccaaggagggcgaaagaaagaaacugaagccccgcuggcuugaugcucggauuuacuccgacccucuggcccucaaagaguucaaggaguucgcugccgggagaaaaucucugacgcugaaccucaucaccgagaugggccgccuucccacauuuaugacccagaaggcgaagaaugcccuggauaaccuggcugugcuccauacagccgaagcuggaggccgggccuauaaucacgcccugagcgagcuuccugagacccuggaaacacuccugcugcucacccuucuggcuacgguuacagggggaauuuuccuguuucucauguccggcaaagggaucggaaagaugacccugggcaugugcugcaucauuaccgcgagcauccuucugugguacgcccagauucagccccacuggaucgcugccucuauuauccucgaguucuuucugaucgugcugcucauuccggaaccugagaaacaaagaacaccccaggacaaccagcuuaccuauguggucaucgccauucugacaguuguggcugccacgauggcgaaugaaaugggcuuccuggagaagaccaaaaaggauuuugggcucggauccaucacaacccagcaacccgagagcaacauucuggacaucgaucuucggccugccuccgcuuggacacuguacgccguggcuaccacguucaucaccccgaugcuccgccauucuauugaaaauagcuccgucaacgugucucugacagccaucgcgaaucaggccaccguucugaugggccucgggaagggauggccccuuagcaaaauggacauuggcgugccucugcuggcuaucggguguuacucccaggucaaccccauuacacucaccgccgcucugcuucugcucguggcccacuaugcuaucauuggaccuggccugcaggccaaggcgacgagagaggcccaaaaacgggcugccgcuggcaucaugaagaaucccacagucgacgggaugaccgugaucgaucuggacccuauuccguacgaucccaaauuugaaaagcagcucggacagguuaugcuucuggugcugugcgucacacaggugcucaugaugcgcaccaccugggcccugugugaggcccuuacacuggcgacgggcccuaucagcacccucugggaagggaaccccggaagauucuggaauacaaccauugcuguuucuauggccaacaucuuucggggcuccuaucuggcuggggccggacuccuguucagcauuaugaagaacacagccaauacccgcagaggcacgggcaacacaggggagacccuuggagagaaauggaagaaucggcugaacgcucugggcaaaucugaauuucaaaucuacaagaaauccgggauccaggagguggaccgcacccucgccaaggaaggaauuaaaagaggcgagacagaucaucacgcggucagccgggggucugccaagcugagaugguucguggagcgcaaucuugugaccccugaaggaaagguugucgaccugggcugcggcagagggggauggagcuauuacuguggcgggcucaaaaacgugaaggaggugaaaggacugacaaagggcgggcccggacaugaagaacccaucccuauguccacguauggcuggaaucuggucagacuccagucuggcguugauguguucuuuacaccgcccgaaaaaugcgacacacuucugugugauauuggggagagcuccccuaaccccaccguggaggcuggacgcacacugcggguccucaaucugguggaaaacuggcuuaauaacaauacccaauucugcaucaagguucugaacccuuacaugccgagcgugauugagaagauggaagcccuccagagaaaauacggcggggcucugguccgcaauccccugucccggaacucuacgcacgagauguauugggugagcaacgccuccggaaauaucguuucuagcgugaacaugaucuccagaaugcucauuaaucgcuuuaccaugcggcacaagaaagcgacauacgaaccugacgucgaucuuggcucugggaccagaaacaucggaauugagagcgagacacccaaucuggacaucauuggcaagcgcaucgagaagaucaagcaggagcaugaaaccuccuggcacuaugaucaggaccauccuuacaagacaugggccuaucacggcagcuacgagaccaaacaaacggggucugcuuccagcauggugaacggagugguccggcugcucacaaagcccugggacguuauuccgauggugacccagauggccaugaccgauacaacgccuuucggccagcagagaguguuuaaagaaaaggucgacacccgcacacaagagcccaaagaggggaccaagaagcugaugaaaaucacagcugaauggcuuuggaaggagcugggcaaaaagaaaaccccuagaauguguacacgggaagaguucacccgcaaggugagaucuaaugccgcucucggcgccauuuuuacggaugagaacaaauggaaguccgcgcgggaagccguugaggacagcggguucugggaacugguggauaaggagagaaaucugcaccucgaaggaaaaugcgagaccugugucuauaacaugaugggcaagcgggagaaaaagcugggcgaauuugggaaagcuaagggaucucgcgccaucugguacauguggcuuggcgcuagauuccuggaguuugaagcccucggguuccugaaugaggaccauugguuuucccgggaaaacagccuuuccggaguggagggcgaggggcugcacaagcucggcuacauucugcgcgauguuagcaaaaaggaaggaggcgccauguaugcggacgauacagcugggugggacaccagaaucacacuggaggaucucaaaaaugaagagauggugaccaaccauauggaaggagagcacaagaaacuggccgaggccauuuucaaacuuacguaccagaauaaggucgugcggguucagcgccccacaccuagaggcaccgugauggacaucaucucucggcgcgaccagagagggagcggacaagucgugacauauggccugaacaccuucacgaacauggaagcucagcucauucggcagauggagggggaaggcgucuuuaaauccauccaacagcugaccgugaaggaggagauugccguuaaaaauuggcuuauccgcgugggaagagaacggcugucucgcauggcuauuagcggcgaugacugcgucgugaagccccucgaugacagauucgccuccgcgcugacagcccugaacgauauggggaaagugcggaaggacauccagcagugggagccgucuagaggauggaaugauuggacccaaguuccuuuuugcagccaucacuuccacgaacucaucaugaaggacggccgcgugcuggucgugcccugucggaaccaggaugagcuuauugggagagcucgcaucucccagggagccggcuggucucugcgggaaacagcuugccucgggaaaagcuacgcccagauguggucccugauguauuuucauagacgcgaccuucggcuggcggccaaugcuauuuguagcgccguucccucucacuggaucccuaccuccagaacaaccuggagcauucaugcuacgcacgaguggaugacaaccgaggauaugcucaccguguggaaccgcgucuggauccaagaaaauccguggauggaggacaagacacccguggaaucuugggaggaaaucccuuaccugggcaaacgggaggaucaguggugcggaucccugauuggccucaccagcagagccacaugggcuaagaacauccagacggccauuaaucagguccgcucccugaucgggaacgaggaauauaccgacuacaugcccucuaugaaacgguucagacgggaggaagaggaagcgggagugcuuugguga

SEQ ID NO: 19609 - RNA, 9876 nt, Artificial Sequence
  derived and/or modified CDS sequence (opt5) from DENV-2__KM279583__SS-prME
accgccggaaucauuaucaugaugauucccaccgugauggcuuuccaccugacgaccagaaacggggaaccucauaugaucgugagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagauggcccugcuccagauggaaaacaaggcuuggcugguccaccgccaaugguuucuugaucugccccucccguggcugccuggcgccgacacccagggguccaacuggauccagaaagagacacuggugaccuucaagaauccccacgccaagaaacaggauguugugguccucggaagccaagagggcgcuaugcauacggcgcugacaggggccaccgaaauucagauguccucuggcaaccuucuguuuacaggacaccucaagugcagacugcggauggacaaacuucagcugaagggcaugagcuauuccauguguaccgggaaauucaagguggucaaggagaucgcugaaacccaacauggaacaauugugaucagaguucaguacgagggcgacgggagcccuugcaaaauucccuucgagaucauggaucucgaaaagcgccacgugcugggacggcugaucacggucaaucccauugugaccgagaaagacucuccuguuaacaucgaagccgagccgcccuuuggcgauuccuacauuaucauugggguggaaccuggccagcucaagcugagcugguucaaaaagggaucuagcaucggccagauguuugagacaaccaugagaggggccaagcgcauggcuauucuuggagacacagccugggauuucggcucccucgggggagucuuuaccucuaucggcaaagcgcuccaucaaguguucggggcuaucuauggcgccgccuuuagcggaguguccuggacgaugaagauucugaucggcguugucauuacauggaucgggaugaauagccggucuaccucccugagcgugucucuugugcucgucggagugguuacccuguaccugggcgugaugguccaggcugacuccgggugugugguuagcuggaaaaacaaggagcucaaaugcggauccggcauuuucaucacagauaaugugcacaccuggacagaacaguauaaguuucagcccgagucuccuagcaagcuggccuccgcuauccaaaaagcccacgaagaggggauuuguggcaucagaucugucacgcgccuugaaaaccugauguggaagcagauuacccccgagcucaaucauauccugacagagaacgaagugaaacugaccauuaugacaggagacaucaagggcaucaugcaggcggggaaacggagccuuagaccgcagccuaccgagcucaaguacuccuggaaagccuggggaaaggcuaagaugcugagcacggaacugcacaaucauaccuuccucauugauggccccgagacagccgaaugcccuaacaccaaucgcgcuuggaacucucuggagguugaggacuauggguuuggaguguucacaaccaauaucuggcuuaaacugaaggaacggcaagaugucuuuugugacuccaaacucaugagcgccgcgauuaaggacaacagagccgugcacgcugauaugggcuacuggaucgagucugcccugaacgacacauggaaaauugaaaaggcuuccuucaucgaggucaagagcugccacuggcccaaaucucauacccuguggagcaauggcguccuugaguccgaaaugaucauuccuaagaacuucgccgggcccguuagccagcacaauuaucgcccgggauaccauacgcagacagccggcccuuggcaccucgggcggcuggagauggauuuugacuucugugaaggaaccaccgugguggucacagaggauugcggcaacagagggcccucucugcggaccacgacagcuuccggaaaacucaucaccgaauggugcugucgcagcugcacacugcccccucuuagauaccggggcgaggacggcuguugguaugggauggagauuagaccgcugaaggaaaaagaggaaaaucucgugaacucccugguuaccgcgggacauggccagaucgauaauuuuucucugggggugcuuggaauggcccucuuccuggaggaaaugcugcgcacacgggucggcaccaagcacgcuauucuccugguggccguuagcuuugugacgcuuaucaccgggaacauguccuucagagaccugggacgcgucauggugaugguuggcgccacaaugaccgaugacauuggcaugggggugacauaccucgcucugcuggccgcguuuaaggucagacccaccuucgcugccggacuucugcuccggaaacugacgucuaaggagcucaugaugacaaccaucggcaucgugcugcuuagccaauccacaauuccugagucuauccuggaacucaccgaugcccuggcucuggggaugauggugcuuaaaauuguccgcaauauggagaaguaucagcuggccguuaccaucauggcgauucucugcgugcccaacgcugugauccugcagaaugccuggaaagucagcuguacaacgcucgccgugguuuccgugagcccucugcuucugaccucuucccaacagaaggcugacuggaucccccucgcccugacaauuaagggacugaacccuaccgcuaucuuucuuacaacccugagcagaacgucuaaaaagcgguccuggccccucaaugaagccauuauggcggucggcauggugagcauccuggccucuucccuccugaaaaacgauauuccgaugacagggccucuuguugcuggaggccugcugaccgugugcuacguccucaccggccgcagcgccgaccuggagcuugaaagagcugccgacgugcggugggaggagcaggccgaaaucuccgggagcucucccauccugagcauuacaaucuccgaggauggaucuaugagcauuaagaaugaagaggaggaacagacccucacaauccugauucgcacgggccuccuggucaucuccgggcuuuucccugugucuauucccaucaccgcugcggccugguaucugugggagguuaaaaagcaaagagcuggagugcugugggacgucccgagcccucccccugugggcaaagccgaacucgaggauggggccuaccggaucaagcagaagggcauucugggcuauucccagaucggcgcugggguuuacaaagaaggaacauuucacaccauguggcaugugacacgcggcgccguccuuaugcacaaggggaaaagaauugagcccucuugggcggacgugaagaaagaucugaucagcuacggaggcggguggaagcucgagggagaauggaaggagggcgaagaggugcagguucuggcucucgaacccggcaaaaacccucgggccguccaaaccaagccggggcuguucaaaacgaacaccggaacaauuggcgccgugucccuugacuuuagccccgggaccucuggauccccuaucguggauaagaaaggcaaggucguggggcuguauggaaauggcguugugacaagaagcggcaccuacgucucugcuaucgcccagacagagaaguccauugaggacaaccccgaaaucgaggaugacauuuuccgcaaaaagcggcugacgaucauggaucuccauccuggggcgggaaaaaccaagagauaucugcccgcuauugugcgcgaagccaucaaacggggccuuagaacacugauccucgccccuacccgcguuguggcugccgagauggaagaggcucugcgggggcucccgauuagauaccagacccccgccauccgcgcggagcacacaggacgggaaauugucgaccugaugugucaugccacguucaccaugagacuucugagcccuauccgggugcccaauuauaaccugauuaucauggaugaggcucacuuuacagacccugccuccauugcugcccgcggcuacaucucuaccagaguugaaaugggggaggccgcuggcaucuucaugacagcgacacccccgggaagccgggacccuuuuccccaguccaaugcccccauuauggaugaggaacgcgagaucccugaaagaagcuggaacucuggccacgagugggugacggacuucaaggggaagacagucugguuugugcccuccauuaaagcuggaaaugauaucgccgccugccuccggaagaacggcaaaaaggugauucaacugagcagaaaaaccuucgacucugaauauaucaagacccgcacaaaugauugggacuuugucguuaccacagauaucagcgagaugggggcuaacuucaaggccgagcgggugauugacccuagacgcuguaugaaaccggugauccuuaccgauggagaggaacgggucauucuggcgggccccaugccugugacgcauuccucugcugcccagagacgcgggcggguuggcagaaaucccaagaacgaaaaugaccaguacaucuacaugggagagccucucgaaaacgaugaggacugcgcccacuggaaagaggcuaagaugcugcuggacaauauuaacacacccgaaggcaucaucccgagcauguuugagccugaacgcgagaaaguggaugccauugacggggaauauagacuccggggagaggcgcgcaagaccuucgucgaucuuaugagacggggcgaccugcccguguggcuggccuaccgcguugcugccgaggggaucaacuaugcugauagacggugguguuuugacggagugaaaaauaaccaaauucucgaagagaaugucgaaguggagaucuggacaaaggagggcgaaagaaagaaacugaagccucgcuggcuugaugcccggauuuacuccgacccccuggcucucaaagaguucaaggaguucgccgcggggagaaaaucucugacccugaaccucaucacggagaugggccgccuuccuaccuuuaugacacagaaggccaagaaugcucuggauaaccuggccguccuccauaccgcugaagccggaggccgggccuauaaucacgcucugagcgagcuucccgagacacuggaaacccuccugcugcucacacuucuggcgaccgugacagggggaauuuuccuguuucucauguccggcaaagggaucggaaagaugacacugggcaugugcugcaucauuaccgccagcauccuucugugguacgcucagauucagccgcacuggaucgccgccucuauuauccucgaguucuuucugaucguucugcucauuccugaacccgagaaacaaagaacaccccaggacaaccagcuuacauauguggugaucgcuauucugaccgucguugccgcgacaauggccaaugaaaugggcuuccuggagaagacgaaaaaggauuuugggcucggauccaucaccacacagcaaccugagagcaacauucuggacaucgaucuucggccggcuuccgccuggacccuguacgcuguggccacaaccuucaucacgcccaugcuccgccauucuauugaaaauagcuccgugaacgucucucugaccgcgaucgccaaucaggcuacagugcugaugggccucgggaagggauggccucuuagcaaaauggacauuggcguuccccugcuggccaucggguguuacucccaggugaacccuauuacccucacagcugcccugcuucugcucgucgcucacuaugccaucauuggacccggccugcaggcgaaggccaccagagaggcucaaaaacgggccgcugccggcaucaugaagaauccuacgguggacgggaugacagucaucgaucuggacccgauucccuacgauccuaaauuugaaaagcagcucggacaggugaugcuucugguucugugcgugacccagguccucaugaugcgcacaaccugggcccugugugaggcgcuuacccuggcuacaggccccaucagcacgcucugggaagggaacccuggaagauucuggaauaccacaauugccgugucuauggcuaacaucuuucggggcuccuaucuggccggggccggacugcuguucagcauuaugaagaacaccgcuaauacacgcagaggcaccggcaacacgggggagacacuuggagagaaauggaagaaucggcugaacgcccugggcaaaucugaauuucaaaucuacaagaaauccgggauccaggagguugaccgcacccucgcgaaggaaggaauuaaaagaggcgagaccgaucaucacgccgugagccgggggucugcuaagcugagaugguucgucgagcgcaaucuugugacacccgaaggaaaggugguugaccugggcugcggcagagggggauggagcuauuacuguggcgggcucaaaaacgucaaggaggugaaaggacugaccaagggcgggccgggacaugaagaaccuauccccauguccacauauggcuggaaucuggugagacuccagucuggcgucgauguuuucuuuacgcccccugaaaaaugcgacacccuucugugugauauuggggagagcucccccaacccuacaguggaggccggacgcacccugcgggugcucaaucuggucgaaaacuggcuuaauaacaauacacaauucugcaucaaggugcugaacccguacaugcccagcguuauugagaagauggaagcucuccagagaaaauacggcggggcccuggugcgcaauccucugucccggaacucuacccacgagauguauugggucagcaacgcguccggaaauaucgugucuagcguuaacaugaucuccagaaugcucauuaaucgcuuuacgaugcggcacaagaaagccaccuacgaacccgacguggaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggcuuaucacggcagcuacgagacaaaacaaaccgggucugccuccagcauggucaacggaguggugcggcugcucacgaagccgugggacgucauuccuaugguuacacagauggcuaugaccgauaccacacccuucggccagcagagaguguuuaaagaaaagguggacacgcgcacccaagagccuaaagaggggacaaagaagcugaugaaaaucaccgccgaauggcuuuggaaggagcugggcaaaaagaaaacacccagaauguguacccgggaagaguucacacgcaaggucagaucuaaugcugcccucggcgcgauuuuuaccgaugagaacaaauggaaguccgcccgggaagcuguggaggacagcggguucugggaacugguugauaaggagagaaaucugcaccucgaaggaaaaugcgagacguguguguauaacaugaugggcaagcgggagaaaaagcugggcgaauuugggaaagccaagggaucucgcgcuaucugguacauguggcuuggcgccagauuccuggaguuugaagcccucggguuccugaaugaggaccauugguuuucccgggaaaacagccuuuccggagucgagggcgaggggcugcacaagcucggcuacauucugcgcgaugugagcaaaaaggaaggaggcgcgauguaugcugacgauaccgccgggugggacacaagaaucacccuggaggaucucaaaaaugaagagaugguuacaaaccauauggaaggagagcacaagaaacuggccgaggcuauuuucaaacuuaccuaccagaauaaggugguccgggugcagcgcccuacgcccagaggcacaguuauggacaucaucucucggcgcgaccagagagggagcggacaaguggucaccuauggccugaacacauucaccaacauggaagcccagcucauucggcagauggagggggaaggcguguuuaaauccauccaacagcugacggucaaggaggagauugcugugaaaaauuggcuuauccgcguuggaagagaacggcugucucgcauggccauuagcggcgaugacugcguggucaagccgcucgaugacagauucgcguccgcccugaccgcucugaacgauauggggaaagugcggaaggacauccagcagugggagccuucuagaggauggaaugauuggacacaagugcccuuuugcagccaucacuuccacgaacucaucaugaaggacggccgcguucuggugguccccugucggaaccaggaugagcuuauugggagagcccgcaucucccagggagcuggcuggucucugcgggaaaccgccugccucgggaaaagcuacgcgcagauguggucccugauguauuuucauagacgcgaccuucggcuggccgcuaaugccauuuguagcgcugugccuucucacuggaucccgacauccagaaccacauggagcauucaugccacccacgaguggaugacgacagaggauaugcucaccguuuggaaccgcguguggauccaagaaaaucccuggauggaggacaagaccccugucgaaucuugggaggaaauccccuaccugggcaaacgggaggaucaguggugcggaucccugauuggccucacaagcagagcuaccugggccaagaacauccagacagcgauuaaucaggugcgcucccugaucgggaacgaggaauauacggacuacaugccuucuaugaaacgguucagacgggaggaagaggaagccggaguccuuugguga

SEQ ID NO: 19610 - RNA, 9876 nt, Artificial Sequence
  derived and/or modified CDS sequence (opt5) from DENV-2__KM279585__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggcguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguugugagaguccaguacgagggcgacgggagcccuugcaaaauccccuucgagauuauggaucucgaaaagcgccacgugcugggacggcugaucacgguuaaucccaucgugaccgagaaagacucuccugucaacauugaagcugagccgcccuuuggcgauuccuacaucauuaucgggguggaaccuggccagcucaagcugagcugguucaaaaagggaucuagcauuggccagauguuugagacaaccaugagaggggccaagcgcauggccauccuuggagacacagcuugggauuucggcucccucgggggaguguuuaccucuauuggcaaagcccuccaucaaguuuucggggcgaucuauggcgcugccuuuagcggagucuccuggacgaugaagauccugauuggcguggugaucacauggauugggaugaauagccggucuaccucccugagcgucucucuugugcucguuggaguggucacccuguaccugggcgugaugguucaggccgacuccggguguguggucagcuggaaaaacaaggagcucaaaugcggauccggcaucuucauuacagauaaugugcacaccuggacagaacaguauaaguuucagcccgagucuccuagcaagcuggcuuccgccauccaaaaagcucacgaagaggggaucuguggcauuagaucuguuacgcgccuugaaaaccugauguggaagcagaucacccccgagcucaaucauauucugacagagaacgaagugaaacugaccaucaugacaggagacauuaagggcaucaugcaggccgggaaacggagccuuagaccgcagccuaccgagcucaaguacuccuggaaagcguggggaaaggccaagaugcugagcacggaacugcacaaucauaccuuccucaucgauggccccgagacagcugaaugcccuaacaccaaucgcgccuggaacucucuggaggucgaggacuauggguuuggaguguucacaaccaauauuuggcuuaaacugaaggaacggcaagauguguuuugugacuccaaacucaugagcgcugccaucaaggacaacagagcgguccacgccgauaugggcuacuggauugagucugcucugaacgacacauggaaaaucgaaaaggccuccuucauugagguuaagagcugccacuggcccaaaucucauacccuguggagcaauggcgugcuugaguccgaaaugaucaucccuaagaacuucgcugggcccgugagccagcacaauuaucgcccgggauaccauacgcagacagccggcccuuggcaccucgggcggcuggagauggauuuugacuucugugaaggaaccaccgucgugguuacagaggauugcggcaacagagggcccucucugcggaccacgacagccuccggaaaacucauuaccgaauggugcugucgcagcugcacacugcccccucuuagauaccggggcgaggacggcuguugguaugggauggagaucagaccgcugaaggaaaaagaggaaaaucucgugaacucccuggucaccgcuggacauggccagauugauaauuuuucucugggggugcuuggaauggcgcuguuccuggaggaaaugcugcgcacacggguuggcaccaagcacgccauccuccugguggcugucagcuuugugacgcuuauuaccgggaacauguccuucagagaccugggacgcguuauggugauggucggcgccacaaugaccgaugacaucggcaugggggugacauaccucgcccugcuggcugccuuuaaggugagacccaccuucgcggcuggacuucugcuccggaaacugacgucuaaggagcucaugaugacaaccauuggcaucguccugcuuagccaauccacaaucccugagucuauucuggaacucaccgaugcccuggcccuggggaugaugguucuuaaaaucgugcgcaauauggagaaguaucagcuggcugugaccauuauggccauccucugcguccccaacgcggugauucugcagaaugcuuggaaaguuagcuguacaacgcucgccguggucuccgugagcccucugcuucugaccucuucccaacagaaggccgacuggaucccccucgcucugacaaucaagggacugaacccuaccgccauuuuucuuacaacccugagcagaacgucuaaaaagcgguccuggccccucaaugaagcuaucauggccguuggcauggugagcauucuggcgucuucccuccugaaaaacgauaucccgaugacagggccucuugucgccggaggccugcugaccgugugcuacguccucaccggccgcagcgcugaccuggagcuugaaagagccgcugacgugcggugggaggagcaggccgaaauuuccgggagcucucccauccugagcaucacaauuuccgaggauggaucuaugagcaucaagaaugaagaggaggaacagacccucacaauucugauccgcacgggccuccugguuauuuccgggcuuuucccugugucuauccccauuaccgccgcugcgugguaucugugggaggucaaaaagcaaagagccggagugcugugggacguuccgagcccucccccugugggcaaagcugaacucgaggauggggccuaccggaucaagcagaagggaauccugggcuauucccagauuggcgccggggucuacaaagaaggaacauuucacaccauguggcaugugacacgcggcgcugugcuuaugcacaaggggaaaagaaucgagcccucuugggccgacguuaagaaagaucugauuagcuacggaggcggguggaagcucgagggagaauggaaggagggcgaagagguccaggugcuggcgcucgaacccggcaaaaacccucgggcugugcaaaccaagccggggcuguucaaaacgaacaccggaacaaucggcgccgucucccuugacuuuagccccgggaccucuggauccccuauuguggauaagaaaggcaagguuguggggcuguauggaaauggcgucgugacaagaagcggcaccuacguuucugccaucgcucagacagagaaguccaucgaggacaaccccgaaauugaggaugacaucuuccgcaaaaagcggcugacgauuauggaucuccauccuggggccggaaaaaccaagagauaucugcccgcgaucgugcgcgaagcuauuaaacggggccuuagaacacugauccucgccccuacccgcgucguggccgcugagauggaagaggcccugcgggggcucccgaucagauaccagacccccgcuauucgcgccgagcacacaggacgggaaaucguugaccugaugugucaugcgacguucaccaugagacuucugagcccuauucgggugcccaauuauaaccugaucauuauggaugaggcccacuuuacagacccugcuuccaucgccgcucgcggcuacauuucuaccagagucgaaaugggggaggccgccggcaucuucaugacagcuacacccccgggaagccgggacccuuuuccccaguccaaugcgcccaucauggaugaggaacgcgagauuccugaaagaagcuggaacucuggccacgagugggugacggacuucaaggggaagacagugugguuuguccccuccaucaaagccggaaaugauauugcugccugccuccggaagaacggcaaaaagguuauccaacugagcagaaaaaccuucgacucugaauauauuaagacccgcacaaaugauugggacuuuguggugaccacagauaucagcgagaugggggccaacuucaaggcugagcgggucaucgacccuagacgcuguaugaaaccggugauucuuaccgauggagaggaacggguuauccuggccggccccaugccugugacgcauuccucugcggcucagagacgcgggcgggucggcagaaaucccaagaacgaaaaugaccaguacauuuacaugggagagccucucgaaaacgaugaggacugcgcccacuggaaagaggccaagaugcugcuggacaauaucaacacacccgaaggcauuaucccgagcauguuugagccugaacgcgagaaaguggaugcuaucgacggggaauauagacuccggggagaggcccgcaagaccuucguugaucuuaugagacggggcgaccugcccguguggcuggcguaccgcgucgccgcugaggggauuaacuaugccgauagacggugguguuuugacggagugaaaaauaaccaaauccucgaagagaaugucgaaguggagauuuggacaaaggagggcgaaagaaagaaacugaagccucgcuggcuugaugcucggaucuacuccgacccccuggcccucaaagaguucaaggaguucgcugccgggagaaaaucucugacccugaaccucauuacggagaugggccgccuuccuaccuuuaugacacagaaggcgaagaaugcccuggauaaccuggcuguucuccauaccgccgaagcuggaggccgggccuauaaucacgcccugagcgagcuucccgagacacuggaaacccuccugcugcucacacuucuggcuaccgugacagggggaaucuuccuguuucucauguccggcaaagggauuggaaagaugacacugggcaugugcugcaucaucaccgcgagcauucuucugugguacgcccagauccagccgcacuggauugcugccucuaucauucucgaguucuuucugaucgugcugcucaucccugaacccgagaaacaaagaacaccccaggacaaccagcuuacauaugucguuauugccauccugaccgugguggcugccacaauggcgaaugaaaugggcuuccuggagaagacgaaaaaggauuuugggcucggauccauuaccacacagcaaccugagagcaacauccuggacauugaucuucggccggccuccgcuuggacccuguacgccgucgcuacaaccuucaucacgcccaugcuccgccauucuaucgaaaauagcuccgugaacguuucucugaccgccauugcgaaucaggccacagugcugaugggccucgggaagggauggccucuuagcaaaauggacaucggcgucccccugcuggcuauuggguguuacucccaggugaacccuaucacccucacagccgcucugcuucugcucgucgcccacuaugcuauuaucggacccggccugcaggccaaggcgaccagagaggcccaaaaacgggcugccgcuggcauuaugaagaauccuacgguggacgggaugacaguuaucgaucuggacccgauccccuacgauccuaaauuugaaaagcagcucggacaggugaugcuucugguccugugcgugacccagguucucaugaugcgcacaaccugggcccugugugaggcccuuacccuggcgacaggccccauuagcacgcucugggaagggaacccuggaagauucuggaauaccacaaucgcugugucuauggccaacauuuuucggggcuccuaucuggcuggggccggacuccuguucagcaucaugaagaacaccgccaauacacgcagaggcaccggcaacacgggggagacacuuggagagaaauggaagaaucggcugaacgcucugggcaaaucugaauuucaaauuuacaagaaauccgggauccaggaggucgaccgcacccucgccaaggaaggaaucaaaagaggcgagaccgaucaucacgcggugagccgggggucugccaagcugagaugguucguggagcgcaaucuuguuacacccgaaggaaaggucguggaccugggcugcggcagagggggauggagcuauuacuguggcgggcucaaaaacgugaaggaggucaaaggacugaccaagggcgggccgggacaugaagaaccuauucccauguccacauauggcuggaaucugguuagacuccagucuggcguggauguguucuuuacgcccccugaaaaaugcgacacccuucugugugauaucggggagagcucccccaacccuacagucgaggcuggacgcacccugcgggugcucaaucugguugacaacuggcuuaauaacaauacacaauucugcauuaaggugcugaacccguacaugcccagcgucaucgaaaagauggaggcccuccagagaaaauacggcggggcucuggugcgcaauccucugucccggaacucuacccacgaaauguauuggguuagcaacgccuccggaaauauugugucuagcgucaacaugaucuccagaaugcucaucaaucgcuuuacgaugcggcacaagaaagcgaccuacgagcccgauguggaccuuggcucugggacaagaaacauuggaaucgaaagcgagaccccuaaucuggauauuaucggcaagcgcauugagaaaaucaagcaggaacaugagacauccuggcacuaugaccaggaccaucccuacaagaccugggccuaucacggcagcuacgaaacaaaacaaaccgggucugcuuccagcauggugaacggagucguucggcugcucacgaagccgugggaugugaucccuauggugacacagauggccaugaccgacaccacacccuucggccagcagagagucuuuaaagagaagguggauacgcgcacccaagaaccuaaagaggggacaaagaagcugaugaaaauuaccgcugaguggcuuuggaaggaacugggcaagaagaaaacacccagaauguguacccgggaggaguucacacgcaagguuagaucuaaugccgcucucggcgccaucuuuaccgacgagaacaaauggaaguccgcgcgggaggccguggaagauagcggguucugggagcuggucgacaaggaaagaaaucugcaccucgagggaaaaugcgaaacguguguguauaacaugaugggcaagcgggagaaaaagcugggcgaguuugggaaagcuaagggaucucgcgccauuugguacauguggcuuggcgcuagauuccuggaauuugaggcccucggguuccugaaugaagaucauugguuuucccgggagaacagccuuuccggaguugaaggcgaggggcugcacaagcucggcuacauccugcgcgacgugagcaaaaaggagggaggcgccauguaugcggaugacaccgcugggugggauacaagaauuacccuggaagaccucaaaaaugaggaaauggucacaaaccauauggagggagaacacaagaaacuggccgaggccaucuucaaacuuaccuaccagaauaaggugguucgggugcagcgcccuacgcccagaggcacagucauggacauuaucucucggcgcgaucagagagggagcggacaaguggucaccuauggccugaacacauucaccaacauggaggcucagcucauccggcagauggaaggggagggcguguuuaaauccauucaacagcugacgguuaaggaagagaucgccgugaaaaauuggcuuauucgcgucggaagagagcggcugucucgcauggcuaucagcggcgacgauugcguggugaagccgcucgacgauagauucgccuccgcgcugaccgcccugaacgacauggggaaaguucggaaggauauucagcagugggaaccuucuagaggauggaaugacuggacacaagugcccuuuugcagccaucacuuccacgagcucaucaugaaggauggccgcguccuggugguucccugucggaaccaggacgaacuuaucgggagagcucgcauuucccagggagccggcuggucucugcgggagaccgcuugccucgggaaaagcuacgcccagauguggaaucugauguauuuucauagacgcgaucuucggcuggcggccaacgcuaucuguuccgccgugccuagccacuggauuccgacaucuagaaccacaugguccauccaugcuacccacgaauggaugacgacagaggacaugcucaccgucuggaaucgcguguggauucaagagaaccccuggauggaagauaagaccccugucgagagcugggaagagauccccuaccugggcaaacgggaagaccaguggugcggaucucugaucggccucacauccagagccaccugggcuaagaauauucagacagccaucaaccaggugcgcagccugauugggaaugaggaguauacggacuacaugccuuccaugaaacgguucagacgggaagaggaagaggcgggaguucuuugguga

SEQ ID NO: 19611 - RNA, 9876 nt, Artificial Sequence
  derived and/or modified CDS sequence (opt5) from DENV-2__KM279525__SS-prME
accgccggaaucauuaucaugaugauucccaccgugauggcuuuccaccugacgaccagaaacggggaaccucauaugaucgucagccggcaggaaaagggaaaaucccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucauccuuauuacggggaacauguccuucagagaccugggacgcgugaugguuauggugggcgccaccaugacagaugacaucggcaugggggucaccuaccucgcccugcuggcugccuuuaaggugagacccacauucgcggcuggacuucugcuccggaaacugaccucuaaggagcucaugaugacgacaaucggcauugugcugcuuagccaauccaccaucccugagaauauucuggaacucacagaugcccuggcccuggggaugaugguccuuaaaaucguucgcaacauggagaaguaucagcuggcugugaccauuauggccauccucugcgugcccaaugcggucauccugcagaacgcuuggaaagugucuuguaccacacucgccguugugagcgucuccccucugcuucugacgagcucucaacagaaggccgacuggauuccccucgcucugaccaucaagggacugaauccuacagccauuuuucuuaccacacuguccagaaccagcaaaaagcggucuuggccccucaacgaagcuaucauggccgugggcaugguuuccauucuggcgagcucucuccugaaaaaugauaucccgaugacggggccucuuguggccggaggccugcugacagucugcuacgugcucaccggccgcuccgcugaccuggagcuugaaagagccgcugacguccggugggaggagcaggccgaaaucagcggguccagccccauucugucuaucaccauuagcgaggauggauccaugucuaucaagaacgaagaggaggaacagacacucaccauucugauccgcacaggccuccuggugauuagcgggcuuuucccuguuuccauccccaucacggccgcugcgugguaucugugggaggugaaaaagcaaagagccggaguccugugggacgugccgucuccucccccuguuggcaaagcugaacucgaggauggggccuaccggauuaagcagaagggaauccugggcuauagccagauuggcgccgggguguacaaagaaggaaccuuucacacaauguggcaugucacccgcggcgcugugcuuaugcacaaggggaaaagaaucgagcccuccugggccgacgugaagaaagaucugauuucuuacggaggcggguggaagcucgagggagaauggaaggagggcgaagagguucagguccuggcgcucgaacccggcaaaaacccucgggcugugcaaacaaagccggggcuguucaaaaccaauacgggaaccaucggcgccgugagccuugacuuuucccccgggacaagcggaucuccuaucgucgauaagaaaggcaaggugguugggcuguauggaaacggcguggucaccagauccggcacauacgugagcgccauugcucagaccgagaagucuaucgaggacaaucccgaaauugaggaugacaucuuccgcaaaaagcggcugacaauuauggaucuccauccuggggccggaaaaacgaagagauaucugcccgcgaucguucgcgaagcuaucaaacggggccuuagaacccugauucucgccccuacacgcguggucgccgcugagauggaagaggcccugcgggggcucccgaucagauaccagacccccgcuauucgcgccgagcacaccggacgggaaaucguggaccugaugugucaugcgacauucacgaugagacuucuguccccuauucggguucccaacuauaaucugaucauuauggaugaggcccacuuuaccgacccugcuagcaucgccgcucgcggcuacaucuccacaagaguggaaaugggggaggccgccggcauuuucaugaccgcuacacccccgggaucucgggacccuuuuccccagagcaacgcgcccaucauggaugaggaacgcgagauuccugaaagauccuggaauagcggccacgagugggucaccgacuucaaggggaagacggugugguuugugcccucuaucaaagccggaaacgauauugcugccugccuccggaagaauggcaaaaaggucauccaacuguccagaaaaacauucgacagcgaauauaucaagacccgcaccaacgauugggacuuuguugugacaaccgauauuucugagaugggggccaauuucaaggcugagcgggugaucgacccuagacgcuguaugaaaccggucauucuuacagauggagaggaacgggugauccuggccggccccaugccuguuacccauagcuccgcggcucagagacgcgggcgggugggcagaaaccccaagaaugaaaacgaccaguacauuuacaugggagagccucucgaaaaugaugaggacugcgcccacuggaaagaggccaagaugcugcuggacaacaucaacacgcccgaaggcaucauuccgucuauguuugagccugaacgcgagaaagucgaugcuaucgacggggaauauagacuccggggagaggcccgcaagacauucguggaucuuaugagacggggcgaccugcccguuuggcuggcguaccgcguggccgcugaggggauuaauuaugccgauagacggugguguuuugacggagucaaaaacaaucaaauccucgaagagaacguggaagucgagauuuggaccaaggagggcgaaagaaagaaacugaagccucgcuggcuugaugcucggaucuacagcgacccccuggcccucaaagaguucaaggaguucgcugccgggagaaaaucccugacacugaaucucauuaccgagaugggccgccuuccuacguuuaugacccagaaggcgaagaacgcccuggauaaucuggcugugcuccauacagccgaagcuggaggccgggccuauaaccacgcccugucugagcuucccgagacccuggaaacacuccugcugcucacccuucuggcuacaguuaccgggggaaucuuccuguuucucaugagcggcaaagggaucggaaagaugacgcugggcaugugcugcauuaucacagcguccauucuucugugguacgcccagauccagccgcacuggauugcugccagcaucauccucgaguucuuucugauugugcugcucaucccugaacccgagaaacaaagaacaccccaggacaaucagcuuaccuauguggucauugccauccugacaguuguggcugccaccauggcgaacgaaaugggcuuccuggagaagaccaagaaggauuuugggcucggaucuauuacgacccagcaaccugaguccaauauccuggacaucgaucuucggccggccagcgcuuggacacuguacgccguggcuaccacauucauuacccccaugcuccgccauuccaucgaaaacucuagcgucaaugugucccugacggccauugcgaaccaggccaccguucugaugggccucgggaagggauggccucuuucuaaaauggacaucggcgugccccugcuggcuauuggguguuacagccaggucaauccuaucacacucaccgccgcucugcuucugcucguggcccacuaugcuauuaucggacccggccugcaggccaaggcgacaagagaggcccaaaaacgggcugccgcuggcaucaugaagaacccuaccgucgacgggaugacggugauugaucuggacccgauccccuacgauccuaaauuugaaaagcagcucggacagguuaugcuucuggugcugugcgucacacaggugcucaugaugcgcaccacaugggcccugugugaggcccuuacccuggcgaccggccccauuuccacacucugggaagggaauccuggaagauucuggaacacgaccaucgcuguuagcauggccaacauuuuucggggcucuuaucuggcuggggccggacuccuguucuccaucaugaagaauacagccaacacccgcagaggcacaggcaauaccggggagacgcuuggagagaaauggaagaaccggcugaaugcucugggcaaaagcgaauuucaaaucuacaagaaaucugggauucaggagguggaccgcacacucgccaaggaaggaaucaaaagaggcgagaccgaucaucacgcggucucccgggggagcgccaagcugagaugguucguggagcgcaaccuugugacccccgaaggaaagguugucgaccugggcugcggcagagggggauggucuuauuacuguggcgggcucaaaaaugugaaggaggugaaaggacugacaaagggcgggccgggacaugaagaaccuauucccaugagcaccuauggcuggaaccuggucagacuccaguccggcguugauguguucuuuacacccccugaaaaaugcgacacgcuucugugugauaucggggagucuagccccaauccuaccguggaggcuggacgcacacugcggguccucaaccugguggaaaauuggcuuaacaauaacacccaauucugcauuaagguucugaauccguacaugcccuccgugaucgagaagauggaagcccuccagagaaaauacggcggggcucugguccgcaacccucugagccggaacuccacacacgagauguauugggugucuaaugccagcggaaacaucguuuccucugugaauaugauuagcagaaugcucaucaaccgcuuuaccaugcggcacaagaaagcgacguacgaacccgacgucgaucuuggcuccgggaccagaaauauuggaaucgagucugagacaccuaaccuggacauuaucggcaagcgcaucgagaaaauuaagcaggagcaugaaaccagcuggcacuaugaucaggaccaucccuacaagacaugggccuaucacggcuccuacgagaccaaacaaacagggagcgcuucuuccauggugaauggagugguccggcugcucaccaagccgugggacguuaucccuauggugacgcagauggccaugacagauaccacccccuucggccagcagagaguguuuaaagaaaaggucgacacacgcacgcaagagccuaaagaggggaccaagaagcugaugaaaauuacagcugaauggcuuuggaaggagcugggcaaaaagaaaacccccagaauguguacacgggaagaguucacccgcaaggugagaagcaacgccgcucucggcgccaucuuuacagaugagaauaaauggaagucugcgcgggaagccguugaggacuccggguucugggaacugguggauaaggagagaaaccugcaccucgaaggaaaaugcgagaccugugucuauaauaugaugggcaagcgggagaaaaagcugggcgaauuugggaaagcuaagggaagccgcgccauuugguacauguggcuuggcgcuagauuccuggaguuugaagcccucggguuccugaacgaggaccauugguuuucucgggaaaauucccuuagcggaguggagggcgaggggcugcacaagcucggcuacauccugcgcgauguuuccaaaaaggaaggaggcgccauguaugcggacgauacggcugggugggacaccagaauuacacuggaggaucucaaaaacgaagagauggugaccaaucauauggaaggagagcacaagaaacuggccgaggccaucuucaaacuuacauaccagaacaaggucgugcggguucagcgcccuacccccagaggcacggugauggacaucauuagccggcgcgaccagagagggucuggacaagucgugacauauggccugaacaccuucacaaauauggaagcucagcucauccggcagauggagggggaaggcgucuuuaaaagcauucaacagcugaccgugaaggaggagaucgccguuaaaaacuggcuuauucgcgugggaagagaacggcugucccgcauggcuaucucuggcgaugacugcgucgugaagccgcucgaugacagauucgccagcgcgcugacggcccugaaugauauggggaaagugcggaaggacauccagcagugggagccuuccagaggauggaacgauuggacccaaguucccuuuugcucucaucacuuccacgaacucauuaugaaggacggccgcgugcuggucgugcccugucggaaucaggaugagcuuaucgggagagcucgcauuagccagggagccggcuggucccugcgggaaacagcuugccucgggaaaucuuacgcccagauguggagccugauguauuuucauagacgcgaccuucggcuggcggccaacgcuaucuguuccgccguuccuagccacuggauuccgaccucuagaacaaccugguccauccaugcuacacacgaguggaugaccacggaggauaugcucacaguguggaaucgcgucuggauccaagaaaaccccuggauggaggacaagaccccuguggaaagcugggaggaaauucccuaccugggcaaacgggaggaucaguggugcggaucucugaucggccucaccuccagagccacaugggcuaagaauauucagaccgccaucaaccagguccgcagccugauugggaaugaggaauauacagacuacaugccuuccaugaaacgguucagacgggaggaagaggaagcgggagugcuuugguga

SEQ ID NO: 19612 - RNA, 9876 nt, Artificial Sequence
  derived and/or modified CDS sequence (opt5) from DENV-2__KM279528__SS-prME
accgccggaaucauuaucaugaugauucccaccgugauggcuuuccaccugacgaccagaaacggggaaccucauaugaucgucagccggcaggaaaagggaaaaucccuccuguuuaagaccgaaaauggcguuaacaugugcacccuuauggccauggaccugggggaacucugugaagauaccauuaccuacaauugcccgcugcuuagacaaaacgaacccgaagacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccuaaaucuauccuggagcucaccgaugcccuggcccuggggaugaugguccuuaagauuguucgcaauauggaaaaauaucagcuggcugugaccaucauggccauucucugcgugcccaacgcggucauccugcagaaugcuuggaaggugagcuguacaacgcucgccguuguguccgucagcccucugcuucugaccucuucccaacagaaggccgacuggaucccccucgcucugacaauuaaaggacugaacccuaccgccaucuuucuuacaacccugagcagaacgucuaagaaacgguccuggccccucaaugaggcuauuauggccgugggcaugguuagcauccuggcgucuucccuccugaagaacgauauuccgaugacagggccucuuguggccggaggccugcugaccgucugcuacgugcucaccggccgcagcgcugaccuggaacuugagagagccgcugacguccggugggaagaacaggccgagaucuccgggagcucucccauccugagcauuacaaucuccgaagauggaucuaugagcauuaaaaaugaggaagaggagcagacccucacaauccugauucgcacgggccuccuggugaucuccgggcuuuucccuguuucuauucccaucaccgccgcugcgugguaucugugggaagugaagaaacaaagagccggaguccugugggacgugccgagcccucccccuguuggcaaggcugagcucgaagauggggccuaccggaucaagcagaaaggcauucugggcuauucccagaucggcgccgggguguacaaggagggaacauuucacaccauguggcaugucacacgcggcgcugugcuuaugcacaaagggaagagaauugaacccucuugggccgacgugaaaaaggaucugaucagcuacggaggcggguggaagcucgagggagaguggaaagaaggcgaggaaguucagguccuggcgcucgagcccggcaagaacccucgggcugugcaaaccaaaccggggcuguucaagacgaacaccggaacaauuggcgccgugucccuugacuuuagccccgggaccucuggauccccuaucgucgauaaaaagggcaaggugguugggcuguauggaaauggcguggucacaagaagcggcaccuacgugucugccaucgcucagacagaaaaauccauugaggacaaccccgagaucgaagaugacauuuuccgcaagaaacggcugacgaucauggaucuccauccuggggccggaaagaccaaaagauaucugcccgcgauuguucgcgaggcuaucaagcggggccuuagaacacugauccucgccccuacccgcguggucgccgcugaaauggaggaagcccugcgggggcucccgauuagauaccagacccccgcuauccgcgccgagcacacaggacgggagauuguggaccugaugugucaugcgacguucaccaugagacuucugagcccuauccggguucccaauuauaaccugauuaucauggaugaagcccacuuuacagacccugcuuccauugccgcucgcggcuacaucucuaccagaguggagaugggggaagccgccggcaucuucaugacagcuacacccccgggaagccgggacccuuuuccccaguccaaugcgcccauuauggaugaggagcgcgaaaucccugagagaagcuggaacucuggccacgaaugggucacggacuucaaggggaaaacagugugguuugugcccuccauuaaggccggaaaugauaucgcugccugccuccggaaaaacggcaagaaagucauucaacugagcagaaagaccuucgacucugaguauaucaagacccgcacaaaugauugggacuuuguugugaccacagauaucagcgaaaugggggccaacuucaaagcugagcgggugauugacccuagacgcuguaugaagccggucauccuuaccgauggagaggaacgggugauucuggccggccccaugccuguuacgcauuccucugcggcucagagacgcgggcgggugggcagaaaucccaaaaacgagaaugaccaguacaucuacaugggagaaccucucgagaacgaugaagacugcgcccacuggaaggaggccaaaaugcugcuggacaauauuaacacacccgagggcaucaucccgagcauguuugaaccugagcgcgaaaaggucgaugcuauugacggggaguauagacuccggggagaagcccgcaaaaccuucguggaucuuaugagacggggcgaccugcccguuuggcuggcguaccgcguggccgcugaggggaucaacuaugccgauagacggugguguuuugacggagucaagaauaaccaaauucucgaggaaaauguggaggucgaaaucuggacaaaggagggcgagcgcaagaagcugaaaccucgcuggcuugaugcucggauuuacuccgacccccuggcccucaaggaguucaaagaguucgcugccgggagaaagucucugacccugaaccucaucacggaaaugggccgccuuccuaccuuuaugacacagaaggcgaaaaaugcccuggauaaccuggcugugcuccauaccgccgaggcuggaggccgggccuauaaucacgcccugagcgaacuucccgagacacuggagacccuccugcugcucacacuucuggcuaccguuacagggggaauuuuccuguuucucauguccggcaaggggaucggaaaaaugacacugggcaugugcugcaucauuaccgcgagcauccuucugugguacgcccagauucagccgcacuggaucgcugccucuauuauccucgaguucuuucugaucgugcugcucauuccugagcccgaaaagcaaagaacaccccaggacaaccagcuuacauauguggucaucgccauucugaccguuguggcugccacaauggcgaaugagaugggcuuccuggagaaaacgaagaaggauuuugggcucggauccaucaccacacagcaaccugagagcaacauucuggacaucgaucuucggccggccuccgcuuggacccuguacgccguggcuacaaccuucaucacgcccaugcuccgccauucuauugagaauagcuccgucaacgugucucugaccgccaucgcgaaucaggccacaguucugaugggccucgggaaaggauggccucuuagcaagauggacauuggcgugccccugcuggcuaucggguguuacucccaggucaacccuauuacccucacagccgcucugcuucugcucguggcccacuaugcuaucauuggacccggccugcaggccaaagcgaccagagaagcccaaaagcgggcugccgcuggcaucaugaaaaauccuacggucgacgggaugacagugaucgaucuggacccgauucccuacgauccuaaguuugagaagcagcucggacagguuaugcuucuggugcugugcgucacccaggugcucaugaugcgcacaaccugggcccugugugaagcccuuacccuggcgacaggccccaucagcacgcucugggaggggaacccuggaagauucuggaauaccacaauugcuguuucuauggccaacaucuuucggggcuccuaucuggcuggggccggacuccuguucagcauuaugaaaaacaccgccaauacacgcagaggcaccggcaacacgggggaaacacuuggagagaaguggaaaaaucggcugaacgcucugggcaagucugaguuucaaaucuacaaaaaguccgggauccaggaaguggaccgcacccucgccaaagagggaauuaagagaggcgaaaccgaucaucacgcggucagccgggggucugccaagcugagaugguucguggagcgcaaucuugugacacccgagggaaaaguugucgaccugggcugcggcagagggggauggagcuauuacuguggcgggcucaagaacgugaaagaagugaagggacugaccaaaggcgggccgggacaugaggaaccuauccccauguccacauauggcuggaaucuggucagacuccagucuggcguugauguguucuuuacgcccccugagaagugcgacacccuucugugugauauuggggaaagcucccccaacccuacaguggaggcuggacgcacccugcggguccucaaucugguggagaacuggcuuaauaacaauacacaauucugcaucaagguucugaacccguacaugcccagcgugauugagaaaauggaggcccuccagagaaaguacggcggggcucugguccgcaauccucugucccggaacucuacccacgaaauguauugggugagcaacgccuccggaaauaucguuucuagcgugaacaugaucuccagaaugcucauuaaucgcuuuacgaugcggcacaaaaaggcgaccuacgagcccgacgucgaucuuggcucugggacaagaaacaucggaauugaaagcgagaccccuaaucuggacaucauuggcaaacgcaucgagaagaucaagcaggaacaugagacauccuggcacuaugaucaggaccaucccuacaaaaccugggccuaucacggcagcuacgaaacaaagcaaaccgggucugcuuccagcauggugaacggagugguccggcugcucacgaaaccgugggacguuauuccuauggugacacagauggccaugaccgauaccacacccuucggccagcagagaguguuuaaggagaaagucgacacgcgcacccaagaaccuaaggaggggacaaagaaacugaugaagaucaccgcugaguggcuuuggaaagaacugggaaagaaaaagacacccagaauguguacccgggaggaguucacacgcaaagugagaucuaaugccgcucucggcgccauuuuuaccgaugagaacaaguggaaguccgcgcgggaggccguugaagacagcggguucugggagcugguggauaaagaaagaaaucugcaccucgagggaaagugcgaaacgugugucuauaacaugaugggcaaacgggagaagaaacugggcgaguuugggaaggcuaagggaucucgcgccaucugguacauguggcuuggcgcuagauuccuggaauuugaggcccucggguuccugaaugaagaccauugguuuucccgggagaacagccuuuccggaguggaaggcgaggggcugcacaaacucggcuacauucugcgcgauguuagcaagaaagagggaggcgccauguaugcggacgauaccgcugggugggacacaagaaucacccuggaagaucucaagaaugaggaaauggugacaaaccauauggagggagaacacaaaaagcuggccgaggccauuuucaaacuuaccuaccagaauaaagucgugcggguucagcgcccuacgcccagaggcacagugauggacaucaucucucggcgcgaccagagagggagcggacaagucgugaccuauggccugaacacauucaccaacauggaggcucagcucauucggcagauggaaggggagggcgucuuuaaguccauccaacagcugacggugaaagaagagauugccguuaagaauuggcuuauccgcgugggaagagagcggcugucucgcauggcuauuagcggcgaugacugcgucgugaaaccgcucgaugacagauucgccuccgcgcugaccgcccugaacgauauggggaaggugcggaaggacauccagcagugggaaccuucuagaggauggaaugauuggacacaaguucccuuuugcagccaucacuuccacgagcucaucaugaaagacggccgcgugcuggucgugcccugucggaaccaggaugaacuuauugggagagcucgcaucucccagggagccggcuggucucugcgggagaccgcuugccucggaaagagcuacgcccagauguggucccugauguauuuucauagacgcgaccuucggcuggcggccaaugcuauuuguagcgccguuccuucucacuggaucccgacauccagaaccacauggagcauucaugcuacccacgaauggaugacgacagaggauaugcucaccguguggaaccgcgucuggauccaagagaaucccuggauggaagacaaaaccccuguggagucuugggaagagauccccuaccugggcaagcgggaagaucaguggugcggaucccugauuggccucacaagcagagccaccugggcuaaaaacauccagacagccauuaaucagguccgcucccugaucgggaacgaggaguauacggacuacaugccuucuaugaagcgguucagacgggaagaggaagaggcgggagugcuuugguga

SEQ ID NO: 19613 - RNA, 9876 nt, Artificial Sequence
  derived and/or modified CDS sequence (opt5) from DENV-2__KM279533__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauucucugcgugcccaacgcggucauccugcagaaugcuuggaaagugagcuguacaacgcucgccguuguguccgucagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcaaagagccggaguccugugggacgugccgagcccucccccuguuggcaaagcugaacucgaggauggggccuaccggaucaagcagaagggcauucugggcuauucccagaucggcgccgggguguacaaagaaggaacauuucacaccauguggcaugucacacgcggcgcugugcuuaugcacaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcaaaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucagacagagaaguccauugaggacaaccccgaaaucgaggaugacauuuuccgcaaaaagcggcugacgaucauggaucuccauccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaauuauaaccugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaaugcgcccauuauggaugaggaacgcgagaucccugaaagaagcuggaacucuggccacgagugggucacggacuucaaggggaagacagugugguuugugcccuccauuaaagccggaaaugauaucgcugccugccuccggaagaacggcaaaaaggucauucaacugagcagaaaaaccuucgacucugaauauaucaagacccgcacaaaugauugggacuuuguugugaccacagauaucagcgagaugggggccaacuucaaggcugagcgggugauugacccuagacgcuguaugaaaccggucauccuuaccgauggagaggaacgggugauucuggccggccccaugccuguuacgcauuccucugcggcucagagacgcgggcgggugggcagaaaucccaagaacgaaaaugaccaguacaucuacaugggagagccucucgaaaacgaugaggacugcgcccacuggaaagaggccaagaugcugcuggacaauauuaacacacccgaaggcaucaucccgagcauguuugagccugaacgcgagaaagucgaugcuauugacggggaauauagacuccggggagaggcccgcaagaccuucguggaucuuaugagacggggcgaccugcccguuuggcuggcguaccgcguggccgcugaggggaucaacuaugccgauagacggugguguuuugacggagucaaaaauaaccaaauucucgaagagaauguggaagucgagaucuggacaaaggagggcgaaagaaagaaacugaagccucgcuggcuugaugcucggauuuacuccgacccccuggcccucaaagaguucaaggaguucgcugccgggagaaaaucucugacccugaaccucaucacggagaugggccgccuuccuaccuuuaugacacagaaggcgaagaaugcccuggauaaccuggcugugcuccauaccgccgaagcuggaggccgggccuauaaucacgcccugagcgagcuucccgagacacuggaaacccuccugcugcucacacuucuggcuaccguuacagggggaauuuuccuguuucucauguccggcaaagggaucggaaagaugacacugggcaugugcugcaucauuaccgcgagcauccuucugugguacgcccagauucagccgcacuggaucgcugccucuauuauccucgaguucuuucugaucgugcugcucauuccugaacccgagaaacaaagaacaccccaggacaaccagcuuacauauguggucaucgccauucugaccguuguggcugccacaauggcgaaugaaaugggcuuccuggagaagacgaaaaaggauuuugggcucggauccaucaccacacagcaaccugagagcaacauucuggacaucgaucuucggccggccuccgcuuggacccuguacgccguggcuacaaccuucaucacgcccaugcuccgccauucuauugaaaauagcuccgucaacgugucucugaccgccaucgcgaaucaggccacaguucugaugggccucgggaagggauggccucuuagcaaaauggacauuggcgugccccugcuggcuaucggguguuacucccaggucaacccuauuacccucacagccgcucugcuucugcucguggcccacuaugcuaucauuggacccggccugcaggccaaggcgaccagagaggcccaaaaacgggcugccgcuggcaucaugaagaauccuacggucgacgggaugacagugaucgaucuggacccgauucccuacgauccuaaauuugaaaagcagcucggacagguuaugcuucuggugcugugcgucacccaggugcucaugaugcgcacaaccugggcccugugugaggcccuuacccuggcgacaggccccaucagcacgcucugggaagggaacccuggaagauucuggaauaccacaauugcuguuucuauggccaacaucuuucggggcuccuaucuggcuggggccggacuccuguucagcauuaugaagaacaccgccaauacacgcagaggcaccggcaacacgggggagacacuuggagagaaauggaagaaucggcugaacgcucugggcaaaucugaauuucaaaucuacaagaaauccgggauccaggagguggaccgcacccucgccaaggaaggaauuaaaagaggcgagaccgaucaucacgcggucagccgggggucugccaagcugagaugguucguggagcgcaaucuugugacacccgaaggaaagguugucgaccugggcugcggcagagggggauggagcuauuacuguggcgggcucaaaaacgugaaggaggugaaaggacugaccaagggcgggccgggacaugaagaaccuauccccauguccacauauggcuggaaucuggucagacuccagucuggcguugauguguucuuuacgcccccugaaaaaugcgacacccuucugugugauauuggggagagcucccccaacccuacaguggaggcuggacgcacccugcggguccucaaucugguggaaaacuggcuuaauaacaauacacaauucugcaucaagguucugaacccguacaugcccagcgugauugagaagauggaagcccuccagagaaaauacggcggggcucugguccgcaauccucugucccggaacucuacccacgagauguauugggugagcaacgccuccggaaauaucguuucuagcgugaacaugaucuccagaaugcucauuaaucgcuuuacgaugcggcacaagaaagcgaccuacgaacccgacgucgaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggccuaucacggcagcuacgagacaaaacaaaccgggucugcuuccagcauggugaacggagugguccggcugcucacgaagccgugggacguuauuccuauggugacacagauggccaugaccgauaccacacccuucggccagcagagaguguuuaaagaaaaggucgacacgcgcacccaagagccuaaagaggggacaaagaagcugaugaaaaucaccgcugaauggcuuuggaaggagcugggcaaaaagaaaacacccagaauguguacccgggaagaguucacacgcaaggugagaucuaaugccgcucucggcgccauuuuuaccgaugagaacaaauggaaguccgcgcgggaagccguugaggacagcggguucugggaacugguggauaaggagagaaaucugcaccucgaaggaaaaugcgagacgugugucuauaacaugaugggcaagcgggagaaaaagcugggcgaauuugggaaagcuaagggaucucgcgccaucugguacauguggcuuggcgcuagauuccuggaguuugaagcccucggguuccugaaugaggaccauugguuuucccgggaaaacagccuuuccggaguggagggcgaggggcugcacaagcucggcuacauucugcgcgauguuagcaaaaaggaaggaggcgccauguaugcggacgauaccgcugggugggacacaagaaucacccuggaggaucucaaaaaugaagagauggugacaaaccauauggaaggagagcacaagaaacuggccgaggccauuuucaaacuuaccuaccagaauaaggucgugcggguucagcgcccuacgcccagaggcacagugauggacaucaucucucggcgcgaccagagagggagcggacaagucgugaccuauggccugaacacauucaccaacauggaagcucagcucauucggcagauggagggggaaggcgucuuuaaauccauccaacagcugacggugaaggaggagauugccguuaaaaauuggcuuauccgcgugggaagagaacggcugucucgcauggcuauuagcggcgaugacugcgucgugaagccgcucgaugacagauucgccuccgcgcugaccgcccugaacgauauggggaaagugcggaaggacauccagcagugggagccuucuagaggauggaaugauuggacacaaguucccuuuugcagccaucacuuccacgaacucaucaugaaggacggccgcgugcuggucgugcccugucggaaccaggaugagcuuauugggagagcucgcaucucccagggagccggcuggucucugcgggaaaccgcuugccucgggaaaagcuacgcccagauguggucccugauguauuuucauagacgcgaccuucggcuggcggccaaugcuauuuguagcgccguuccuucucacuggaucccgacauccagaaccacauggagcauucaugcuacccacgaguggaugacgacagagaacaugcucaccguguggaaucgcgucuggauccaagaaaaccccuggauggaggauaagaccccuguggaaucuugggaggaaauccccuaccugggcaaacgggaggaccaguggugcggaucccugauuggccucacaagcagagccaccugggcuaagaauauccagacagccauuaaccagguccgcucccugaucgggaaugaggaauauacggauuacaugccuucuaugaaacgguucagacgggaggaagaggaagcgggagugcuuugguga

SEQ ID NO: 19614 - RNA, 9876 nt, Artificial Sequence
  derived and/or modified CDS sequence (opt5) from DENV-2__KM279535__SS-prME
accgccggaaucauuaucaugaugauucccaccgugauggcuuuccaccugacgaccagaaacggggagccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauuagcugcgugcccaacgcggucauccuccagaaugcuuggaaaguguccuguacaacgcuggccguugugagcgucucuccucuccugcuuaccuccagccaacagaaggccgacuggaucccccuggcucucacaauuaagggacugaacccuaccgccaucuuucugacaacccuuucuagaacguccaaaaagcggagcuggccccugaaugaagcuauuauggccgugggcaugguuucuauccucgcguccagccugcucaaaaacgauauuccgaugacagggccucugguggccggaggccuucugaccgucugcuacgugcugaccggccgcuccgcugaccucgagcuggaaagagccgcugacguccggugggaggagcaggccgaaaucagcgggucuagccccauccuuuccauuacaaucucugaggauggaagcauguccauuaagaaugaagaggaggaacagacccugacaauccucauucgcacgggccugcucgugaucucugggcuguucccuguuagcauucccaucaccgccgcugcgugguaucuuugggaggugaaaaagcaaagagccggaguccugugggacgugccguccccucccccuguuggcaaagcugaacuggaggauggggccuaccggaucaagcagaagggcauucucggcuauucucagaucggcgccgggguguacaaagaaggaacauuucacaccauguggcaugucacacgcggcgcugugcugaugcacaaggggaaaagaauugagcccagcugggccgacgugaagaaagaucuuaucuccuacggaggcggguggaagcuggagggagaauggaaggagggcgaagagguucagguccucgcgcuggaacccggcaaaaacccucgggcugugcaaaccaagccgggacucuucaaaacgaacaccggaacaauuggcgccgugagccuggacuuuucucccgggaccuccggaagcccuaucgucgauaagaaaggcaaggugguugggcuuuauggaaauggcguggucacaagaucuggcaccuacguguccgccaucgcucagacagaaaagagcauugaggacaaccccgaaaucgaggaugacauuuuccgcaaaaagcggcugacgaucauggaucugcauccuggggccggaaaaaccaagagauaucuccccgcgauuguucgcgaagcuaucaaacggggccugagaacacuuauccuggccccuacccgcguggucgccgcugagauggaagaggcccuccgggggcugccgauuagauaccagacccccgcuauccgcgccgagcacacaggacgggaaauuguggaccucaugugucaugcgacguucaccaugagacugcuuuccccuauccggguucccaauuauaaccugauuaucauggaugaggcccacuuuacagacccugcuucuauugccgcucgcggcuacaucagcaccagaguggaaaugggggaggccgccggcaucuucaugacagcuacacccccgggaucccgggacccuuuuccccagagcaaugcgcccauuauggaugaggaacgcgagaucccugaaagaucuuggaacuccggccacgagugggucacggacuucaaggggaagacagugugguuugugcccagcauuaaagccggaaaugauaucgcugccugccugcggaagaacggcaaaaaggucauucaacucucuagaaaaaccuucgacagcgaauauaucaagacccgcacaaaugauugggacuuuguugugaccacagauaucuccgagaugggggccaacuucaaggcugagcgggugauugacccuagacgcuguaugaaaccggucauccugaccgauggagaggaacgggugauucuugccggccccaugccuguuacgcauucuagcgcggcucagagacgcgggcgggugggcagaaaucccaagaacgaaaaugaccaguacaucuacaugggagagccucuggaaaacgaugaggacugcgcccacuggaaagaggccaagaugcuccuggacaauauuaacacacccgaaggcaucaucccguccauguuugagccugaacgcgagaaagucgaugcuauugacggggaauauagacugcggggagaggcccgcaagaccuucguggaucucaugagacggggcgaccuucccguuuggcuggcguaccgcguggccgcugaggggaucaacuaugccgauagacggugguguuuugacggagucaaaaauaaccaaauucuggaagagaauguggaagucgagaucuggacaaaggagggcgaaagaaagaaacucaagccucgcuggcuggaugcucggauuuacucugacccccuugcccugaaagaguucaaggaguucgcugccgggagaaaaagccucacccugaaccugaucacggagaugggccgccucccuaccuuuaugacacagaaggcgaagaaugcccuugauaaccuggcugugcugcauaccgccgaagcuggaggccgggccuauaaucacgcccucuccgagcugcccgagacacuugaaacccugcuccugcugacacuccuugcuaccguuacagggggaauuuuccuguuucugaugagcggcaaagggaucggaaagaugacacucggcaugugcugcaucauuaccgcgucuauccugcuuugguacgcccagauucagccgcacuggaucgcugccuccauuauccuggaguucuuucucaucgugcugcugauuccugaacccgagaaacaaagaacaccccaggacaaccagcucacauauguggucaucgccauucuuaccguuguggcugccacaauggcgaaugaaaugggcuuccuggagaagacgaaaaaggauuuugggcugggaagcaucaccacacagcaaccugaguccaacauucucgacaucgaucugcggccggccucugcuuggacccuuuacgccguggcuacaaccuucaucacgcccaugcugcgccauagcauugaaaauuccucugucaacgugagccucaccgccaucgcgaaucaggccacaguucugaugggccuggggaagggauggccucucuccaaaauggacauuggcgugccccuucuggcuaucggguguuacagccaggucaacccuauuacccugacagccgcucuccugcuucugguggcccacuaugcuaucauuggacccggccuccaggccaaggcgaccagagaggcccaaaaacgggcugccgcuggcaucaugaagaauccuacggucgacgggaugacagugaucgaucuggacccgauucccuacgauccuaaauuugaaaagcagcugggacagguuaugcuccuugugcugugcgucacccaggugcugaugaugcgcacaaccugggcccucugugaggcccugacccuugcgacaggccccaucucuacgcugugggaagggaacccuggaagauucuggaauaccacaauugcuguuuccauggccaacaucuuucggggcagcuaucucgcuggggccggacugcuguucucuauuaugaagaacaccgccaauacacgcagaggcaccggcaacacgggggagacacucggagagaaauggaagaaucggcuuaacgcucugggcaaauccgaauuucaaaucuacaagaaaagcgggauccaggagguggaccgcacccuggccaaggaaggaauuaaaagaggcgagaccgaucaucacgcggucucucgggggagcgccaagcucagaugguucguggagcgcaaucuggugacacccgaaggaaagguugucgaccuuggcugcggcagagggggaugguccuauuacuguggcgggcugaaaaacgugaaggaggugaaaggacucaccaagggcgggccgggacaugaagaaccuauccccaugucuacauauggcuggaaucuggucagacugcagagcggcguugauguguucuuuacgcccccugaaaaaugcgacacccuccuuugugauauuggggaguccagccccaacccuacaguggaggcuggacgcacccugcggguccugaaucucguggaaaacuggcugaauaacaauacacaauucugcaucaagguucuuaacccguacaugcccuccgugauugagaagauggaagcccugcagagaaaauacggcggggcucucguccgcaauccucugucucggaacagcacccacgagauguauuggguguccaacgccucuggaaauaucguuagcuccgugaacaugaucucuagaaugcugauuaaucgcuuuacgaugcggcacaagaaagcgaccuacgaacccgacgucgaucucggcagcgggacaagaaacaucggaauugaguccgagaccccuaaucuugacaucauuggcaagcgcaucgagaagaucaagcaggagcaugaaacaagcuggcacuaugaucaggaccaucccuacaagaccugggccuaucacggcucuuacgagacaaaacaaaccggguccgcuagcucuauggugaacggagugguccggcugcugacgaagccgugggacguuauuccuauggugacacagauggccaugaccgauaccacacccuucggccagcagagaguguuuaaagaaaaggucgacacgcgcacccaagagccuaaagaggggacaaagaagcucaugaaaaucaccgcugaauggcuguggaaggagcuuggcaaaaagaaaacacccagaauguguacccgggaagaguucacacgcaaggugagauccaaugccgcucugggcgccauuuuuaccgaugagaacaaauggaaaagcgcgcgggaagccguugaggacucuggguucugggaacucguggauaaggagagaaaucugcaccuggaaggaaaaugcgagacgugugucuauaacaugaugggcaagcgggagaaaaagcucggcgaauuugggaaagcuaagggaucccgcgccaucugguacauguggcugggcgcuagauuccuugaguuugaagcccugggguuccucaaugaggaccauugguuuagccgggaaaacucccugagcggaguggagggcgaggggcuucacaagcugggcuacauucuccgcgauguuucuaaaaaggaaggaggcgccauguaugcggacgauaccgcugggugggacacaagaaucacccuggaggaucugaaaaaugaagagauggugacaaaccauauggaaggagagcacaagaaacucgccgaggccauuuucaagcugaccuaccagaauaaggucgugcggguucagcgcccuacgcccagaggcacagugauggacaucaucagccggcgcgaccagagaggguccggacaagucgugaccuauggccuuaacacauucaccaacauggaagcucagcugauucggcagauggagggggaaggcgucuuuaaaucuauccaacagcucacggugaaggaggagauugccguuaaaaauuggcugauccgcgugggaagagaacggcuuagccgcauggcuauuuccggcgaugacugcgucgugaagccgcuggaugacagauucgccucugcgcucaccgcccugaacgauauggggaaagugcggaaggacauccagcagugggagccuagcagaggauggaaugauuggacacaaguucccuuuugcucccaucacuuccacgaacugaucaugaaggacggccgcgugcucgucgugcccugucggaaccaggaugagcugauugggagagcucgcaucucucagggagccggcuggagccuucgggaaaccgcuugccuggggaaauccuacgcccagauguggagccucauguauuuucauagacgcgaccugcggcuugcggccaaugcuauuuguucugccguuccuucccacuggaucccgacaagcagaaccacauggucuauucaugcuacccacgaguggaugacgacagaggauaugcugaccguguggaaccgcgucuggauccaagaaaaucccuggauggaggacaagaccccuguggaauccugggaggaaauccccuaccucggcaaacgggaggaucaguggugcggaagccugauuggccugacauccagagccaccugggcuaagaacauccagacagccauuaaucagguccgcucucucaucgggaacgaggaauauacggacuacaugccuagcaugaaacgguucagacgggaggaagaggaagcgggagugcugugguga

SEQ ID NO: 19615 - RNA, 9876 nt, Artificial Sequence
  derived and/or modified CDS sequence (opt5) from DENV-2__KM279539__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggcguuaacaugugcacccuuauggccauggaccugggggaacucugugaggauacgauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucggcgggguguuuaccucuaucgggaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauucucugcgugcccaacgcggucauccugcagaaugcuuggaaagugagcuguacaacgcucgccguuguguccgucagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcaaagagccggaguccugugggacgugccgagcccucccccuguuggcaaagcugaacucgaggauggggccuaccggaucaagcagaagggcauucugggcuauucccagaucggcgccgggguguacaaagaaggaacauuucacaccauguggcaugucacacgcggcgcugugcuuaugcacaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcaaaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucagacagaggaguccauugaagacaaccccgagaucgaagaugacauuuuccgcaagaaacggcugacgaucauggaucuccauccuggggccggaaagaccaaaagauaucugcccgcgauuguucgcgaggcuaucaagcggggccuuagaacacugauccucgccccuacccgcguggucgccgcugaaauggaggaggcccugcgggggcucccgauuagauaccagacccccgcuauccgcgccgaacacacaggacgggagauuguggaccugaugugucaugcgacguucaccaugagacuucugagcccuauccggguucccaauuauaaccugauuaucauggaugaagcccacuuuacagacccugcuuccauugccgcucgcggcuacaucucuaccagaguggagaugggggaggccgccggcaucuucaugacagcuacacccccgggaagccgggacccuuuuccccaguccaaugcgcccauuauggaugaagaacgcgaaaucccugagagaagcuggaacucuggccacgaaugggucacggacuucaaagggaagacagugugguuugugcccuccauuaaggccggaaaugauaucgcugccugccuccggaaaaacggcaagaaagucauucaacugagcagaaagaccuucgacucugaguauaucaaaacccgcacaaaugauugggacuuuguugugaccacagauaucagcgagaugggggccaacuucaaggcugaacgggugauugacccuagacgcuguaugaagccggucauccuuaccgauggagaggaacgggugauucuggccggccccaugccuguuacgcauuccucugcggcucagagacgcgggcgggugggcagaaaucccaaaaacgagaaugaccaguacaucuacaugggagaaccucucgagaacgaugaggacugcgcccacuggaaggaagccaaaaugcugcuggacaauauuaacacacccgagggcaucaucccgagcauguuugaaccugagcgcgaaaaggucgaugcuauugacggggaguauagacuccggggagaggcccgcaaaaccuucguggaucuuaugagacggggcgaccugcccguuuggcuggcguaccgcguggccgcugaagggaucaacuaugccgauagacggugguguuuugacggagucaagaauaaccaaauucucgaggaaaauguggaggucgagaucuggacaaaagaaggcgagagaaagaagcugaaaccucgcuggcuugaugcucggauuuacuccgacccccuggcccucaaggaguucaaagaguucgcugccgggagaaagucucugacccugaaccucaucacggaaaugggccgccuuccuaccuuuaugacacagaaagcgaagaaugcccuggauaaccuggcugugcuccauaccgccgaggcuggaggccgggccuauaaucacgcccugagcgagcuucccgaaacacuggagacccuccugcugcucacacuucuggcuaccguuacagggggaauuuuccuguuucucauguccggcaaggggaucggaaaaaugacacugggcaugugcugcaucauuaccgcgagcauccuucugugguacgcccagauucagccgcacuggaucgcugccucuauuauccucgaguucuuucugaucgugcugcucauuccugagcccgaaaagcaaagaacaccccaggacaaccagcuuacauauguggucaucgccauucugaccguuguggcugccacaauggcgaaugagaugggcuuccuggagaaaacgaagaaagauuuugggcucggauccaucaccacacagcaaccugaaagcaacauucuggacaucgaucuucggccggccuccgcuuggacccuguacgccguggcuacaaccuucaucacgcccaugcuccgccauucuauugagaauagcuccgucaacgugucucugaccgccaucgcgaaucaggccacaguucugaugggccucgggaagggauggccucuuagcaagauggacauuggcgugccccugcuggcuaucggguguuacucccaggucaacccuauuacccucacagccgcucugcuucugcucguggcccacuaugcuaucauuggacccggccugcaggccaaagcgaccagagaagcccaaaagcgggcugccgcuggcaucaugaaaaauccuacggucgacgggaugacagugaucgaucuggacccgauucccuacgauccuaaguuugagaaacagcucggacagguuaugcuucuggugcugugcgucacccaggugcucaugaugcgcacaaccugggcccugugugaagcccuuacccuggcgacaggccccaucagcacgcucugggaggggaacccuggaagauucuggaauaccacaauugcuguuucuauggccaacaucuuucggggcuccuaucuggcuggggccggacuccuguucagcauuaugaagaacaccgccaauacacgcagaggcaccggcaacacgggggagacacuuggagaaaaguggaaaaaucggcugaacgcucugggcaagucugaguuucaaaucuacaaaaaguccgggauccaggaaguggaccgcacccucgccaaagagggaauuaagagaggcgagaccgaucaucacgcggucagccgggggucugccaaacugagaugguucguggaacgcaaucuugugacacccgagggaaagguugucgaccugggcugcggcagagggggauggagcuauuacuguggcgggcucaagaacgugaaagaagugaagggacugaccaaaggcgggccgggacaugaggaaccuauccccauguccacauauggcuggaaucuggucagacuccagucuggcguugauguguucuuuacgcccccugagaagugcgacacccuucugugugauauuggggagagcucccccaacccuacaguggaagcuggacgcacccugcggguccucaaucugguggagaacuggcuuaauaacaauacacaauucugcaucaaaguucugaacccguacaugcccagcgugauugaaaagauggaggcccuccagagaaaguacggcggggcucugguccgcaauccucugucccggaacucuacccacgaaauguauugggugagcaacgccuccggaaauaucguuucuagcgugaacaugaucuccagaaugcucauuaaucgcuuuacgaugcggcacaaaaaggcgaccuacgagcccgacgucgaucuuggcucugggacaagaaacaucggaauugagagcgaaaccccuaaucuggacaucauuggcaaacgcaucgagaagaucaaacaggaacaugagacauccuggcacuaugaucaggaccaucccuacaagaccugggccuaucacggcagcuacgaaacaaagcaaaccgggucugcuuccagcauggugaacggagugguccggcugcucacgaaaccgugggacguuauuccuauggugacacagauggccaugaccgauaccacacccuucggccagcagagaguguuuaaggagaaagucgacacgcgcacccaagagccuaaggaagggaccaaaaagcugaugaagaucaccgcugaguggcuuuggaaagaacugggaaagaaaaagacacccagaauguguacccgggaggaguucacacgcaaagugagaucuaaugccgcucucggcgccauuuuuaccgaugaaaacaaguggaaauccgcgcgggaggccguugaagacagcggguucugggagcugguggauaaggaaagaaaucugcaccucgagggaaagugcgagacgugugucuauaacaugaugggcaaacgggaaaagaaacugggcgaguuugggaaggcuaaaggaucucgcgccaucugguacauguggcuuggcgcuagauuccuggaauuugaggcccucggguuccugaaugaagaccauugguuuucccgggagaacagccuuuccggaguggagggcgaagggcugcacaagcucggcuacauucugcgcgauguuagcaagaaagagggaggcgccauguaugcggacgauaccgcugggugggacacaagaaucacccuggaagaucucaagaaugaggaaauggugacaaaccauauggagggagagcacaaaaagcuggccgaagccauuuucaaacuuaccuaccagaauaaggucgugcggguucagcgcccuacgcccagaggcacagugauggacaucaucucucggcgcgaccagagagggagcggacaagucgugaccuauggccugaacacauucaccaacauggaggcucagcucauucggcagauggaaggggagggcgucuuuaaguccauccaacagcugacggugaaagaggaaauugccguuaagaauuggcuuauccgcgugggaagagagcggcugucucgcauggcuauuagcggcgaugacugcgucgugaaaccgcucgaugacagauucgccuccgcgcugaccgcccugaacgauauggggaaggugcggaaagacauccagcagugggaaccuucuagaggauggaaugauuggacacaaguucccuuuugcagccaucacuuccacgagcucaucaugaaggacggccgcgugcuggucgugcccugucggaaccaggaugaacuuauugggagagcucgcaucucccagggagccggcuggucucugcgggagaccgcuugccucggaaagagcuacgcccagauguggucccugauguauuuucauagacgcgaccuucggcuggcggccaaugcuauuuguagcgccguuccuucucacuggaucccgacauccagaaccacauggagcauucaugcuacccacgaguggaugacgacagaagauaugcucaccguguggaaccgcgucuggauccaagagaaucccuggauggaagacaaaaccccuguggagucuugggaagagauccccuaccugggcaagcgggaggaucaguggugcggaucccugauuggccucacaagcagagccaccugggcuaaaaacauccagacagccauuaaucagguccgcucccugaucgggaacgaagaguauacggacuacaugccuucuaugaagcgguucagacgggaagaggaagaggcgggagugcuuugguga

SEQ ID NO: 19616 - RNA, 9876 nt, Artificial Sequence
  derived and/or modified CDS sequence (opt5) from DENV-2__KM279543__SS-prME
accgccggaaucauuaucaugaugauucccaccgugauggcuuuccaccugacgaccagaaacggggaaccucauaugaucgugagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaauguuuaccucuaucggcaaagcccuccaucaaguguucggggcgaucuauggcgcugccuuuagcggaguguccuggacgaugaagauucugaucggcguugucauuacauggaucgggaugaauagccggucuaccucccugagcgugucucuugugcucgucggagugguuacccuguaccugggcgugaugguccaggccgacuccgggugugugguuagcuggaaaaacaaggagcucaaaugcggauccggcauuuucaucacagauaaugugcacaccuggacagaacaguauaaguuucagcccgagucuccuagcaagcuggcuuccgccauccaaaaagcucacgaagaggggauuuguggcaucagaucugucacgcgccuugaaaaccugauguggaagcagauuacccccgagcucaaucauauccugacagagaacgaagugaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguugaggacuauggguuuggaguguucacaaccaauaucuggcuuaaacugaaggaacggcaagaugucuuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguccuugaguccgaaaugaucauuccuaagaacuucgcugggcccguuagccagcacaauuaucgcccgggauaccauacgcagacagccggcccuuggcaccucgggcggcuggagauggauuuugacuucugugaaggaaccaccgugguggucacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucgugaacucccugguuaccgcuggacauggccagaucgauaauuuuucucugggggugcuuggaauggcgcuguuccuggaggaaaugcugcgcacacgggucggcaccaagcacgccauucuccugguggcuguuagcuuugugacgcuuaucaccgggaacauguccuucagagaccugggacgcgucauggugaugguuggcgccacaaugaccgaugacauuggcaugggggugacauaccucgcccugcuggcugccuuuaaggucagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugauggugcuuaaaauuguccgcaauauggagaaguaucagcuggcuguuaccaucauggccauucucugcgugcccaacgcggugauccugcagaaugcuuggaaagucagcuguacaacgcucgccgugguuuccgugagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgucggcauggugagcauccuggcgucuucccuccugaaaaacgauauuccgaugacagggccucuuguugccggaggccugcugaccgugugcuacguccucaccggccgcagcgcugaccuggagcuugaaagagccgcugacgugcggugggaggagcaggccgaaaucuccgggagcucucccauccugagcauuacaaucuccgaggauggaucuaugagcauuaagaaugaagaggaggaacagacccucacaauccugauucgcacgggccuccuggucaucuccgggcuuuucccugugucuauucccaucaccgccgcugcgugguaucugugggagguuaaaaagcaaagagccggagugcugugggacgucccgagcccucccccugugggcaaagcugaacucgaggauggggccuaccggaucaagcagaagggcauucugggcuauucccagaucggcgccgggguuuacaaagaaggaacauuucacaccauguggcaugugacacgcggcgcuguccuuaugcacaaggggaaaagaauugagcccucuugggccgacgugaagaaagaucugaucagcuacggaggcggguggaagcucgagggagaauggaaggagggcgaagaggugcagguucuggcgcucgaacccggcaaaaacccucgggcuguccaaaccaagccggggcuguucaaaacgaacaccggaacaauuggcgccgugucccuugacuuuagccccgggaccucuggauccccuaucguggauaagaaaggcaaggucguggggcuguauggaaauggcguugugacaagaagcggcaccuacgucucugccaucgcucagacagagaaguccauugaggacaaccccgaaaucgaggaugacauuuuccgcaaaaagcggcugacgaucauggaucuccauccuggggccggaaaaaccaagagauaucugcccgcgauugugcgcgaagcuaucaaacggggccuuagaacacugauccucgccccuacccgcguuguggccgcugagauggaagaggcccugcgggggcucccgauuagauaccagacccccgcuauccgcgccgagcacacaggacgggaaauugucgaccugaugugucaugcgacguucaccaugagacuucugagcccuauccgggugcccaauuauaaccugauuaucauggaugaggcccacuuuacagacccugcuuccauugccgcucgcggcuacaucucuaccagaguugaaaugggggaggccgccggcaucuucaugacagcuacacccccgggaagccgggacccuuuuccccaguccaaugcgcccauuauggaugaggaacgcgagaucccugaaagaagcuggaacucuggccacgagugggugacggacuucaaggggaagacagucugguuugugcccuccauuaaagccggaaaugauaucgcugccugccuccggaagaacggcaaaaaggugauucaacugagcagaaaaaccuucgacucugaauauaucaagacccgcacaaaugauugggacuuugucguuaccacagauaucagcgagaugggggccaacuucaaggcugagcgggugauugacccuagacgcuguaugaaaccggugauccuuaccgauggagaggaacgggucauucuggccggccccaugccugugacgcauuccucugcggcucagagacgcgggcggguuggcagaaaucccaagaacgaaaaugaccaguacaucuacaugggagagccucucgaaaacgaugaggacugcgcccacuggaaagaggccaagaugcugcuggacaauauuaacacacccgaaggcaucaucccgagcauguuugagccugaacgcgagaaaguggaugcuauugacggggaauauagacuccggggagaggcccgcaagaccuucgucgaucuuaugagacggggcgaccugcccguguggcuggcguaccgcguugccgcugaggggaucaacuaugccgauagacggugguguuuugacggagugaaaaauaaccaaauucucgaagagaaugucgaaguggagaucuggacaaaggagggcgaaagaaagaaacugaagccucgcuggcuugaugcucggauuuacuccgacccccuggcccucaaagaguucaaggaguucgcugccgggagaaaaucucugacccugaaccucaucacggagaugggccgccuuccuaccuuuaugacacagaaggcgaagaaugcccuggauaaccuggcuguccuccauaccgccgaagcuggaggccgggccuauaaucacgcccugagcgagcuucccgagacacuggaaacccuccugcugcucacacuucuggcuaccgugacagggggaauuuuccuguuucucauguccggcaaagggaucggaaagaugacacugggcaugugcugcaucauuaccgcgagcauccuucugugguacgcccagauucagccgcacuggaucgcugccucuauuauccucgaguucuuucugaucguucugcucauuccugaacccgagaaacaaagaacaccccaggacaaccagcuuacauauguggugaucgccauucugaccgucguugcugccacaauggcgaaugaaaugggcuuccuggagaagacgaaaaaggauuuugggcucggauccaucaccacacagcaaccugagagcaacauucuggacaucgaucuucggccggccuccgcuuggacccuguacgccguggcuacaaccuucaucacgcccaugcuccgccauucuauugaaaauagcuccgugaacgucucucugaccgccaucgcgaaucaggccacagugcugaugggccucgggaagggauggccucuuagcaaaauggacauuggcguuccccugcuggcuaucggguguuacucccaggugaacccuauuacccucacagccgcucugcuucugcucgucgcccacuaugcuaucauuggacccggccugcaggccaaggcgaccagagaggcccaaaaacgggcugccgcuggcaucaugaagaauccuacgguggacgggaugacagucaucgaucuggacccgauucccuacgauccuaaauuugaaaagcagcucggacaggugaugcuucugguucugugcgugacccagguccucaugaugcgcacaaccugggcccugugugaggcccuuacccuggcgacaggccccaucagcacgcucugggaagggaacccuggaagauucuggaauaccacaauugcugugucuauggccaacaucuuucggggcuccuaucuggcuggggccggacuccuguucagcauuaugaagaacaccgccaauacacgcagaggcaccggcaacacgggggagacacuuggagagaaauggaagaaucggcugaacgcucugggcaaaucugaauuucaaaucuacaagaaauccgggauccaggagguugaccgcacccucgccaaggaaggaauuaaaagaggcgagaccgaucaucacgcggugagccgggggucugccaagcugagaugguucgucgagcgcaaucuugugacacccgaaggaaaggugguugaccugggcugcggcagagggggauggagcuauuacuguggcgggcucaaaaacgucaaggaggugaaaggacugaccaagggcgggccgggacaugaagaaccuauccccauguccacauauggcuggaaucuggugagacuccagucuggcgucgauguuuucuuuacgcccccugaaaaaugcgacacccuucugugugauauuggggagagcucccccaacccuacaguggaggcuggacgcacccugcgggugcucaaucuggucgaaaacuggcuuaauaacaauacacaauucugcaucaaggugcugaacccguacaugcccagcguuauugagaagauggaagcccuccagagaaaauacggcggggcucuggugcgcaauccucugucccggaacucuacccacgagauguauugggucagcaacgccuccggaaauaucgugucuagcguuaacaugaucuccagaaugcucauuaaucgcuuuacgaugcggcacaagaaagcgaccuacgaacccgacguggaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggccuaucacggcagcuacgagacaaaacaaaccgggucugcuuccagcauggucaacggaguggugcggcugcucacgaagccgugggacgucauuccuaugguuacacagauggccaugaccgauaccacacccuucggccagcagagaguguuuaaagaaaagguggacacgcgcacccaagagccuaaagaggggacaaagaagcugaugaaaaucaccgcugaauggcuuuggaaggagcugggcaaaaagaaaacacccagaauguguacccgggaagaguucacacgcaaggucagaucuaaugccgcucucggcgccauuuuuaccgaugagaacaaauggaaguccgcgcgggaagccguggaggacagcggguucugggaacugguugauaaggagagaaaucugcaccucgaaggaaaaugcgagacguguguguauaacaugaugggcaagcgggagaaaaagcugggcgaauuugggaaagcuaagggaucucgcgccaucugguacauguggcuuggcgcuagauuccuggaguuugaagcccucggguuccugaaugaggaccauugguuuucccgggaaaacagccuuuccggagucgagggcgaggggcugcacaagcucggcuacauucugcgcgaugugagcaaaaaggaaggaggcgccauguaugcggacgauaccgcugggugggacacaagaaucacccuggaggaucucaaaaaugaagagaugguuacaaaccauauggaaggagagcacaagaaacuggccgaggccauuuucaaacuuaccuaccagaauaaggugguccgggugcagcgcccuacgcccagaggcacaguuauggacaucaucucucggcgcgaccagagagggagcggacaaguggucaccuauggccugaacacauucaccaacauggaagcucagcucauucggcagauggagggggaaggcguguuuaaauccauccaacagcugacggucaaggaggagauugccgugaaaaauuggcuuauccgcguuggaagagaacggcugucucgcauggcuauuagcggcgaugacugcguggucaagccgcucgaugacagauucgccuccgcgcugaccgcccugaacgauauggggaaagugcggaaggacauccagcagugggagccuucuagaggauggaaugauuggacacaagugcccuuuugcagccaucacuuccacgaacucaucaugaaggacggccgcguucuggugguccccugucggaaccaggaugagcuuauugggagagcucgcaucucccagggagccggcuggucucugcgggaaaccgcuugccucgggaaaagcuacgcccagauguggucccugauguauuuucauagacgcgaccuucggcuggcggccaaugcuauuuguagcgccgugccuucucacuggaucccgacauccagaaccacauggagcauucaugcuacccacgaguggaugacgacagaggauaugcucaccguuuggaaccgcguguggauccaagaaaaucccuggauggaggacaagaccccugucgaaucuugggaggaaauccccuaccugggcaaacgggaggaucaguggugcggaucccugauuggccucacaagcagagccaccugggcuaagaacauccagacagccauuaaucaggugcgcucccugaucgggaacgaggaauauacggacuacaugccuucuaugaaacgguucagacgggaggaagaggaagcgggaguccuuugguga

SEQ ID NO: 19617 - RNA, 9876 nt, Artificial Sequence
  derived and/or modified CDS sequence (opt5) from DENV-2__KM279571__SS-prME
accgccggcaucauuaucaugaugauucccaccgugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauaccauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaagaucagacccacguucgcggcuggacuucugcuccggaaacugacauccaaggagcucaugaugaccacaaucggcauugugcugcuuucucaaagcaccaucccugaguccauucuggaacucaccgaugcccuggcccuggggaugauggugcuuaaaaucguccgcaauauggagaaguaucagcuggcuguuacaauuauggccauccucugcgugcccaacgcggugauccugcagaaugcuuggaaagucucuuguacgacccucgccgugguuagcguguccccucugcuucugacaagcucucaacagaaggccgacuggauuccccucgcucugaccaucaagggacugaacccuacagccauuuuucuuaccacgcuguccagaacaagcaaaaagcggucuuggccccucaaugaagcuaucauggccgucggcaugguguccauucuggcgagcucucuccugaaaaacgauaucccgaugaccgggccucuuguugccggaggccugcugaccgugugcuacguccucacaggccgcuccgcugaccuggagcuugaaagagccgcugacgugcggugggaggagcaggccgaaaucagcggguccagccccauucugucuaucaccauuagcgaggauggauccaugucuaucaagaaugaagaggaggaacagacacucacgauucugauccgcaccggccuccuggucauuagcgggcuuuucccuguguccauccccaucacagccgcugcgugguaucugugggagguuaaaaagcaaagagccggagugcugugggacgucccgucuccucccccugugggcaaagcugaacucgaggauggggccuaccggauuaagcagaagggaauccugggcuauagccagauuggcgccgggguuuacaaagaaggaaccuuucacacaauguggcaugugacccgcggcgcuguccuuaugcacaaggggaaaagaaucgagcccuccugggccgacgugaagaaagaucugauuucuuacggaggcggguggaagcucgagggagaauggaaggagggcgaagaggugcagguucuggcgcucgaacccggcaaaaacccucgggcuguccaaacgaagccggggcuguucaaaaccaacacaggaaccaucggcgccgugagccuugacuuuucccccgggacaagcggaucuccuaucguggauaagaaaggcaaggucguggggcuguauggaaauggcguugugaccagauccggcacauacgucagcgccauugcucagacggagaagucuaucgaggacaaccccgaaauugaggaugacaucuuccgcaaaaagcggcugaccauuauggaucuccauccuggggccggaaaaacaaagagauaucugcccgcgaucgugcgcgaagcuaucaaacggggccuuagaacccugauucucgccccuacccgcguuguggccgcugagauggaagaggcccugcgggggcucccgaucagauaccagacacccgcuauucgcgccgagcacacgggacgggaaaucgucgaccugaugugucaugcgaccuucacaaugagacuucuguccccuauucgggugcccaauuauaaccugaucauuauggaugaggcccacuuuaccgacccugcuagcaucgccgcucgcggcuacaucuccacaagaguugaaaugggggaggccgccggcauuuucaugaccgcuacgcccccgggaucucgggacccuuuuccccagagcaaugcgcccaucauggaugaggaaaaggagauuccugaacgcuccuggaacagcggccacgagugggugacagacuucaaggggaaaaccgucugguuugugcccucuaucaaggccggaaaugauauugcugccugccuccgcaagaacggcaagaaagugauccaacugucccggaagaccuucgacagcgaauauaucaagacaagaaccaaugauugggacuuugucguuacaaccgauauuucugagaugggggccaacuucaaagcugagcgcgugaucgacccucggagauguaugaagccggugauucuuacggauggagaggaacgcgucauccuggccggccccaugccugugacacauagcuccgcggcucagcggagagggcgcguuggccggaaucccaaaaacgaaaaugaccaguacauuuacaugggagagccucucgaaaacgaugaggacugcgcccacuggaaggaggccaaaaugcugcuggacaauaucaacacccccgaaggcaucauuccgucuauguuugagccugaaagagagaagguggaugcuaucgacggggaauaucgccucagaggagaggcccggaaaacauucgucgaucuuaugcgcagaggcgaccugcccguguggcuggcguaccggguugccgcugaggggauuaacuaugccgaucgcagaugguguuuugacggagugaagaauaaccaaauccucgaagagaaugucgaaguggagauuuggaccaaggagggcgaacggaaaaagcugaaaccuagauggcuugaugcucgcaucuacagcgacccccuggcccucaaggaguucaaagaguucgcugccgggcggaagucccugacgcugaaccucauuaccgagaugggcagacuuccuacauuuaugacccagaaggcgaaaaaugcccuggauaaccuggcuguccuccauacagccgaagcuggaggccgcgccuauaaucacgcccugucugagcuucccgagacccuggaaacacuccugcugcucacccuucuggcuacggugacagggggaaucuuccuguuucucaugagcggcaaggggaucggaaaaaugacccugggcaugugcugcauuaucaccgcguccauucuucugugguacgcccagauccagccgcacuggauugcugccagcaucauccucgaguucuuucugauuguucugcucaucccugaacccgagaagcaacggacaccccaggacaaccagcuuaccuauguggugauugccauccugacagucguugcugccacgauggcgaaugaaaugggcuuccuggagaaaaccaagaaggauuuugggcucggaucuauuacaacccagcaaccugaguccaacauccuggacaucgaucuuagaccggccagcgcuuggacacuguacgccguggcuaccacguucauuacccccaugcuccggcauuccaucgaaaauucuagcgugaacgucucccugacagccauugcgaaucaggccaccgugcugaugggccucgggaaaggauggccucuuucuaagauggacaucggcguuccccugcuggcuauuggguguuacagccaggugaacccuaucacacucaccgccgcucugcuucugcucgucgcccacuaugcuauuaucggacccggccugcaggccaaagcgacgcgcgaggcccaaaagagagcugccgcuggcaucaugaaaaauccuacaguggacgggaugaccgucauugaucuggacccgauccccuacgauccuaaguuugaaaagcagcucggacaggugaugcuucugguucugugcgugacacagguccucaugaugcggaccaccugggcccugugugaggcccuuacacuggcgacgggccccauuuccacccucugggaagggaacccuggacgcuucuggaauacaaccaucgcugugagcauggccaacauuuuuagaggcucuuaucuggcuggggccggacuccuguucuccaucaugaaaaacacagccaauacccggcgcggcacgggcaacacaggggagacccuuggagagaaguggaaaaauagacugaacgcucugggcaagagcgaauuucaaaucuacaaaaagucugggauucaggagguugaccggacccucgccaaagaaggaaucaagcgcggcgagacagaucaucacgcgguguccagagggagcgccaagcugcggugguucgucgagagaaaucuugugacccccgaaggaaaagugguugaccugggcugcggccgcgggggauggucuuauuacuguggcgggcucaagaacgucaaagaggugaagggacugacaaaaggcgggccgggacaugaagaaccuauucccaugagcacguauggcuggaaucuggugcggcuccaguccggcgucgauguuuucuuuacacccccugaaaagugcgacacacuucugugugauaucggggagucuagccccaacccuaccguggaggcuggaagaacacugcgcgugcucaaucuggucgaaaacuggcuuaauaacaauacccaauucugcauuaaggugcugaacccguacaugcccuccguuaucgagaaaauggaagcccuccagcggaaguacggcggggcucuggugagaaauccucugagccgcaacuccacgcacgagauguauugggucucuaacgccagcggaaauaucguguccucuguuaacaugauuagccggaugcucaucaauagauuuaccaugcgccacaaaaaggcgacauacgaacccgacguggaucuuggcuccgggacccggaacauuggaaucgagucugagacaccuaaucuggacauuaucggcaaaagaaucgaaaagauuaagcaggagcaugaaaccagcuggcacuaugaucaggaccaucccuacaaaacaugggccuaucacggcuccuacgagaccaagcaaacggggagcgcuucuuccauggucaacggaguggugcgccugcucacaaaaccgugggacgucaucccuaugguuacccagauggccaugaccgauacaacgcccuucggccagcagcggguguuuaaggaaaaaguggacaccagaacacaagagccuaaggaggggaccaagaaacugaugaagauuacagcugaauggcuuuggaaagagcugggaaagaaaaagacccccagaauguguacaagagaagaguucacccggaaaguccgcagcaaugccgcucucggcgccaucuuuacggaugagaacaaguggaagucugcgagagaagccguggaggacuccggguucugggaacugguugauaaagagcggaaucugcaccucgaaggaaagugcgagaccuguguguauaacaugaugggcaaaagagagaagaaacugggcgaauuugggaaggcuaagggaagccgggccauuugguacauguggcuuggcgcucgcuuccuggaguuugaagcccucggguuccugaaugaggaccauugguuuucuagagaaaacucccuuagcggagucgagggcgaggggcugcacaaacucggcuacauccugcgggauguguccaagaaagaaggaggcgccauguaugcggacgauacagcugggugggacacccgcauuacacuggaggaucucaagaaugaagagaugguuaccaaccauauggaaggagagcacaaaaagcuggccgaggccaucuucaaacuuacguaccagaauaaaguggucagagugcagcggccuacaccccgcggcaccguuauggacaucauuagcagacgggaccagcgcgggucuggacaaguggucacauauggccugaacaccuucacgaacauggaagcucagcucaucagacagauggagggggaaggcguguuuaagagcauucaacagcugaccgucaaagaggagaucgccgugaagaauuggcuuauucggguuggacgcgaaagacugucccggauggcuaucucuggcgaugacugcguggucaaaccgcucgaugaccgcuucgccagcgcgcugacagcccugaacgauauggggaaggugagaaaggacauccagcagugggagccuucccggggauggaaugauuggacccaagugcccuuuugcucucaucacuuccacgaacucauuaugaaagacggcagaguucuggugguccccugucgcaaccaggaugagcuuaucgggcgggcuagaauuagccagggagccggcuggucccugcgcgaaacagcuugccucgggaagucuuacgcccagauguggagccugauguauuuucaucggagagaccuucgccuggcggccaaugcuaucuguuccgccgugccuagccacuggauuccgaccucucggacaaccugguccauccaugcuacgcacgaguggaugacaaccgaggauaugcucaccguuuggaacagaguguggauccaagaaaaucccuggauggaggacaaaacaccugucgaaagcugggaggaaauucccuaccugggcaagcgcgaggaucaguggugcggaucucugaucggccucaccucccgggccacaugggcuaaaaacauucagacggccaucaaucaggugagaagccugauugggaacgaggaauauaccgacuacaugccuuccaugaagcgcuuccggagagaggaagaggaagcgggaguccuuugguga

SEQ ID NO: 19618 - RNA, 9876 nt, Artificial Sequence
  derived and/or modified CDS sequence (opt5) from DENV-2__KM279544__SS-prME
accgccggaaucauuaucaugaugauucccacagugauggcuuuccaccugacgaccagaaacggggaaccucauaugaucgugagccggcaggaaaagggaaaaucccuccuguuuaagaccgagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaccucuaaccgcgacuuugucgaaggcgugagcgggggauccuggguugauaucgugcuggagcacggcagcugugucacaaccauggccaaaaauaagcccacacucgacuucgaacugaucaagaccgaggcuaaacaccuugccacgcugagaaaguacugcguggaagcuaaacucacaaacaccaccacagccucucgguguccuacccagggggagccgucccugaaugaggaacaagauaagcgcuuugugugcaaacauagcauggucgacagaggauggggcaacggcugugggcuguucggaaagggcgggauuguuacaugcgcgauguuuacgugcaagaaaaauauggagggaaagguggugcagcccgaaaaccucgaguauaccaucgucauuacaccucacucuggcgaagagaaugccguggggaacgauaccggaaaacauggcaaggagaucaaaguuacaccccaguccagcauuaccgaagcugagcugacgggcuacgggaccgugacaauggaauguucuccucggaccggacuugacuucaaugagaugguccugcuccagauggaaaacaaggccuggcuggugcaccgccaaugguuucuugaucugccccucccguggcugccuggcgcugacacacagggguccaacuggauccagaaagagacccugguuacguucaagaauccccacgccaagaaacaggauguggucgugcucggaagccaagagggcgccaugcauacagcucugaccggggcgacagaaauccagauguccucuggcaaccuucuguuuaccggacaccucaagugcagacugcggauggacaaacuucagcugaagggcaugagcuauuccauguguaccgggaaauucaaggucgugaaggagauugccgaaacacaacauggaacgaucguuauuagagugcaguacgagggcgacgggagcccuugcaaaauccccuucgagauuauggaucucgaaaagcgccacguccugggacggcugaucaccgugaaucccaucguuacagagaaagacucuccugugaacauugaagcugagccgcccuuuggcgauuccuacaucauuaucggggucgaaccuggccagcucaagcugagcugguucaaaaagggaucuagcauuggccagauguuugagaccacaaugagaggggccaagcgcauggccauccuuggagacaccgcuugggauuucggcucccucgggggaauguuuacgucuauuggcaaagcccuccaucaaguguucggggcgaucuauggcgcugccuuuagcggaguguccuggacaaugaagauccugauuggcguugucaucaccuggauugggaugaauagccggucuaccucccugagcgugucucuugugcucgucggagugguuacacuguaccugggcgugaugguccaggccgacuccgggugugugguuagcuggaaaaacaaggagcucaaaugcggauccggcaucuucauuaccgauaaugugcacacauggacggaacaguauaaguuucagcccgagucuccuagcaagcuggcuuccgccauccaaaaagcucacgaagaggggaucuguggcauuagaucugucacccgccuugaaaaccugauguggaagcagaucacacccgagcucaaucauauucugaccgagaacgaagugaaacugacaaucaugaccggagacauuaagggcaucaugcaggccgggaaacggagccuuagaccgcagccuacggagcucaaguacuccuggaaagcguggggaaaggccaagaugcugagcaccgaacugcacaaucauacauuccucaucgauggccccgagaccgcugaaugcccuaacacaaaucgcgccuggaacucucuggagguugaggacuauggguuuggaguguucaccacaaauauuuggcuuaaacugaaggaacggcaagaugucuuuugugacuccaaacucaugagcgcugccaucaaggacaacagagcggugcacgccgauaugggcuacuggauugagucugcucugaacgacaccuggaaaaucgaaaaggccuccuucauugaggucaagagcugccacuggcccaaaucucauacgcuguggagcaauggcguccuugaguccgaaaugaucaucccuaagaacuucgcugggcccguuagccagcacaauuaucgcccgggauaccauacacagaccgccggcccuuggcaccucgggcggcuggagauggauuuugacuucugugaaggaaccacagugguggucaccgaggauugcggcaacagagggcccucucugcggacgacaaccgccuccggaaaacucauuacagaauggugcugucgcagcugcacccugcccccucuuagauaccggggcgaggacggcuguugguaugggauggagaucagaccgcugaaggaaaaagaggaaaaucucgugaacucccugguuacagcuggacauggccagauugauaauuuuucucugggggugcuuggaauggcgcuguuccuggaggaaaugcugcgcacccgggucggcacgaagcacgccauccuccugguggcuguuagcuuugugacccuuauuacagggaacauguccuucagagaccugggacgcgucauggugaugguuggcgccaccaugacagaugacaucggcaugggggugaccuaccucgcccugcuggcugccuuuaaggucagacccacguucgcggcuggacuucugcuccggaaacugacaucuaaggagcucaugaugaccacaauuggcaucgugcugcuuagccaauccaccaucccugagucuauucuggaacucaccgaugcccuggcccuggggaugauggugcuuaaaaucguccgcaauauggagaaguaucagcuggcuguuacaauuauggccauccucugcgugcccaacgcggugauucugcagaaugcuuggaaagucagcuguacgacccucgccgugguuuccgugagcccucugcuucugacaucuucccaacagaaggccgacuggaucccccucgcucugaccaucaagggacugaacccuacagccauuuuucuuaccacgcugagcagaacaucuaaaaagcgguccuggccccucaaugaagcuaucauggccgucggcauggugagcauucuggcgucuucccuccugaaaaacgauaucccgaugaccgggccucuuguugccggaggccugcugaccgugugcuacguccucacaggccgcagcgcugaccuggagcuugaaagagccgcugacgugcggugggaggagcaggccgaaauuuccgggagcucucccauccugagcaucaccauuuccgaggauggaucuaugagcaucaagaaugaagaggaggaacagacacucacgauucugauccgcaccggccuccuggucauuuccgggcuuuucccugugucuauccccauuacagccgcugcgugguaucugugggagguuaaaaagcaaagagccggagugcugugggacgucccgagcccucccccugugggcaaagcugaacucgaggauggggccuaccggaucaagcagaagggaauccugggcuauucccagauuggcgccgggguuuacaaagaaggaaccuuucacacaauguggcaugugacccgcggcgcuguccuuaugcacaaggggaaaagaaucgagcccucuugggccgacgugaagaaagaucugauuagcuacggaggcggguggaagcucgagggagaauggaaggagggcgaagaggugcagguucuggcgcucgaacccggcaaaaacccucgggcuguccaaacgaagccggggcuguucaaaaccaacacaggaaccaucggcgccgugucccuugacuuuagccccgggacaucuggauccccuauuguggauaagaaaggcaaggucguggggcuguauggaaauggcguugugaccagaagcggcacauacgucucugccaucgcucagacggagaaguccaucgaggacaaccccgaaauugaggaugacaucuuccgcaaaaagcggcugaccauuauggaucuccauccuggggccggaaaaacaaagagauaucugcccgcgaucgugcgcgaagcuauuaaacggggccuuagaacccugauccucgccccuacccgcguuguggccgcugagauggaagaggcccugcgggggcucccgaucagauaccagacacccgcuauucgcgccgagcacacgggacgggaaaucgucgaccugaugugucaugcgaccuucacaaugagacuucugagcccuauucgggugcccaauuauaaccugaucauuauggaugaggcccacuuuaccgacccugcuuccaucgccgcucgcggcuacauuucuacaagaguugaaaugggggaggccgccggcaucuucaugaccgcuacgcccccgggaagccgggacccuuuuccccaguccaaugcgcccaucauggaugaggaacgcgagauuccugaaagaagcuggaacucuggccacgagugggugacagacuucaaggggaagaccgucugguuugugcccuccaucaaagccggaaaugauauugcugccugccuccggaagaacggcaaaaaggugauccaacugagcagaaaaaccuucgacucugaauauauuaagacacgcaccaaugauugggacuuugucguuacaaccgauaucagcgagaugggggccaacuucaaggcugagcgggugaucgacccuagacgcuguaugaaaccggugauucuuacggauggagaggaacgggucauccuggccggccccaugccugugacacauuccucugcggcucagagacgcgggcggguuggcagaaaucccaagaacgaaaaugaccaguacauuuacaugggagagccucucgaaaacgaugaggacugcgcccacuggaaagaggccaagaugcugcuggacaauaucaacacccccgaaggcauuaucccgagcauguuugagccugaacgcgagaaaguggaugcuaucgacggggaauauagacuccggggagaggcccgcaagacauucgucgaucuuaugagacggggcgaccugcccguguggcuggcguaccgcguugccgcugaggggauuaacuaugccgauagacggugguguuuugacggagugaaaaauaaccaaauccucgaagagaaugucgaaguggagauuuggaccaaggagggcgaaagaaagaaacugaagccucgcuggcuugaugcucggaucuacuccgacccccuggcccucaaagaguucaaggaguucgcugccgggagaaaaucucugacgcugaaccucauuaccgagaugggccgccuuccuacauuuaugacccagaaggcgaagaaugcccuggauaaccuggcuguccuccauacagccgaagcuggaggccgggccuauaaucacgcccugagcgagcuucccgagacccuggaaacacuccugcugcucacccuucuggcuacggugacagggggaaucuuccuguuucucauguccggcaaagggauuggaaagaugacccugggcaugugcugcaucaucaccgcgagcauucuucugugguacgcccagauccagccgcacuggauugcugccucuaucauucucgaguucuuucugaucguucugcucaucccugaacccgagaaacaaagaacaccccaggacaaccagcuuaccuauguggugauugccauccugacagucguugcugccacgauggcgaaugaaaugggcuuccuggagaagaccaaaaaggauuuugggcucggauccauuacaacccagcaaccugagagcaacauccuggacauugaucuucggccggccuccgcuuggacacuguacgccguggcuaccacguucaucacccccaugcuccgccauucuaucgaaaauagcuccgugaacgucucucugacagccauugcgaaucaggccaccgugcugaugggccucgggaagggauggccucuuagcaaaauggacaucggcguuccccugcuggcuauuggguguuacucccaggugaacccuaucacacucaccgccgcucugcuucugcucgucgcccacuaugcuauuaucggacccggccugcaggccaaggcgacgagagaggcccaaaaacgggcugccgcuggcauuaugaagaauccuacaguggacgggaugaccgucaucgaucuggacccgauccccuacgauccuaaauuugaaaagcagcucggacaggugaugcuucugguucugugcgugacacagguccucaugaugcgcaccaccugggcccugugugaggcccuuacacuggcgacgggccccauuagcacccucugggaagggaacccuggaagauucuggaauacaaccaucgcugugucuauggccaacauuuuucggggcuccuaucuggcuggggccggacuccuguucagcaucaugaagaacacagccaauacccgcagaggcacgggcaacacaggggagacccuuggagagaaauggaagaaucggcugaacgcucugggcaaaucugaauuucaaauuuacaagaaauccgggauccaggagguugaccgcacccucgccaaggaaggaaucaaaagaggcgagacagaucaucacgcggugagccgggggucugccaagcugagaugguucgucgagcgcaaucuugugacccccgaaggaaaggugguugaccugggcugcggcagagggggauggagcuauuacuguggcgggcucaaaaacgucaaggaggugaaaggacugacaaagggcgggccgggacaugaagaaccuauucccauguccacguauggcuggaaucuggugagacuccagucuggcgucgauguuuucuuuacacccccugaaaaaugcgacacacuucugugugauaucggggagagcucccccaacccuaccguggaggcuggacgcacacugcgggugcucaaucuggucgaaaacuggcuuaauaacaauacccaauucugcauuaaggugcugaacccguacaugcccagcguuaucgagaagauggaagcccuccagagaaaauacggcggggcucuggugcgcaauccucugucccggaacucuacgcacgagauguauugggucagcaacgccuccggaaauauugugucuagcguuaacaugaucuccagaaugcucaucaaucgcuuuaccaugcggcacaagaaagcgacauacgaacccgacguggaucuuggcucugggaccagaaacauuggaaucgagagcgagacaccuaaucuggacauuaucggcaagcgcauugagaagaucaagcaggagcaugaaaccuccuggcacuaugaucaggaccaucccuacaagacaugggccuaucacggcagcuacgagaccaaacaaacggggucugcuuccagcauggucaacggaguggugcggcugcucacaaagccgugggacgucaucccuaugguuacccagauggccaugaccgauacaacgcccuucggccagcagagaguguuuaaagaaaagguggacacccgcacacaagagccuaaagaggggaccaagaagcugaugaaaauuacagcugaauggcuuuggaaggagcugggcaaaaagaaaacccccagaauguguacacgggaagaguucacccgcaaggucagaucuaaugccgcucucggcgccaucuuuacggaugagaacaaauggaaguccgcgcgggaagccguggaggacagcggguucugggaacugguugauaaggagagaaaucugcaccucgaaggaaaaugcgagaccuguguguauaacaugaugggcaagcgggagaaaaagcugggcgaauuugggaaagcuaagggaucucgcgccauuugguacauguggcuuggcgcuagauuccuggaguuugaagcccucggguuccugaaugaggaccauugguuuucccgggaaaacagccuuuccggagucgagggcgaggggcugcacaagcucggcuacauccugcgcgaugugagcaaaaaggaaggaggcgccauguaugcggacgauacagcugggugggacaccagaauuacacuggaggaucucaaaaaugaagagaugguuaccaaccauauggaaggagagcacaagaaacuggccgaggccaucuucaaacuuacguaccagaauaaggugguccgggugcagcgcccuacacccagaggcaccguuauggacauuaucucucggcgcgaccagagagggagcggacaaguggucacauauggccugaacaccuucacgaacauggaagcucagcucauccggcagauggagggggaaggcguguuuaaauccauucaacagcugaccgucaaggaggagaucgccgugaaaaauuggcuuauucgcguuggaagagaacggcugucucgcauggcuaucagcggcgaugacugcguggucaagccgcucgaugacagauucgccuccgcgcugacagcccugaacgauauggggaaagugcggaaggacauucagcagugggagccuucuagaggauggaaugauuggacccaagugcccuuuugcagccaucacuuccacgaacucaucaugaaggacggccgcguucuggugguccccugucggaaccaggaugagcuuaucgggagagcucgcauuucccagggagccggcuggucucugcgggaaacagcuugccucgggaaaagcuacgcccagauguggucccugauguauuuucauagacgcgaccuucggcuggcggccaaugcuaucuguagcgccgugccuucucacuggauuccgaccuccagaacaaccuggagcauccaugcuacgcacgaguggaugacaaccgaggauaugcucaccguuuggaaccgcguguggauucaagaaaaucccuggauggaggacaagacacuggucgaaucuugggaggaaaucccuuaccugggcaaacgggaggaucaguggugcggaucccucaucggccugaccagcagagccacaugggcuaagaacauucagacggccaucaaucaggugcgcucccuuauugggaacgaggaauauaccgacuacaugcccucuaugaaacgguucagacgggaggaagaggaagcgggaguccugugguga

SEQ ID NO: 19619 - RNA, 9876 nt, Artificial Sequence
  derived and/or modified CDS sequence (opt5) from DENV-2__KM279549__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauucucugcgugcccaacgcggucauccugcagaaugcuuggaaagugagcuguacaacgcucgccguuguguccgucagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcaaagagccggaguccugugggacgugccgagcccucccccuguuggcaaagcugaacucgaggauggggccuaccggaucaagcagaagggcauucugggcuauucccagaucggcgccgggguguacaaagaaggaacauuucacaccauguggcaugucacacgcggcgcugugcuuaugcacaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcaaaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucagacagagaaguccauugaggacaaccccgaaaucgaggaugacauuuuccgcaaaaagcggcugacgaucauggaucuccauccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaauuauaaccugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaaugcgcccauuauggaugaggaacgcgagaucccugaaagaagcuggaacucuggccacgagugggucacggacuucaaggggaagacagugugguuugugcccuccauuaaagccggaaaugauaucgcugccugccuccggaagaacggcaaaaaggucauucaacugagcagaaaaaccuucgacucugaauauaucaagacccgcacaaaugauugggacuuuguugugaccacagauaucagcgagaugggggccaacuucaaggcugagcgggugauugacccuagacgcuguaugaaaccggucauccuuaccgauggagaggaacgggugauucuggccggccccaugccuguuacgcauuccucugcggcucagagacgcgggcgggugggcagaaaucccaagaacgaaaaugaccaguacaucuacaugggagagccucucgaaaacgaugaggacugcgcccacuggaaagaggccaagaugcugcuggacaauauuaacacacccgaaggcaucaucccgagcauguuugagccugaacgcgagaaagucgaugcuauugacggggaauauagacuccggggagaggcccgcaagaccuucguggaucuuaugagacggggcgaccugcccguuuggcuggcguaccgcguggccgcugaggggaucaacuaugucgauagacggugguguuuugacggagugaaaaauaaccaaauucucgaagagaaugucgaaguggagaucuggacaaaggagggcgaaagaaagaaacugaagccucgcuggcuugaugcccggauuuacuccgacccccuggcucucaaagaguucaaggaguucgccgcugggagaaaaucucugacccugaaccucaucacggagaugggccgccuuccuaccuuuaugacacagaaggccaagaaugcgcuggauaaccuggccguucuccauaccgcugaagccggaggccgggcuuauaaucacgcccugagcgagcuucccgagacacuggaaacccuccugcugcucacacuucuggccaccgugacagggggaauuuuccuguuucucauguccggcaaagggaucggaaagaugacacugggcaugugcugcaucauuaccgcuagcauccuucugugguacgcgcagauucagccgcacuggaucgccgcuucuauuauccucgaguucuuucugaucgugcugcucauuccugaacccgagaaacaaagaacaccccaggacaaccagcuuacauaugucguuaucgccauucugaccgugguggccgcuacaauggccaaugaaaugggcuuccuggagaagacgaaaaaggauuuugggcucggauccaucaccacacagcaaccugagagcaacauucuggacaucgaucuucggccggcguccgccuggacccuguacgcugucgccacaaccuucaucacgcccaugcuccgccauucuauugaaaauagcuccgugaacguuucucugaccgcuaucgccaaucaggcgacagugcugaugggccucgggaagggauggccucuuagcaaaauggacauuggcgucccccugcuggccaucggguguuacucccaggugaacccuauuacccucacagcugcccugcuucugcucgucgcucacuaugccaucauuggacccggccugcaggcuaaggccaccagagaggcgcaaaaacgggccgcugccggcaucaugaagaauccuacgguggacgggaugacaguuaucgaucuggacccgauucccuacgauccuaaauuugaaaagcagcucggacaggugaugcuucugguccugugcgugacccagguucucaugaugcgcacaaccugggcucugugugaggcccuuacccuggccacaggccccaucagcacgcucugggaagggaacccuggaagauucuggaauaccacaauugcggugucuauggcuaacaucuuucggggcuccuaucuggccggggcuggacuccuguucagcauuaugaagaacaccgccaauacacgcagaggcaccggcaacacgggggagacacuuggagagaaauggaagaaucggcugaacgcccugggcaaaucugaauuucaaaucuacaagaaauccgggauccaggaggucgaccgcacccucgcuaaggaaggaauuaaaagaggcgagaccgaucaucacgccgugagccgggggucugcgaagcugagaugguucguggagcgcaaucuuguuacacccgaaggaaaggucguggaccugggcugcggcagagggggauggagcuauuacuguggcgggcucaaaaacgugaaggaggucaaaggacugaccaagggcgggccgggacaugaagaaccuauccccauguccacauauggcuggaaucugguuagacuccagucuggcguggauguguucuuuacgcccccugaaaaaugcgacacccuucugugugauauuggggagagcucccccaacccuacagucgaggccggacgcacccugcgggugcucaaucugguugaaaacuggcuuaauaacaauacacaauucugcaucaaggugcugaacccguacaugcccagcgucauugagaagauggaagcucuccagagaaaauacggcggggcccuggugcgcaauccucugucccggaacucuacccacgagauguauuggguuagcaacgcuuccggaaauaucgugucuagcgucaacaugaucuccagaaugcucauuaaucgcuuuacgaugcggcacaagaaagccaccuacgaacccgacguggaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggcguaucacggcagcuacgagacaaaacaaaccgggucugccuccagcauggugaacggagucguucggcugcucacgaagccgugggacgugauuccuauggugacacagauggcuaugaccgauaccacacccuucggccagcagagagucuuuaaagaaaagguggacacgcgcacccaagagccuaaagaggggacaaagaagcugaugaaaaucaccgccgaauggcuuuggaaggagcugggcaaaaagaaaacacccagaauguguacccgggaagaguucacacgcaagguuagaucuaaugcugcccucggcgcuauuuuuaccgaugagaacaaauggaaguccgcccgggaagcgguggaggacagcggguucugggaacuggucgauaaggagagaaaucugcaccucgaaggaaaaugcgagacguguguguauaacaugaugggcaagcgggagaaaaagcugggcgaauuugggaaagccaagggaucucgcgcuaucugguacauguggcuuggcgccagauuccuggaguuugaagcucucggguuccugaaugaggaccauugguuuucccgggaaaacagccuuuccggaguugagggcgaggggcugcacaagcucggcuacauucugcgcgaugugagcaaaaaggaaggaggcgccauguaugccgacgauaccgcggggugggacacaagaaucacccuggaggaucucaaaaaugaagagauggucacaaaccauauggaaggagagcacaagaaacuggcugaggccauuuucaaacuuaccuaccagaauaaggugguucgggugcagcgcccuacgcccagaggcacagucauggacaucaucucucggcgcgaccagagagggagcggacaaguggucaccuauggccugaacacauucaccaacauggaagcccagcucauucggcagauggagggggaaggcguguuuaaauccauccaacagcugacgguuaaggaggagauugcugugaaaaauuggcuuauccgcgucggaagagaacggcugucucgcauggccauuagcggcgaugacugcguggugaagccgcucgaugacagauucgcuuccgcccugaccgcgcugaacgauauggggaaaguucggaaggacauccagcagugggagccuucuagaggauggaaugauuggacacaagugcccuuuugcagccaucacuuccacgaacucaucaugaaggacggccgcguccuggugguucccugucggaaccaggaugagcuuauugggagagcccgcaucucccagggagcuggcuggucucugcgggaaaccgccugccucgggaaaagcuacgcucagauguggucccugauguauuuucauagacgcgaccuucggcuggccgcgaaugccauuuguagcgcugugccuucucacuggaucccgacauccagaaccacauggagcauucaugccacccacgaguggaugacgacagaggauaugcucaccgucuggaaccgcguguggauccaagaaaaucccuggauggaggacaagaccccugucgaaucuugggaggaaauccccuaccugggcaaacgggaggaucaguggugcggaucccugauuggccucacaagcagagcuaccugggccaagaacauccagacagcuauuaaucaggugcgcucccugaucgggaacgaggaauauacggacuacaugccuucuaugaaacgguucagacgggaggaagaggaagccggaguucuuugguga

SEQ ID NO: 19620 - RNA, 9876 nt, Artificial Sequence
  derived and/or modified CDS sequence (opt5) from DENV-2__KM279552__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccacuccacaauuccugagucuauccuggaacucaccgaugcccuggcccuggggaugaugguccuuaaaauuguucgcaauauggagaaguaucaacuggcugugaccaucauggccauucucugcgugcccaacgcggucauccugcagaaugcuuggaaagugagcuguacaacgcucgccguuguguccgucagcccucugcuucugaccucuucccagcaaaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcagagagccggaguccugugggacgugccgagcccucccccuguuggcaaagcugaacucgaggauggggccuaccggaucaagcaaaagggcauucugggcuauucccagaucggcgccgggguguacaaagaaggaacauuucauaccauguggcacgucacacgcggcgcugugcuuaugcauaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcagaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucaaacagagaaguccauugaggacaaccccgaaaucgaggaugacauuuuccgcaaaaagcggcugacgaucauggaucuccacccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcauacaggacgggaaauuguggaccugaugugucacgcgacguucaccaugagacuucugagcccuauccggguucccaauuauaaccugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaaugcgcccauuauggaugaggaacgcgagaucccugaaagaagcuggaacucuggccaugagugggucacggacuucaaggggaagacagugugguuugugcccuccauuaaagccggaaaugauaucgcugccugccuccggaagaacggcaaaaaggucauucagcugagcagaaaaaccuucgacucugaauauaucaagacccgcacaaaugauugggacuuuguugugaccacagauaucagcgagaugggggccaacuucaaggcugagcgggugauugacccuagacgcuguaugaaaccggucauccuuaccgauggagaggaacgggugauucuggccggccccaugccuguuacgcacuccucugcggcucaaagacgcgggcgggugggcagaaaucccaagaacgaaaaugaccaguacaucuacaugggagagccucucgaaaacgaugaggacugcgcccauuggaaagaggccaagaugcugcuggacaauauuaacacacccgaaggcaucaucccgagcauguuugagccugaacgcgagaaagucgaugcuauugacggggaauauagacuccggggagaggcccgcaagaccuucguggaucuuaugagacggggcgaccugcccguuuggcuggcguaccgcguggccgcugaggggaucaacuaugccgauagacggugguguuuugacggagucaaaaauaaccagauucucgaagagaauguggaagucgagaucuggacaaaggagggcgaaagaaagaaacugaagccucgcuggcuugaugcucggauuuacuccgacccccuggcccucaaagaguucaaggaguucgcugccgggagaaaaucucugacccugaaccucaucacggagaugggccgccuuccuaccuuuaugacacaaaaggcgaagaaugcccuggauaaccuggcugugcuccacaccgccgaagcuggaggccgggccuauaaucacgcccugagcgagcuucccgagacacuggaaacccuccugcugcucacacuucuggcuaccguuacagggggaauuuuccuguuucucauguccggcaaagggaucggaaagaugacacugggcaugugcugcaucauuaccgcgagcauccuucugugguacgcccagauucagccgcauuggaucgcugccucuauuauccucgaguucuuucugaucgugcugcucauuccugaacccgagaaacagagaacaccccaagacaaccagcuuacauauguggucaucgccauucugaccguuguggcugccacaauggcgaaugaaaugggcuuccuggagaagacgaaaaaggauuuugggcucggauccaucaccacacagcagccugagagcaacauucuggacaucgaucuucggccggccuccgcuuggacccuguacgccguggcuacaaccuucaucacgcccaugcuccgccacucuauugaaaauagcuccgucaacgugucucugaccgccaucgcgaaucaagccacaguucugaugggccucgggaagggauggccucuuagcaaaauggacauuggcgugccccugcuggcuaucggguguuacucccaggucaacccuauuacccucacagccgcucugcuucugcucguggcccauuaugcuaucauuggacccggccugcaggccaaggcgaccagagaggcccagaaacgggcugccgcuggcaucaugaagaauccuacggucgacgggaugacagugaucgaucuggacccgauucccuacgauccuaaauuugaaaagcaacucggacagguuaugcuucuggugcugugcgucacccaggugcucaugaugcgcacaaccugggcccugugugaggcccuuacccuggcgacaggccccaucagcacgcucugggaagggaacccuggaagauucuggaauaccacaauugcuguuucuauggccaacaucuuucggggcuccuaucuggcuggggccggacuccuguucagcauuaugaagaacaccgccaauacacgcagaggcaccggcaacacgggggagacacuuggagagaaauggaagaaucggcugaacgcucugggcaaaucugaauuucagaucuacaagaaauccgggauccaagagguggaccgcacccucgccaaggaaggaauuaaaagaggcgagaccgaucaccaugcggucagccgggggucugccaagcugagaugguucguggagcgcaaucuugugacacccgaaggaaagguugucgaccugggcugcggcagagggggauggagcuauuacuguggcgggcucaaaaacgugaaggaggugaaaggacugaccaagggcgggccgggacacgaagaaccuauccccauguccacauauggcuggaaucuggucagacuccagucuggcguugauguguucuuuacgcccccugaaaaaugcgacacccuucugugugauauuggggagagcucccccaacccuacaguggaggcuggacgcacccugcggguccucaaucugguggaaaacuggcuuaauaacaauacacaguucugcaucaagguucugaacccguacaugcccagcgugauugagaagauggaagcccuccaaagaaaauacggcggggcucugguccgcaauccucugucccggaacucuacccacgagauguauugggugagcaacgccuccggaaauaucguuucuagcgugaacaugaucuccagaaugcucauuaaucgcuuuacgaugcggcauaagaaagcgaccuacgaacccgacgucgaucuuggcucugggacaagaaacaucggaauugagagcgagaccccuaaucuggacaucauuggcaagcgcaucgagaagaucaagcaggagcacgaaacauccuggcauuaugaucaggaccaccccuacaagaccugggccuaucacggcagcuacgagacaaaacagaccgggucugcuuccagcauggugaacggagugguccggcugcucacgaagccgugggacguuauuccuauggugacacaaauggccaugaccgauaccacacccuucggccagcagagaguguuuaaagaaaaggucgacacgcgcacccaggagccuaaagaggggacaaagaagcugaugaaaaucaccgcugaauggcuuuggaaggagcugggcaaaaagaaaacacccagaauguguacccgggaagaguucacacgcaaggugagaucuaaugccgcucucggcgccauuuuuaccgaugagaacaaauggaaguccgcgcgggaagccguugaggacagcggguucugggaacugguggauaaggagagaaaucugcaucucgaaggaaaaugcgagacgugugucuauaacaugaugggcaagcgggagaaaaagcugggcgaauuugggaaagcuaagggaucucgcgccaucugguacauguggcuuggcgcuagauuccuggaguuugaagcccucggguuccugaaugaggaccacugguuuucccgggaaaacagccuuuccggaguggagggcgaggggcugcauaagcucggcuacauucugcgcgauguuagcaaaaaggaaggaggcgccauguaugcggacgauaccgcugggugggacacaagaaucacccuggaggaucucaaaaaugaagagauggugacaaaccacauggaaggagagcauaagaaacuggccgaggccauuuucaaacuuaccuaccaaaauaaggucgugcggguucagcgcccuacgcccagaggcacagugauggacaucaucucucggcgcgaccagagagggagcggacaggucgugaccuauggccugaacacauucaccaacauggaagcucaacucauucggcagauggagggggaaggcgucuuuaaauccauccagcaacugacggugaaggaggagauugccguuaaaaauuggcuuauccgcgugggaagagaacggcugucucgcauggcuauuagcggcgaugacugcgucgugaagccgcucgaugacagauucgccuccgcgcugaccgcccugaacgauauggggaaagugcggaaggacauccagcagugggagccuucuagaggauggaaugauuggacacagguucccuuuugcagccaccacuuccaugaacucaucaugaaggacggccgcgugcuggucgugcccugucggaaccaagaugagcuuauugggagagcucgcaucucccagggagccggcuggucucugcgggaaaccgcuugccucgggaaaagcuacgcccagauguggucccugauguauuuucacagacgcgaccuucggcuggcggccaaugcuauuuguagcgccguuccuucucauuggaucccgacauccagaaccacauggagcauucacgcuacccacgaguggaugacgacagaggauaugcucaccguguggaaccgcgucuggauccaggaaaaucccuggauggaggacaagaccccuguggaaucuugggaggaaauccccuaccugggcaaacgggaggaucaauggugcggaucccugauuggccucacaagcagagccaccugggcuaagaacauccagacagccauuaaucagguccgcucccugaucgggaacgaggaauauacggacuacaugccuucuaugaaacgguucagacgggaggaagaggaagcgggagugcuuugguga

SEQ ID NO: 19621 - RNA, 9876 nt, Artificial Sequence
  derived and/or modified CDS sequence (opt5) from DENV-2__KM279557__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggucgugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucguuaacucccuggugaccgcuggacauggccagaucgauaauuuuucucuggggguccuuggaauggcgcuguuccuggaggaaaugcugcgcacacgggugggcaccaagcacgccauucuccugguugcugugagcuuugucacgcuuaucaccgggaacauguccuucagagaccugggacgcgugaugguuauggugggcgccacaaugaccgaugacauuggcaugggggucacauaccucgcccugcuggcugccuuuaaggugagacccaccuucgcggcuggacuucugcuccggaaacugacgucuaaggagcucaugaugacaaccaucggcaucgugcugcuuagccaauccacaauuccugagucuauccuggaacucaccgaugcccuggcccuggggaugaugguccuuaaaauuguucgcaauauggagaaguaucagcuggcugugaccaucauggccauucucugcgugcccaacgcggucauccugcagaaugcuuggaaagugagcuguacaacgcucgccguuguguccgucagcccucugcuucugaccucuucccaacagaaggccgacuggaucccccucgcucugacaauuaagggacugaacccuaccgccaucuuucuuacaacccugagcagaacgucuaaaaagcgguccuggccccucaaugaagcuauuauggccgugggcaugguuagcauccuggcgucuucccuccugaaaaacgauauuccgaugacagggccucuuguggccggaggccugcugaccgucugcuacgugcucaccggccgcagcgcugaccuggagcuugaaagagccgcugacguccggugggaggagcaggccgaaaucuccgggagcucucccauccugagcauuacaaucuccgaggauggaucuaugagcauuaagaaugaagaggaggaacagacccucacaauccugauucgcacgggccuccuggugaucuccgggcuuuucccuguuucuauucccaucaccgccgcugcgugguaucugugggaggugaaaaagcaaagagccggaguccugugggacgugccgagcccucccccuguuggcaaagcugaacucgaggauggggccuaccggaucaagcagaagggcauucugggcuauucccagaucggcgccgggguguacaaagaaggaacauuucacaccauguggcaugucacacgcggcgcugugcuuaugcacaaggggaaaagaauugagcccucuugggccgacgugaagaaagaucugaucagcuacggaggcggguggaagcucgagggagaauggaaggagggcgaagagguucagguccuggcgcucgaacccggcaaaaacccucgggcugugcaaaccaagccggggcuguucaaaacgaacaccggaacaauuggcgccgugucccuugacuuuagccccgggaccucuggauccccuaucgucgauaagaaaggcaaggugguugggcuguauggaaauggcguggucacaagaagcggcaccuacgugucugccaucgcucagacagagaaguccauugaggacaaccccgaaaucgaggaugacauuuuccgcaaaaagcggcugacgaucauggaucuccauccuggggccggaaaaaccaagagauaucugcccgcgauuguucgcgaagcuaucaaacggggccuuagaacacugauccucgccccuacccgcguggucgccgcugagauggaagaggcccugcgggggcucccgauuagauaccagacccccgcuauccgcgccgagcacacaggacgggaaauuguggaccugaugugucaugcgacguucaccaugagacuucugagcccuauccggguucccaauuauaaccugauuaucauggaugaggcccacuuuacagacccugcuuccauugccgcucgcggcuacaucucuaccagaguggaaaugggggaggccgccggcaucuucaugacagcuacacccccgggaagccgggacccuuuuccccaguccaaugcgcccauuauggaugaggaacgcgagaucccugaaagaagcuggaacucuggccacgagugggucacggacuucaaggggaagacagugugguuugugcccuccauuaaagccggaaaugauaucgcugccugccuccggaagaacggcaaaaaggucauucaacugagcagaaaaaccuucgacucugaauauaucaagacccgcacaaaugauugggacuuuguugugaccacagauaucagcgagaugggggccaacuucaaggcugagcgggugauugacccuagacgcuguaugaaaccggucauccuuaccgauggagaggaacgggugauucuggccggccccaugccuguuacgcauuccucugcggcucagagacgcgggcgggugggcagaaaucccaagaacgaaaaugaccaguacaucuacaugggagagccucucgaaaacgaugaggacugcgcccacuggaaagaggccaagaugcugcuggacaauauuaacacacccgaaggcaucaucccgagcauguuugagccugaacgcgagaaagucgaugcuauugacggggaauauagacuccggggagaggcccgcaagaccuucguggaucuuaugagacggggcgaccugcccguuuggcuggcguaccgcguggccgcugaggggaucaacuaugccgauagacggugguguuuugacggagucaaaaauaaccaaauucucgaagagaauguggaagucgagaucuggacaaaggagggcgaaagaaagaaacugaagccucgcuggcuugaugcucggauuuacuccgacccccuggcccucaaagaguucaaggaguucgcugccgggagaaaaucucugacccugaaccucaucacggagaugggccgccuuccuaccuuuaugacacagaaggcgaagaaugcccuggauaaccuggcugugcuccauaccgccgaagcuggaggccgggccuauaaucacgcccugagcgagcuucccgagacacuggaaacccuccugcugcucacacuucuggcuaccguuacagggggaauuuuccuguuucucauguccggcaaagggaucggaaagaugacacugggcaugugcugcaucauuaccgcgagcauccuucugugguacgcccagauucagccgcacuggaucgcugccucuauuauccucgaguucuuucugaucgugcugcucauuccugaacccgagaaacaaagaacaccccaggacaaccagcuuacauauguggucaucgccauucugaccguuguggcugccacaauggcgaaugaaaugggcuuccuggagaagacgaaaaaggauuuugggcucggauccaucaccacacagcaaccugagagcaacauucuggacaucgaucuucggccggccuccgcuuggacccuguacgccguggcuacaaccuucaucacgcccaugcuccgccauucuauugaaaauagcuccgucaacgugucucugaccgccaucgcgaaucaggccacaguucugaugggccucgggaagggauggccucuuagcaaaauggacauuggcgugccccugcuggcuaucggguguuacucccaggucaacccuauuacccucacagccgcucugcuucugcucguggcccacuaugcuaucauuggacccggccugcaggccaaggcgaccagagaggcccaaaaacgggcugccgcuggcaucaugaagaauccuacggucgacgggaugacagugaucgaucuggacccgauucccuacgauccuaaauuugaaaagcagcucggacagguuaugcuucuggugcugugcgucacccaggugcucaugaugcgcacaaccugggcccugugugaggcccuuacccuggcgacaggccccaucagcacgcucugggaagggaacccuggaagauucuggaauaccacaauugcuguuucuauggccaacaucuuucggggcuccuaucuggcuggggccggacuccuguucagcauuaugaagaacaccgccaauacacgcagaggcaccggcaacacgggggagacacuuggagagaaauggaagaaucggcugaacgcucugggcaaaucugaauuucaaaucuacaagaaauccgggauccaggagguggaccgcacccucgccaaggaaggaauuaaaagaggcgagaccgaucaucacgcggucagccgggggucugccaagcugagaugguucguggagcgcaaucuugugacacccgaaggaaagguugucgaccugggcugcggcagagggggauggagcuauuacuguggcgggcucaaaaacgugaaggaggugaaaggacugaccaagggcgggccgggacaugaagaaccuauccccauguccacauauggcuggaaucuggucagacuccagucuggcguugauguguucuuuacgcccccugaaaaaugcgacacccuucugugugauauuggggagagcucccccaacccuacaguggaggcuggacgcacccugcggguccucaaucugguggaaaacuggcuuaauaacaauacacaauucugcaucaagguucugaacccguacaugcccagcgugauugagaagauggaagcccuccagagaaaauacggcggggcucugguccgcaauccucugucccggaacucuacccacgagauguauugggugagcaacgccuccggaaauaucguuucuagcgugaacaugaucuccagaaugcucauuaaucgcuuuacgaugcggcacaagaaagcgaccuacgaacccgacgucgaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggccuaucacggcagcuacgagacaaaacaaaccgggucugcuuccagcauggugaacggagugguccggcugcucacgaagccgugggacguuauuccuauggugacacagauggccaugaccgauaccacacccuucggccagcagagaguguuuaaagaaaaggucgacacgcgcacccaagagccuaaagaggggacaaagaagcugaugaaaaucaccgcugaauggcuuuggaaggagcugggcaaaaagaaaacacccagaauguguacccgggaagaguucacacgcaaggugagaucuaaugccgcucucggcgccauuuuuaccgaugagaacaaauggaaguccgcgcgggaagccguugaggacagcggguucugggaacugguggauaaggagagaaaucugcaccucgaaggaaaaugcgagacgugugucuauaacaugaugggcaagcgggagaaaaagcugggcgaauuugggaaagcuaagggaucucgcgccaucugguacauguggcuuggcgcuagauuccuggaguuugaagcccucggguuccugaaugaggaccauugguuuucccgggaaaacagccuuuccggaguggagggcgaggggcugcacaagcucggcuacauucugcgcgauguuagcaaaaaggaaggaggcgccauguaugcggacgauaccgcugggugggacacaagaaucacccuggaggaucucaaaaaugaagagauggugacaaaccauauggaaggagagcacaagaaacuggccgaggccauuuucaaacuuaccuaccagaauaaggucgugcggguucagcgcccuacgcccagaggcacagugauggacaucaucucucggcgcgaccagagagggagcggacaagucgugaccuauggccugaacacauucaccaacauggaagcucagcucauucggcagauggagggggaaggcgucuuuaaauccauccaacagcugacggugaaggaggagauugccguuaaaaauuggcuuauccgcgugggaagagaacggcugucucgcauggcuauuagcggcgaugacugcgucgugaagccgcucgaugacagauucgccuccgcgcugaccgcccugaacgauauggggaaagugcggaaggacauccagcagugggagccuucuagaggauggaaugauuggacacaaguucccuuuugcagccaucacuuccacgaacucaucaugaaggacggccgcgugcuggucgugcccugucggaaccaggaugagcuuauugggagagcucgcaucucccagggagccggcuggucucugcgggaaaccgcuugccucgggaaaagcuacgcccagauguggucccugauguauuuucauagacgcgaccuucggcuggcggccaauagcauuuguucugcuguuccuucccacuggaucccgacaagcagaaccacauggucuauucaugccacccacgaguggaugacgacagaggauaugcucaccguguggaaccgcgucuggauccaagaaaaucccuggauggaggacaagaccccuguggaauccugggaggaaauccccuaccugggcaaacgggaggaucaguggugcggaagccugauuggccucacauccagagcuaccugggccaagaacauccagacagcuauuaaucagguccgcucucugaucgggaacgaggaauauacggacuacaugccuagcaugaaacgguucagacgggaggaagaggaagccggagugcuuugguga

SEQ ID NO: 19622 - RNA, 9876 nt, Artificial Sequence
  derived and/or modified CDS sequence (opt5) from DENV-2__KM279591__SS-prME
accgccggaaucauuaucaugaugauucccaccgugauggcuuuccaccugacgaccagaaacggggaaccucauaugaucgucagccggcaggaaaagggaaaaucccuccuguuuaagacagagaauggaguuaacaugugcacccuuauggccauggaccugggggaacucugugaggauaccauuaccuacaauugcccgcugcuucgccaaaacgaacccgaggacaucgauuguuggugcaauucuacaagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaaggugagacccacguucgcggcuggacuucugcuccggaaacugacauccaaggagcucaugaugaccacaaucggcaucgugcugcuuucucaaagcaccauuccugaguccauccuggaacucaccgaugcccuggcccuggggaugaugguccuuaaaauuguucgcaauauggagaaguaucagcuggcugugacaaucauggccauucucugcgugcccaacgcggucauccugcagaaugcuuggaaagugucuuguacgacccucgccguugugagcgucuccccucugcuucugacaagcucucaacagaaggccgacuggaucccccucgcucugaccauuaagggacugaacccuacagccaucuuucuuaccacgcuguccagaacaagcaaaaagcggucuuggccccucaaugaagcuauuauggccgugggcaugguuuccauccuggcgagcucucuccugaaaaacgauauuccgaugaccgggccucuuguggccggaggccugcugaccgucugcuacgugcucacaggccgcuccgcugaccuggagcuugaaagagccgcugacguccggugggaggagcaggccgaaaucagcggguccagccccauccugucuauuaccaucagcgaggauggauccaugucuauuaagaaugaagaggaggaacagacacucacgauccugauucgcaccggccuccuggugaucagcgggcuuuucccuguuuccauucccaucacagccgcugcgugguaucugugggaggugaaaaagcaaagagccggaguccugugggacgugccgucuccucccccuguuggcaaagcugaacucgaggauggggccuaccggaucaagcagaagggcauucugggcuauagccagaucggcgccgggguguacaaagaaggaaccuuucacacaauguggcaugucacccgcggcgcugugcuuaugcacaaggggaaaagaauugagcccuccugggccgacgugaagaaagaucugaucucuuacggaggcggguggaagcucgagggagaauggaaggagggcgaagagguucagguccuggcgcucgaacccggcaaaaacccucgggcugugcaaacgaagccggggcuguucaaaaccaacacaggaaccauuggcgccgugagccuugacuuuucccccgggacaagcggaucuccuaucgucgauaagaaaggcaaggugguugggcuguauggaaauggcguggucaccagauccggcacauacgugagcgccaucgcucagacggagaagucuauugaggacaaccccgaaaucgaggaugacauuuuccgcaaaaagcggcugaccaucauggaucuccauccuggggccggaaaaacaaagagauaucugcccgcgauuguucgcgaagcuaucaaacggggccuuagaacccugauccucgccccuacccgcguggucgccgcugagauggaagaggcccugcgggggcucccgauuagauaccagacacccgcuauccgcgccgagcacacgggacgggaaauuguggaccugaugugucaugcgaccuucacaaugagacuucuguccccuauccggguucccaauuauaaccugauuaucauggaugaggcccacuuuaccgacccugcuagcauugccgcucgcggcuacaucuccacaagaguggaaaugggggaggccgccggcaucuucaugaccgcuacgcccccgggaucucgggacccuuuuccccagagcaaugcgcccauuauggaugaggaacgcgagaucccugaaagauccuggaacagcggccacgagugggucacagacuucaaggggaagaccgugugguuugugcccucuauuaaagccggaaaugauaucgcugccugccuccggaagaacggcaaaaaggucauucaacuguccagaaaaaccuucgacagcgaauauaucaagacacgcaccaaugauugggacuuuguugugacaaccgauaucucugagaugggggccaacuucaaggcugagcgggugauugacccuagacgcuguaugaaaccggucauccuuacggauggagaggaacgggugauucuggccggccccaugccuguuacacauagcuccgcggcucagagacgcgggcgggugggcagaaaucccaagaacgaaaaugaccaguacaucuacaugggagagccucucgaaaacgaugaggacugcgcccacuggaaagaggccaagaugcugcuggacaauauuaacacccccgaaggcaucaucccgucuauguuugagccugaacgcgagaaagucgaugcuauugacggggaauauagacuccggggagaggcccgcaagacauucguggaucuuaugagacggggcgaccugcccguuuggcuggcguaccgcguggccgcugaggggaucaacuaugucgauagacggugguguuuugacggagugaaaaauaaccaaauucucgaagagaaugucgaaguggagaucuggaccaaggagggcgaaagaaagaaacugaagccucgcuggcuugaugcccggauuuacagcgacccccuggcucucaaagaguucaaggaguucgccgcugggagaaaaucccugacgcugaaccucaucaccgagaugggccgccuuccuacauuuaugacccagaaggccaagaaugcgcuggauaaccuggccguucuccauacagcugaagccggaggccgggcuuauaaucacgcccugucugagcuucccgagacccuggaaacacuccugcugcucacccuucuggccacggugacagggggaauuuuccuguuucucaugagcggcaaagggaucggaaagaugacccugggcaugugcugcaucauuaccgcuuccauccuucugugguacgcgcagauucagccgcacuggaucgccgcuagcauuauccucgaguucuuucugaucgugcugcucauuccugaacccgagaaacaaagaacaccccaggacaaccagcuuaccuaugucguuaucgccauucugacagugguggccgcuacgauggccaaugaaaugggcuuccuggagaagaccaaaaaggauuuugggcucggaucuaucacaacccagcaaccugaguccaacauucuggacaucgaucuucggccggcgagcgccuggacacuguacgcugucgccaccacguucaucacccccaugcuccgccauuccauugaaaauucuagcgugaacguuucccugacagcuaucgccaaucaggcgaccgugcugaugggccucgggaagggauggccucuuucuaaaauggacauuggcgucccccugcuggccaucggguguuacagccaggugaacccuauuacacucaccgcugcccugcuucugcucgucgcucacuaugccaucauuggacccggccugcaggcuaaggccacgagagaggcgcaaaaacgggccgcugccggcaucaugaagaauccuacaguggacgggaugaccguuaucgaucuggacccgauucccuacgauccuaaauuugaaaagcagcucggacaggugaugcuucugguccugugcgugacacagguucucaugaugcgcaccaccugggcucugugugaggcccuuacacuggccacgggccccaucuccacccucugggaagggaacccuggaagauucuggaauacaaccauugcggugagcauggcuaacaucuuucggggcucuuaucuggccggggcuggacuccuguucuccauuaugaagaacacagccaauacccgcagaggcacgggcaacacaggggagacccuuggagagaaauggaagaaucggcugaacgcccugggcaaaagcgaauuucaaaucuacaagaaaucugggauccaggaggucgaccgcacccucgcuaaggaaggaauuaaaagaggcgagacagaucaucacgccgugucccgggggagcgcgaagcugagaugguucguggagcgcaaucuuguuacccccgaaggaaaggucguggaccugggcugcggcagagggggauggucuuauuacuguggcgggcucaaaaacgugaaggaggucaaaggacugacaaagggcgggccgggacaugaagaaccuauccccaugagcacguauggcuggaaucugguuagacuccaguccggcguggauguguucuuuacacccccugaaaaaugcgacacacuucugugugauauuggggagucuagccccaacccuaccgucgaggccggacgcacacugcgggugcucaaucugguugaaaacuggcuuaauaacaauacccaauucugcaucaaggugcugaacccguacaugcccuccgucauugagaagauggaagcucuccagagaaaauacggcggggcccuggugcgcaauccucugagccggaacuccacgcacgagauguauuggguuucuaacgcuagcggaaauaucguguccucugucaacaugaucagcagaaugcucauuaaucgcuuuaccaugcggcacaagaaagccacauacgaacccgacguggaucuuggcuccgggaccagaaacaucggaauugagucugagacaccuaaucuggacaucauuggcaagcgcaucgagaagaucaagcaggagcaugaaaccagcuggcacuaugaucaggaccaucccuacaagacaugggcguaucacggcuccuacgagaccaaacaaacggggagcgccucuuccauggugaacggagucguucggcugcucacaaagccgugggacgugauuccuauggugacccagauggcuaugaccgauacaacgcccuucggccagcagagagucuuuaaagaaaagguggacacccgcacacaagagccuaaagaggggaccaagaagcugaugaaaaucacagccgaauggcuuuggaaggagcugggcaaaaagaaaacccccagaauguguacacgggaagaguucacccgcaagguuagaagcaaugcugcccucggcgcuauuuuuacggaugagaacaaauggaagucugcccgggaagcgguggaggacuccggguucugggaacuggucgauaaggagagaaaucugcaccucgaaggaaaaugcgagaccuguguguauaacaugaugggcaagcgggagaaaaagcugggcgaauuugggaaagccaagggaagccgcgcuaucugguacauguggcuuggcgccagauuccuggaguuugaagcucucggguuccugaaugaggaccauugguuuucucgggaaaacucccuuagcggaguugagggcgaggggcugcacaagcucggcuacauucugcgcgauguguccaaaaaggaaggaggcgccauguaugccgacgauacagcggggugggacaccagaaucacacuggaggaucucaaaaaugaagagauggucaccaaccauauggaaggagagcacaagaaacuggcugaggccauuuucaaacuuacguaccagaauaaggugguucgggugcagcgcccuacacccagaggcaccgucauggacaucaucagccggcgcgaccagagagggucuggacaaguggucacauauggccugaacaccuucacgaacauggaagcccagcucauucggcagauggagggggaaggcguguuuaaaagcauccaacagcugaccguuaaggaggagauugcugugaaaaauuggcuuauccgcgucggaagagaacggcugucccgcauggccauuucuggcgaugacugcguggugaagccgcucgaugacagauucgcuagcgcccugacagcgcugaacgauauggggaaaguucggaaggacauccagcagugggagccuuccagaggauggaaugauuggacccaagugcccuuuugcucucaucacuuccacgaacucaucaugaaggacggccgcguccuggugguucccugucggaaccaggaugagcuuauugggagagcccgcaucagccagggagcuggcuggucccugcgggaaacagccugccucgggaaaucuuacgcucagauguggagccugauguauuuucauagacgcgaccuucggcuggccgcgaaugccauuuguuccgcugugccuagccacuggaucccgaccucuagaacaaccugguccauucaugccacgcacgaguggaugacaaccgaggauaugcucaccgucuggaaccgcguguggauccaagaaaaucccuggauggaggacaagacaccugucgaaagcugggaggaaauccccuaccugggcaaacgggaggaucaguggugcggaucucugauuggccucaccuccagagcuacaugggccaagaacauccagacggcuauuaaucaggugcgcagccugaucgggaacgaggaauauaccgacuacaugccuuccaugaaacgguucagacgggaggaagaggaagccggaguucuuugguga

SEQ ID NO: 19623 - RNA, 9876 nt, Artificial Sequence
  derived and/or modified CDS sequence (opt5) from DENV-2__KM279558__SS-prME
accgccggaaucauuaucaugaugauucccaccgugauggcuuuccaccugacgaccagaaacggggagccucauaugaucgugagccggcaggaaaagggaaaaucccuccuguuuaagaccgagaauggcguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaaucacaccccaguccagcaucacagaagcugagcugaccggcuacgggacgguuaccauggaauguucuccucggacaggacuugacuucaaugagauggugcugcuccagauggaaaacaaggccuggcugguccaccgccaaugguuucuugaucugccccucccguggcugccuggcgcugacacccagggguccaacuggauucagaaagagacacuggugaccuucaagaauccccacgccaagaaacaggauguugugguccucggaagccaagagggcgccaugcauacggcucugacaggggcgaccgaaauccagauguccucuggcaaccuucuguuuacaggacaccucaagugcagacugcggauggacaaacuucagcugaagggcaugagcuauuccauguguaccgggaaauucaagguggucaaggagauugccgaaacccaacauggaacaaucgugauuagaguucaguacgagggcgacgggagcccuugcaaaauccccuucgagaucauggaucucgaaaagcgccacgugcugggacggcugauuacggucaaucccaucgugaccgagaaagacucuccuguuaacauugaagcugagccgcccuuuggcgauuccuacaucauuaucgggguggaaccuggccagcucaagcugagcugguucaaaaagggaucuagcauuggccagauguuugagacaaccaugagaggggccaagcgcauggccauccuuggagacacagcuugggauuucggcucccucggcggggucuuuaccucuaucgggaaagcccuccaucaaguguucggggcgauuuauggcgcugccuuuagcggaguguccuggacgaugaagauccugauuggcguugucaucacauggauugggaugaauagccggucuaccucccugagcgugucucuugugcucgucggagugguuacccuguaccugggcgugaugguccaggccgacuccgggugugugguuagcuggaaaaacaaggagcucaaaugcggauccggcaucuucaucacagauaaugugcacaccuggacagaacaguauaaguuucagcccgagucuccuagcaagcuggcuuccgccauucaaaaagcucacgaagaggggaucuguggcauuagaucugucacgcgccuugaaaaccugauguggaagcagaucacccccgagcucaaucauauucugacagagaacgaagugaaacugaccaucaugacaggagacaucaagggcauuaugcaggccgggaaacggagccuuagaccgcagccuaccgagcucaaguacuccuggaaagcguggggaaaggccaagaugcugagcacggaacugcacaaucauaccuuccucaucgauggccccgagacagcugaaugcccuaacaccaaucgcgccuggaacucucuggagguugaggacuauggguuuggaguguucacaaccaauauuuggcuuaaacugaaggaacggcaagaugucuuuugugacuccaaacucaugagcgcugccaucaaggacaacagagcggugcacgccgauaugggcuacuggauugagucugcucugaacgacacauggaaaaucgaaaaggccuccuucaucgaggucaagagcugccacuggcccaaaucucauacccuguggagcaauggcguccuugaguccgaaaugauuaucccuaagaacuucgcugggcccguuagccagcacaauuaucgcccgggauaccauacgcagacagccggcccuuggcaccucgggcggcuggagauggauuuugacuucugugaaggaaccaccgugguggucacagaggauugcggcaacagagggcccucucugcggaccacgacagccuccggaaaacucauuaccgaauggugcugucgcagcugcacacugcccccucuuagauaccggggcgaggacggcuguugguaugggauggagaucagaccgcugaaggaaaaagaggaaaaucucgugaacucccugguuaccgcuggacauggccagauugauaauuuuucucugggggugcuuggaauggcgcuguuccuggaggaaaugcugcgcacacgggucggcaccaagcacgccauccuccugguggcuguuagcuuugugacgcuuauuaccgggaacauguccuucagagaccugggacgcgucauggugaugguuggcgccacaaugaccgaugacaucggcaugggggugacauaccucgcccugcuggcugccuuuaaggucagacccaccuucgcggcuggacuucugcuccggaaacugacgucuaaggagcucaugaugacaaccaucggcauugugcugcuuagccaauccacaaucccugagucuauucuggaacucaccgaugcccuggcccuggggaugauggugcuuaaaaucguccgcaauauggagaaguaucagcuggcuguuaccauuauggccaucagcugcgugcccaacgcggugauccuccagaaugcuuggaaagucuccuguacaacgcuggccgugguuagcgugucuccucuccugcuuaccuccagccaacagaaggccgacuggauuccccuggcucucacaaucaagggacugaacccuaccgccauuuuucugacaacccuuucuagaacguccaaaaagcggagcuggccccugaaugaagcuaucauggccgucggcauggugucuauucucgcguccagccugcucaaaaacgauaucccgaugacagggccucugguugccggaggccuucugaccgugugcuacguccugaccggccgcuccgcugaccucgagcuggaaagagccgcugacgugcggugggaggagcaggccgaaaucagcgggucuagccccauucuuuccaucacaauuucugaggauggaagcauguccaucaagaaugaagaggaggaacagacccugacaauucucauccgcacgggccugcucgucauuucugggcuguucccugugagcauccccaucaccgccgcugcgugguaucuuugggagguuaaaaagcaaagagccggagugcugugggacgucccguccccucccccugugggcaaagcugaacuggaggauggggccuaccggauuaagcagaagggaauccucggcuauucucagauuggcgccgggguuuacaaagaaggaacauuucacaccauguggcaugugacacgcggcgcuguccugaugcacaaggggaaaagaaucgagcccagcugggccgacgugaagaaagaucuuauuuccuacggaggcggguggaagcuggagggagaauggaaggagggcgaagaggugcagguucucgcgcuggaacccggcaaaaacccucgggcuguccaaaccaagccgggacucuucaaaacgaacaccggaacaaucggcgccgugagccuggacuuuucucccgggaccuccggaagcccuaucguggauaagaaaggcaaggucguggggcuuuauggaaauggcguugugacaagaucuggcaccuacgucuccgccauugcucagacagaaaagagcaucgaggacaaccccgaaauugaggaugacaucuuccgcaaaaagcggcugacgauuauggaucugcauccuggggccggaaaaaccaagagauaucuccccgcgaucgugcgcgaagcuaucaaacggggccugagaacacuuauucuggccccuacccgcguuguggccgcugagauggaagaggcccuccgggggcugccgaucagauaccagacccccgcuauucgcgccgagcacacaggacgggaaaucgucgaccucaugugucaugcgacguucaccaugagacugcuuuccccuauucgggugcccaauuauaaccugaucauuauggaugaggcccacuuuacagacccugcuucuaucgccgcucgcggcuacaucagcaccagaguugaaaugggggaggccgccggcauuuucaugacagcuacacccccgggaucccgggacccuuuuccccagagcaaugcgcccaucauggaugaggaacgcgagauuccugaaagaucuuggaacuccggccacgagugggugacggacuucaaggggaagacagucugguuugugcccagcaucaaagccggaaaugauauugcugccugccugcggaagaacggcaaaaaggugauccaacucucuagaaaaaccuucgacagcgaauauaucaagacccgcacaaaugauugggacuuugucguuaccacagauauuuccgagaugggggccaacuucaaggcugagcgggugaucgacccuagacgcuguaugaaaccggugauucugaccgauggagaggaacgggucauccuugccggccccaugccugugacgcauucuagcgcggcucagagacgcgggcggguuggcagaaaucccaagaacgaaaaugaccaguacauuuacaugggagagccucuggaaaacgaugaggacugcgcccacuggaaagaggccaagaugcuccuggacaauaucaacacacccgaaggcaucauuccguccauguuugagccugaacgcgagaaaguggaugcuaucgacggggaauauagacugcggggagaggcccgcaagaccuucgucgaucucaugagacggggcgaccuucccguguggcuggcguaccgcguugccgcugaggggauuaacuaugccgauagacggugguguuuugacggagugaaaaauaaccaaauccuggaagagaaugucgaaguggagauuuggacaaaggagggcgaaagaaagaaacucaagccucgcuggcuggaugcucggaucuacucugacccccuugcccugaaagaguucaaggaguucgcugccgggagaaaaagccucacccugaaccugauuacggagaugggccgccucccuaccuuuaugacacagaaggcgaagaaugcccuugauaaccuggcuguccugcauaccgccgaagcuggaggccgggccuauaaucacgcccucuccgagcugcccgagacacuugaaacccugcuccugcugacacuccuugcuaccgugacagggggaaucuuccuguuucugaugagcggcaaagggaucggaaagaugacacucggcaugugcugcauuaucaccgcgucuauucugcuuugguacgcccagauccagccgcacuggauugcugccuccaucauccuggaguucuuucucauuguucugcugaucccugaacccgagaaacaaagaacaccccaggacaaccagcucacauauguggugauugccauccuuaccgucguugcugccacaauggcgaaugaaaugggcuuccuggagaagacgaaaaaggauuuugggcugggaagcauuaccacacagcaaccugaguccaacauccucgacaucgaucugcggccggccucugcuuggacccuuuacgccguggcuacaaccuucauuacgcccaugcugcgccauagcaucgaaaauuccucugugaacgucagccucaccgccauugcgaaucaggccacagugcugaugggccuggggaagggauggccucucuccaaaauggacaucggcguuccccuucuggcuauuggguguuacagccaggugaacccuaucacccugacagccgcucuccugcuucuggucgcccacuaugcuauuaucggacccggccuccaggccaaggcgaccagagaggcccaaaaacgggcugccgcuggcaucaugaagaauccuacgguggacgggaugacagucauugaucuggacccgauccccuacgauccuaaauuugaaaagcagcugggacaggugaugcuccuuguucugugcgugacccagguccugaugaugcgcacaaccugggcccucugugaggcccugacccuugcgacaggccccauuucuacgcugugggaagggaacccuggaagauucuggaauaccacaaucgcuguguccauggccaacauuuuucggggcagcuaucucgcuggggccggacugcuguucucuaucaugaagaacaccgccaauacacgcagaggcaccggcaacacgggggagacacucggagagaaauggaagaaucggcuuaacgcucugggcaaauccgaauuucaaaucuacaagaaaagcgggauucaggagguugaccgcacccuggccaaggaaggaaucaaaagaggcgagaccgaucaucacgcggugucucgggggagcgccaagcucagaugguucgucgagcgcaaucuggugacacccgaaggaaaggugguugaccuuggcugcggcagagggggaugguccuauuacuguggcgggcugaaaaacgucaaggaggugaaaggacucaccaagggcgggccgggacaugaagaaccuauucccaugucuacauauggcuggaaucuggugagacugcagagcggcgucgauguuuucuuuacgcccccugaaaaaugcgacacccuccuuugugauaucggggaguccagccccaacccuacaguggaggcuggacgcacccugcgggugcugaaucucgucgaaaacuggcugaauaacaauacacaauucugcauuaaggugcuuaacccguacaugcccuccguuaucgagaagauggaagcccugcagagaaaauacggcggggcucucgugcgcaauccucugucucggaacagcacccacgagauguauugggucuccaacgccucuggaaauaucgugagcuccguuaacaugauuucuagaaugcugaucaaucgcuuuacgaugcggcacaagaaagcgaccuacgaacccgacguggaucucggcagcgggacaagaaacauuggaaucgaguccgagaccccuaaucuugacauuaucggcaagcgcaucgagaagauuaagcaggagcaugaaacaagcuggcacuaugaucaggaccaucccuacaagaccugggccuaucacggcucuuacgagacaaaacaaaccggguccgcuagcucuauggucaacggaguggugcggcugcugacgaagccgugggacgucaucccuaugguuacacagauggccaugaccgauaccacacccuucggccagcagagaguguuuaaagaaaagguggacacgcgcacccaagagccuaaagaggggacaaagaagcucaugaaaauuaccgcugaauggcuguggaaggagcuuggcaaaaagaaaacacccagaauguguacccgggaagaguucacacgcaaggucagauccaaugccgcucugggcgccaucuuuaccgaugagaacaaauggaaaagcgcgcgggaagccguggaggacucuggguucugggaacucguugauaaggagagaaaucugcaccuggaaggaaaaugcgagacguguguguauaacaugaugggcaagcgggagaaaaagcucggcgaauuugggaaagcuaagggaucccgcgccauuugguacauguggcugggcgcuagauuccuugaguuugaagcccugggguuccucaaugaggaccauugguuuagccgggaaaacucccugagcggagucgagggcgaggggcuucacaagcugggcuacauccuccgcgaugugucuaaaaaggaaggaggcgccauguaugcggacgauaccgcugggugggacacaagaauuacccuggaggaucugaaaaaugaagagaugguuacaaaccauauggaaggagagcacaagaaacucgccgaggccaucuucaagcugaccuaccagaauaaggugguccgggugcagcgcccuacgcccagaggcacaguuauggacaucauuagccggcgcgaccagagaggguccggacaaguggucaccuauggccuuaacacauucaccaacauggaagcucagcugauccggcagauggagggggaaggcguguuuaaaucuauucaacagcucacggucaaggaggagaucgccgugaaaaauuggcugauucgcguuggaagagaacggcuuagccgcauggcuaucuccggcgaugacugcguggucaagccgcuggaugacagauucgccucugcgcucaccgcccugaacgauauggggaaagugcggaaggacauccagcagugggagccuagcagaggauggaaugauuggacacaagugcccuuuugcucccaucacuuccacgaacugauuaugaaggacggccgcguucucgugguccccugucggaaccaggaugagcugaucgggagagcucgcauuucucagggagccggcuggagccuucgggaaaccgcuugccuggggaaauccuacgcccagauguggagccucauguauuuucauagacgcgaccugcggcuugcggccaaugcuaucuguucugccgugccuucccacuggauuccgacaagcagaaccacauggucuauccaugcuacccacgaguggaugacgacagaggauaugcugaccguuuggaaccgcguguggauccaagaaaaucccuggauggaggacaagaccccugucgaauccugggaggaaauucccuaccucggcaaacgggaggaucaguggugcggaagccugaucggccugacauccagagccaccugggcuaagaacauucagacagccaucaaucaggugcgcucucucauugggaacgaggaauauacggacuacaugccuagcaugaaacgguucagacgggaggaagaggaagcgggaguccugugguga

SEQ ID NO: 19624 - RNA, 9876 nt, Artificial Sequence
  derived and/or modified CDS sequence (opt5) from DENV-2__KM279564__SS-prME
accgccggaaucauuaucaugaugauucccaccgugauggcuuuccaccugacgaccagaaacggggagccucauaugaucgugagccggcaggaaaagggaaaaucccuccuguuuaagaccgagaauggcguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaaucacaccccaguccagcaucacagaagcugagcugaccggcuacgggacgguuaccauggaauguucuccucggacaggacuugacuucaaugagauggugcugcuccagauggaaaacaaggccuggcugguccaccgccaaugguuucuugaucugccccucccguggcugccuggcgcugacacccagggguccaacuggauucagaaagagacacuggugaccuucaagaauccccacgccaagaaacaggauguugugguccucggaagccaagagggcgccaugcauacggcucugacaggggcgaccgaaauccagauguccucuggcaaccuucuguuuacaggacaccucaagugcagacugcggauggacaaacuucagcugaagggcaugagcuauuccauguguaccgggaaauucaagguggucaaggagauugccgaaacccaacauggaacaaucgugauuagaguucaguacgagggcgacgggagcccuugcaaaauccccuucgagaucauggaucucgaaaagcgccacgugcugggacggcugauuacggucaaucccaucgugaccgagaaagacucuccuguuaacauugaagcugagccgcccuuuggcgauuccuacaucauuaucgggguggaaccuggccagcucaagcugagcugguucaaaaagggaucuagcauuggccagauguuugagacaaccaugagaggggccaagcgcauggccauccuuggagacacagcuugggauuucggcucccucggcggggucuuuaccucuaucgggaaagcccuccaucaaguguucggggcgauuuauggcgcugccuuuagcggaguguccuggacgaugaagauccugauuggcguugucaucacauggauugggaugaauagccggucuaccucccugagcgugucucuugugcucgucggagugguuacccuguaccugggcgugaugguccaggccgacuccgggugugugguuagcuggaaaaacaaggagcucaaaugcggauccggcaucuucaucacagauaaugugcacaccuggacagaacaguauaaguuucagcccgagucuccuagcaagcuggcuuccgccauucaaaaagcucacgaagaggggaucuguggcauuagaucugucacgcgccuugaaaaccugauguggaagcagaucacccccgagcucaaucauauucugacagagaacgaagugaaacugaccaucaugacaggagacaucaagggcauuaugcaggccgggaaacggagccuuagaccgcagccuaccgagcucaaguacuccuggaaagcguggggaaaggccaagaugcugagcacggaacugcacaaucauaccuuccucaucgauggccccgagacagcugaaugcccuaacaccaaucgcgccuggaacucucuggagguugaggacuauggguuuggaguguucacaaccaauauuuggcuuaaacugaaggaacggcaagaugucuuuugugacuccaaacucaugagcgcugccaucaaggacaacagagcggugcacgccgauaugggcuacuggauugagucugcucugaacgacacauggaaaaucgaaaaggccuccuucaucgaggucaagagcugccacuggcccaaaucucauacccuguggagcaauggcguccuugaguccgaaaugauuaucccuaagaacuucgcugggcccguuagccagcacaauuaucgcccgggauaccauacgcagacagccggcccuuggcaccucgggcggcuggagauggauuuugacuucugugaaggaaccaccgugguggucacagaggauugcggcaacagagggcccucucugcggaccacgacagccuccggaaaacucauuaccgaauggugcugucgcagcugcacacugcccccucuuagauaccggggcgaggacggcuguugguaugggauggagaucagaccgcugaaggaaaaagaggaaaaucucgugaacucccugguuaccgcuggacauggccagauugauaauuuuucucugggggugcuuggaauggcgcuguuccuggaggaaaugcugcgcacacgggucggcaccaagcacgccauccuccugguggcuguuagcuuugugacgcuuauuaccgggaacauguccuucagagaccugggacgcgucauggugaugguuggcgccacaaugaccgaugacaucggcaugggggugacauaccucgcccugcuggcugccuuuaaggucagacccaccuucgcggcuggacuucugcuccggaaacugacgucuaaggagcucaugaugacaaccaucggcauugugcugcuuagccaauccacaaucccugagucuauucuggaacucaccgaugcccuggcccuggggaugauggugcuuaaaaucguccgcaauauggagaaguaucagcuggcuguuaccauuauggccaucagcugcgugcccaacgcggugauccuccagaaugcuuggaaagucuccuguacaacgcuggccgugguuagcgugucuccucuccugcuuaccuccagccaacagaaggccgacuggauuccccuggcucucacaaucaagggacugaacccuaccgccauuuuucugacaacccuuucuagaacguccaaaaagcggagcuggccccugaaugaagcuaucauggccgucggcauggugucuauucucgcguccagccugcucaaaaacgauaucccgaugacagggccucugguugccggaggccuucugaccgugugcuacguccugaccggccgcuccgcugaccucgagcuggaaagagccgcugacgugcggugggaggagcaggccgaaaucagcgggucuagccccauucuuuccaucacaauuucugaggauggaagcauguccaucaagaaugaagaggaggaacagacccugacaauucucauccgcacgggccugcucgucauuucugggcuguucccugugagcauccccaucaccgccgcugcgugguaucuuugggagguuaaaaagcaaagagccggagugcugugggacgucccguccccucccccugugggcaaagcugaacuggaggauggggccuaccggauuaagcagaagggaauccucggcuauucucagauuggcgccgggguuuacaaagaaggaacauuucacaccauguggcaugugacacgcggcgcuguccugaugcacaaggggaaaagaaucgagcccagcugggccgacgugaagaaagaucuuauuuccuacggaggcggguggaagcuggagggagaauggaaggagggcgaagaggugcagguucucgcgcuggaacccggcaaaaacccucgggcuguccaaaccaagccgggacucuucaaaacgaacaccggaacaaucggcgccgugagccuggacuuuucucccgggaccuccggaagcccuaucguggauaagaaaggcaaggucguggggcuuuauggaaauggcguugugacaagaucuggcaccuacgucuccgccauugcucagacagaaaagagcaucgaggacaaccccgaaauugaggaugacaucuuccgcaaaaagcggcugacgauuauggaucugcauccuggggccggaaaaaccaagagauaucuccccgcgaucgugcgcgaagcuaucaaacggggccugagaacacuuauucuggccccuacccgcguuguggccgcugagauggaagaggcccuccgggggcugccgaucagauaccagacccccgcuauucgcgccgagcacacaggacgggaaaucgucgaccucaugugucaugcgacguucaccaugagacugcuuuccccuauucgggugcccaauuauaaccugaucauuauggaugaggcccacuuuacagacccugcuucuaucgccgcucgcggcuacaucagcaccagaguugaaaugggggaggccgccggcauuuucaugacagcuacacccccgggaucccgggacccuuuuccccagagcaaugcgcccaucauggaugaggaacgcgagauuccugaaagaucuuggaacuccggccacgagugggugacggacuucaaggggaagacagucugguuugugcccagcaucaaagccggaaaugauauugcugccugccugcggaagaacggcaaaaaggugauccaacucucuagaaaaaccuucgacagcgaauauaucaagacccgcacaaaugauugggacuuugucguuaccacagauauuuccgagaugggggccaacuucaaggcugagcgggugaucgacccuagacgcuguaugaaaccggugauucugaccgauggagaggaacgggucauccuugccggccccaugccugugacgcauucuagcgcggcucagagacgcgggcggguuggcagaaaucccaagaacgaaaaugaccaguacauuuacaugggagagccucuggaaaacgaugaggacugcgcccacuggaaagaggccaagaugcuccuggacaauaucaacacacccgaaggcaucauuccguccauguuugagccugaacgcgagaaaguggaugcuaucgacggggaauauagacugcggggagaggcccgcaagaccuucgucgaucucaugagacggggcgaccuucccguguggcuggcguaccgcguugccgcugaggggauuaacuaugccgauagacggugguguuuugacggagugaaaaauaaccaaauccuggaagagaaugucgaaguggagauuuggacaaaggagggcgaaagaaagaaacucaagccucgcuggcuggaugcucggaucuacucugacccccuugcccugaaagaguucaaggaguucgcugccgggagaaaaagccucacccugaaccugauuacggagaugggccgccucccuaccuuuaugacacagaaggcgaagaaugcccuugauaaccuggcuguccugcauaccgccgaagcuggaggccgggccuauaaucacgcccucuccgagcugcccgagacacuugaaacccugcuccugcugacacuccuugcuaccgugacagggggaaucuuccuguuucugaugagcggcaaagggaucggaaagaugacacucggcaugugcugcauuaucaccgcgucuauucugcuuugguacgcccagauccagccgcacuggauugcugccuccaucauccuggaguucuuucucauuguucugcugaucccugaacccgagaaacaaagaacaccccaggacaaccagcucacauauguggugauugccauccuuaccgucguugcugccacaauggcgaaugaaaugggcuuccuggagaagacgaaaaaggauuuugggcugggaagcauuaccacacagcaaccugaguccaacauccucgacaucgaucugcggccggccucugcuuggacccuuuacgccguggcuacaaccuucauuacgcccaugcugcgccauagcaucgaaaauuccucugugaacgucagccucaccgccauugcgaaucaggccacagugcugaugggccuggggaagggauggccucucuccaaaauggacaucggcguuccccuucuggcuauuggguguuacagccaggugaacccuaucacccugacagccgcucuccugcuucuggucgcccacuaugcuauuaucggacccggccuccaggccaaggcgaccagagaggcccaaaaacgggcugccgcuggcaucaugaagaauccuacgguggacgggaugacagucauugaucuggacccgauccccuacgauccuaaauuugaaaagcagcugggacaggugaugcuccuuguucugugcgugacccagguccugaugaugcgcacaaccugggcccucugugaggcccugacccuugcgacaggccccauuucuacgcugugggaagggaacccuggaagauucuggaauaccacaaucgcuguguccauggccaacauuuuucggggcagcuaucucgcuggggccggacugcuguucucuaucaugaagaacaccgccaauacacgcagaggcaccggcaacacgggggagacacucggagagaaauggaagaaucggcuuaacgcucugggcaaauccgaauuucaaaucuacaagaaaagcgggauucaggagguugaccgcacccuggccaaggaaggaaucaaaagaggcgagaccgaucaucacgcggugucucgggggagcgccaagcucagaugguucgucgagcgcaaucuggugacacccgaaggaaaggugguugaccuuggcugcggcagagggggaugguccuauuacuguggcgggcugaaaaacgucaaggaggugaaaggacucaccaagggcgggccgggacaugaagaaccuauucccaugucuacauauggcuggaaucuggugagacugcagagcggcgucgauguuuucuuuacgcccccugaaaaaugcgacacccuccuuugugauaucggggaguccagccccaacccuacaguggaggcuggacgcacccugcgggugcugaaucucgucgaaaacuggcugaauaacaauacacaauucugcauuaaggugcuuaacccguacaugcccuccguuaucgagaagauggaagcccugcagagaaaauacggcggggcucucgugcgcaauccucugucucggaacagcacccacgagauguauugggucuccaacgccucuggaaauaucgugagcuccguuaacaugauuucuagaaugcugaucaaucgcuuuacgaugcggcacaagaaagcgaccuacgaacccgacguggaucucggcagcgggacaagaaacauuggaaucgaguccgagaccccuaaucuugacauuaucggcaagcgcaucgagaagauuaagcaggagcaugaaacaagcuggcacuaugaucaggaccaucccuacaagaccugggccuaucacggcucuuacgagacaaaacaaaccggguccgcuagcucuauggucaacggaguggugcggcugcugacgaagccgugggacgucaucccuaugguuacacagauggccaugaccgauaccacacccuucggccagcagagaguguuuaaagaaaagguggacacgcgcacccaagagccuaaagaggggacaaagaagcucaugaaaauuaccgcugaauggcuguggaaggagcuuggcaaaaagaaaacacccagaauguguacccgggaagaguucacacgcaaggucagauccaaugccgcucugggcgccaucuuuaccgaugagaacaaauggaaaagcgcgcgggaagccguggaggacucuggguucugggaacucguugauaaggagagaaaucugcaccuggaaggaaaaugcgagacguguguguauaacaugaugggcaagcgggagaaaaagcucggcgaauuugggaaagcuaagggaucccgcgccauuugguacauguggcugggcgcuagauuccuugaguuugaagcccugggguuccucaaugaggaccauugguuuagccgggaaaacucccugagcggagucgagggcgaggggcuucacaagcugggcuacauccuccgcgaugugucuaaaaaggaaggaggcgccauguaugcggacgauaccgcugggugggacacaagaauuacccuggaggaucugaaaaaugaagagaugguuacaaaccauauggaaggagagcacaagaaacucgccgaggccaucuucaagcugaccuaccagaauaaggugguccgggugcagcgcccuacgcccagaggcacaguuauggacaucauuagccggcgcgaccagagaggguccggacaaguggucaccuauggccuuaacacauucaccaacauggaagcucagcugauccggcagauggagggggaaggcguguuuaaaucuauucaacagcucacggucaaggaggagaucgccgugaaaaauuggcugauucgcguuggaagagaacggcuuagccgcauggcuaucuccggcgaugacugcguggucaagccgcuggaugacagauucgccucugcgcucaccgcccugaacgauauggggaaagugcggaaggacauccagcagugggagccuagcagaggauggaaugauuggacacaagugcccuuuugcucccaucacuuccacgaacugauuaugaaggacggccgcguucucgugguccccugucggaaccaggaugagcugaucgggagagcucgcauuucucagggagccggcuggagccuucgggaaaccgcuugccuggggaaauccuacgcccagauguggagccucauguauuuucauagacgcgaccugcggcuugcggccaaugcuaucuguucugccgugccuucccacuggauuccgacaagcagaaccacauggucuauccaugcuacccacgaguggaugacgacagaggauaugcugaccguuuggaaccgcguguggauccaagaaaaucccuggauggaggacaagaccccugucgaauccugggaggaaauucccuaccucggcaaacgggaggaucaguggugcggaagccugaucggccugacauccagagccaccugggcuaagaacauucagacagccaucaaucaggugcgcucucucauugggaacgaggaauauacggacuacaugccuagcaugaaacgguucagaaucgaggaagaggaagcgggaguccugugguga

SEQ ID NO: 19625 - RNA, 9876 nt, Artificial Sequence
  derived and/or modified CDS sequence (opt5) from DENV-2__KM279595__SS-prME
accgccggaaucauuaucaugaugauucccaccgugauggcuuuccaccugacgacccggaauggggagccucauaugaucgucagccggcaggaaaagggaaagucccuccuguuuaagacagagaauggcguuaacaugugcacccuuauggccauggaccugggggaacucugugaggauaccauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaaggugagacccacguucgcggcuggacuucugcuccggaaacugacauccaaggagcucaugaugaccacaaucggcaucgugcugcuuucucaaagcaccauuccugaguccauccuggaacucaccgaugcccuggcccuggggaugaugguccuuaaaauuguucgcaauauggagaaguaucagcuggcugugacaaucauggccauucucugcgugcccaacgcggucauccugcagaaugcuuggaaagugucuuguacgacccucgccguugugagcgucuccccucugcuucugacaagcucucaacagaaggccgacuggaucccccucgcucugaccauuaagggacugaacccuacagccaucuuucuuaccacgcuguccagaacaagcaaaaagcggucuuggccccucaaugaagcuauuauggccgugggcaugguuuccauccuggcgagcucucuccugaaaaacgauauuccgaugaccgggccucuuguggccggaggccugcugaccgucugcuacgugcucacaggccgcuccgcugaccuggagcuugaaagagccgcugacguccggugggaggagcaggccgaaaucagcggguccagccccauccugucuauuaccaucagcgaggauggauccaugucuauuaagaaugaagaggaggaacagacacucacgauccugauucgcaccggccuccuggugaucagcgggcuuuucccuguuuccauucccaucacagccgcugcgugguaucugugggaggugaaaaagcaaagagccggaguccugugggacgugccgucuccucccccuguuggcaaagcugaacucgaggauggggccuaccggaucaagcagaagggcauucugggcuauagccagaucggcgccgggguguacaaagaaggaaccuuucacacaauguggcaugucacccgcggcgcugugcuuaugcacaaggggaaaagaauugagcccuccugggccgacgugaagaaagaucugaucucuuacggaggcggguggaagcucgagggagaauggaaggagggcgaagagguucagguccuggcgcucgaacccggcaaaaacccucgggcugugcaaacgaagccggggcuguucaaaaccaacacaggaaccauuggcgccgugagccuugacuuuucccccgggacaagcggaucuccuaucgucgauaagaaaggcaaggugguugggcuguauggaaauggcguggucaccagauccggcacauacgugagcgccaucgcucagacggagaagaacauugaggacaaucccgaaaucgaggaugacauuuuccgcaaaaagcggcugaccaucauggaucuccauccuggggccggaaaaacaaagagauaucugcccgcgauuguucgcgaagcuaucaaacggggccuuagaacccugauccucgccccuacccgcguggucgccgcugagauggaagaggcccugcgggggcucccgauuagauaccagacacccgcuauccgcgccgagcacacgggacgggaaauuguggaccugaugugucaugcgaccuucacaaugagacuucugucuccuauccggguucccaacuauaaucugauuaucauggaugaggcccacuuuaccgacccugcuuccauugccgcucgcggcuacaucagcacaagaguggaaaugggggaggccgccggcaucuucaugaccgcuacgcccccgggaucccgggacccuuuuccccagucuaacgcgcccauuauggaugaggaaaaggagaucccugaacgcagcuggaacuccggccacgagugggucacagacuucaaggggaaaaccgugugguuugugcccagcauuaaggccggaaacgauaucgcugccugccuccgcaagaauggcaagaaagucauucaacugucucggaagaccuucgacuccgaauauaucaagacaagaaccaacgauugggacuuuguugugacaaccgauaucagcgagaugggggccaauuucaaagcugagcgcgugauugacccucggagauguaugaagccggucauccuuacggauggagaggaacgcgugauucuggccggccccaugccuguuacacauucuagcgcggcucagcggagagggcgcgugggccggaaccccaaaaaugaaaacgaccaguacaucuacaugggagagccucucgaaaaugaugaggacugcgcccacuggaaggaggccaaaaugcugcuggacaacauuaacacccccgaaggcaucaucccguccauguuugagccugaaagagagaaggucgaugcuauugacggggaauaucgccucagaggagaggcccggaaaacauucguggaucuuaugcgcagaggcgaccugcccguuuggcuggcguaccggguggccgcugaggggaucaauuaugccgaucgcagaugguguuuugacggagucaagaacaaucaaauucucgaagagaacguggaagucgagaucuggaccaaggagggcgaacggaaaaagcugaaaccuagauggcuugaugcucgcauuuacucugacccccuggcccucaaggaguucaaagaguucgcugccgggagaaagagccugacgcugaaucucaucaccgagaugggcagacuuccuacauuuaugacccagaaggcgaaaaacgcccuggauaaucuggcugugcuccauacagccgaagcuggaggccgcgccuauaaccacgcccuguccgagcuucccgagacccuggaaacacuccugcugcucacccuucuggcuacgguuacagggggaauuuuccuguuucucaugucuggcaaggggaucggaaaaaugacccugggcaugugcugcaucauuaccgcgagcauccuucugugguacgcccagauucagccgcacuggaucgcugccuccauuauccucgaguucuuucugaucgugcugcucauuccugaacccgagaagcaacggacaccccaggacaaucagcuuaccuauguggucaucgccauucugacaguuguggcugccacgauggcgaacgaaaugggcuuccuggagaaaaccaagaaggauuuugggcucggaagcaucacaacccagcaaccugagucuaauauucuggacaucgaucuuagaccggccuccgcuuggacacuguacgccguggcuaccacguucaucacccccaugcuccggcauagcauugaaaacuccucugucaaugugagccugacagccaucgcgaaccaggccaccguucugaugggccucgggaaaggauggccucuuuccaagauggacauuggcgugccccugcuggcuaucggguguuacucucaggucaauccuauuacacucaccgccgcucugcuucugcucguggcccacuaugcuaucauuggacccggccugcaggccaaagcgacgcgcgaggcccaaaagagagcugccgcuggcaucaugaaaaacccuacagucgacgggaugaccgugaucgaucuggacccgauucccuacgauccuaaguuugaaaagcagcucggacagguuaugcuucuggugcugugcgucacacaggugcucaugaugcggaccaccugggcccugugugaggcccuuacacuggcgacgggccccaucagcacccucugggaagggaauccuggacgcuucuggaacacaaccauugcuguuuccauggccaacaucuuuagaggcagcuaucuggcuggggccggacuccuguucucuauuaugaaaaauacagccaacacccggcgcggcacgggcaauacaggggagacccuuggagagaaguggaaaaacagacugaaugcucugggcaaguccgaauuucaaaucuacaaaaagagcgggauccaggagguggaccggacccucgccaaagaaggaauuaagcgcggcgagacagaucaucacgcggucucuagaggguccgccaagcugcggugguucguggagagaaaccuugugacccccgaaggaaaaguugucgaccugggcugcggccgcgggggauggagcuauuacuguggcgggcucaagaaugugaaagaggugaagggacugacaaaaggcgggccgggacaugaagaaccuauccccaugucuacguauggcuggaaccugguccggcuccagagcggcguugauguguucuuuacacccccugaaaagugcgacacacuucugugugauauuggggaguccucucccaauccuaccguggaggcuggaagaacacugcgcguccucaaccugguggaaaauuggcuuaacaauaacacccaauucugcaucaagguucugaauccguacaugcccagcgugauugagaaaauggaagcccuccagcggaaguacggcggggcucuggucagaaacccucugucccgcaacagcacgcacgagauguauuggguguccaaugccucuggaaacaucguuagcuccgugaauaugaucucucggaugcucauuaacagauuuaccaugcgccacaaaaaggcgacauacgaacccgacgucgaucuuggcagcgggacccggaauaucggaauugaguccgagacaccuaaccuggacaucauuggcaaaagaaucgaaaagaucaagcaggagcaugaaaccucuuggcacuaugaucaggaccaucccuacaaaacaugggccuaucacggcagcuacgagaccaagcaaacgggguccgcuagcucuauggugaauggagugguccgccugcucacaaaaccgugggacguuauuccuauggugacccagauggccaugaccgauacaacgcccuucggccagcagcggguguuuaaggaaaaagucgacaccagaacacaagagccuaaggaggggaccaagaaacugaugaagaucacagcugaauggcuuuggaaagagcugggaaagaaaaagacccccagaauguguacaagagaagaguucacccggaaagugcgcuccaacgccgcucucggcgccauuuuuacggaugagaauaaguggaaaagcgcgagagaagccguugaggacucuggguucugggaacugguggauaaagagcggaaccugcaccucgaaggaaagugcgagaccugugucuauaauaugaugggcaaaagagagaagaaacugggcgaauuugggaaggcuaagggaucccgggccaucugguacauguggcuuggcgcucgcuuccuggaguuugaagcccucggguuccugaacgaggaccauugguuuagcagagaaaauucucuuuccggaguggagggcgaggggcugcacaaacucggcuacauucugcgggauguuagcaagaaagaaggaggcgccauguaugcggacgauacagcugggugggacacccgcaucacacuggaggaucucaagaacgaagagauggugaccaaucauauggaaggagagcacaaaaagcuggccgaggccauuuucaaacuuacguaccagaacaaagucgugagaguucagcggccuacaccccgcggcaccgugauggacaucaucuccagacgggaccagcgcgggagcggacaagucgugacauauggccugaacaccuucacgaauauggaagcucagcucauuagacagauggagggggaaggcgucuuuaagucuauccaacagcugaccgugaaagaggagauugccguuaaggauuggcuuauccgggugggacgcgaaagacugagccggauggcuauuuccggcgacgauugcgucgugaaaccgcucgacgaucgcuucgccucugcgcugacagcccugaacgacauggggaaggugagaaaggauauccagcagugggagccuagccggggauggaaugacuggacccaaguucccuuuugcucccaucacuuccacgaacucaucaugaaagauggcagagugcuggucgugcccugucgcaaccaggacgagcuuauugggcgggcuagaaucucucagggagccggcuggagccugcgcgaaacagcuugccucgggaaguccuacgcccagauguggucucugauguauuuucaucggagagaucuucgccuggcggccaaugcuauuuguagcgccguuccuucccacuggaucccgaccagccggacaaccuggucuauucaugcuacgcacgaguggaugacaaccgaggacaugcucaccguguggaacagagucuggauccaagaaaaucccuggauggaggauaaaacaccuguggaauccugggaggaaauccccuaccugggcaagcgcgaggaccaguggugcggaagccugauuggccucaccucucgggccacaugggcuaaaaacauccagacggccauuaaucaggucagaucccugaucgggaacgaggaauauaccgacuacaugccuagcaugaagcgcuuccggagagaggaagaggaagcgggagugcuuugguga

SEQ ID NO: 19626 - RNA, 9876 nt, Artificial Sequence
  derived and/or modified CDS sequence (opt5) from DENV-2__KM279566__SS-prME
accgccggaaucauuaucaugaugauucccaccgugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauaccauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaaggugagacccacguucgcggcuggacuucugcuccggaaacugacauccaaggagcucaugaugaccacaaucggcaucgugcugcuuucucaaagcaccauuccugaguccauccuggaacucaccgaugcccuggcccuggggaugaugguccuuaaaauuguucgcaauauggagaaguaucagcuggcugugacaaucauggccauucucugcgugcccaacgcggucauccugcagaaugcuuggaaagugucuuguacgacccucgccguugugagcgucuccccucugcuucugacaagcucucaacagaaggccgacuggaucccccucgcucugaccauuaagggacugaacccuacagccaucuuucuuaccacgcuguccagaacaagcaaaaagcggucuuggccccucaaugaagcuauuauggccgugggcaugguuuccauccuggcgagcucucuccugaaaaacgauauuccgaugaccgggccucuuguggccggaggccugcugaccgucugcuacgugcucacaggccgcuccgcugaccuggagcuugaaagagccgcugacguccggugggaggagcaggccgaaaucagcggguccagccccauccugucuauuaccaucagcgaggauggauccaugucuauuaagaaugaagaggaggaacagacacucacgauccugauucgcaccggccuccuggugaucagcgggcuuuucccuguuuccauucccaucacagccgcugcgugguaucugugggaggugaaaaagcaaagagccggaguccugugggacgugccgucuccucccccuguuggcaaagcugaacucgaggauggggccuaccggaucaagcagaagggcauucugggcuauagccagaucggcgccgggguguacaaagaaggaaccuuucacacaauguggcaugucacccgcggcgcugugcuuaugcacaaggggaaaagaauugagcccuccugggccgacgugaagaaagaucugaucucuuacggaggcggguggaagcucgagggagaauggaaggagggcgaagagguucagguccuggcgcucgaacccggcaaaaacccucgggcugugcaaacgaagccggggcuguucaaaaccaacacaggaaccauuggcgccgugagccuugacuuuucccccgggacaagcggaucuccuaucgucgauaagaaaggcaaggugguugggcuguauggaaauggcguggucaccagauccggcacauacgugagcgccaucgcucagacggagaagucuauugaggacaaccccgaaaucgaggaugacauuuuccgcaaaaagcggcugaccaucauggaucuccauccuggggccggaaaaacaaagagauaucugcccgcgauuguucgcgaagcuaucaaacggggccuuagaacccugauccucgccccuacccgcguggucgccgcugagauggaagaggcccugcgggggcucccgauuagauaccagacacccgcuauccgcgccgagcacacgggacgggaaauuguggaccugaugugucaugcgaccuucacaaugagacuucuguccccuauccggguucccaauuauaaccugauuaucauggaugaggcccacuuuaccgacccugcuagcauugccgcucgcggcuacaucuccacaagaguggaaaugggggaggccgccggcaucuucaugaccgcuacgcccccgggaucucgggacccuuuuccccagagcaaugcgcccauuauggaugaggaaaaggagaucccugaacgcuccuggaacagcggccacgagugggucacagacuucaaggggaaaaccgugugguuugugcccucuauuaaggccggaaaugauaucgcugccugccuccgcaagaacggcaagaaagucauucaacugucccggaagaccuucgacagcgaauauaucaagacaagaaccaaugauugggacuuuguugugacaaccgauaucucugagaugggggccaacuucaaagcugagcgcgugauugacccucggagauguaugaagccggucauccuuacggauggagaggaacgcgugauucuggccggccccaugccuguuacacauagcuccgcggcucagcggagagggcgcgugggccggaaucccaaaaacgaaaaugaccaguacaucuacaugggagagccucucgaaaacgaugaggacugcgcccacuggaaggaggccaaaaugcugcuggacaauauuaacacccccgaaggcaucaucccgucuauguuugagccugaaagagagaaggucgaugcuauugacggggaauaucgccucagaggagaggcccggaaaacauucguggaucuuaugcgcagaggcgaccugcccguuuggcuggcguaccggguggccgcugaggggaucaacuaugccgaucgcagaugguguuuugacggagucaagaauaaccaaauucucgaagagaauguggaagucgagaucuggaccaaggagggcgaacggaaaaagcugaaaccuagauggcuugaugcucgcauuuacagcgacccccuggcccucaaggaguucaaagaguucgcugccgggcggaagucccugacgcugaaccucaucaccgagaugggcagacuuccuacauuuaugacccagaaggcgaaaaaugcccuggauaaccuggcugugcuccauacagccgaagcuggaggccgcgccuauaaucacgcccugucugagcuucccgagacccuggaaacacuccugcugcucacccuucuggcuacgguuacagggggaauuuuccuguuucucaugagcggcaaggggaucggaaaaaugacccugggcaugugcugcaucauuaccgcguccauccuucugugguacgcccagauucagccgcacuggaucgcugccagcauuauccucgaguucuuucugaucgugcugcucauuccugaacccgagaagcaacggacaccccaggacaaccagcuuaccuauguggucaucgccauucugacaguuguggcugccacgauggcgaaugaaaugggcuuccuggagaaaaccaagaaggauuuugggcucggaucuaucacaacccagcaaccugaguccaacauucuggacaucgaucuuagaccggccagcgcuuggacacuguacgccguggcuaccacguucaucacccccaugcuccggcauuccauugaaaauucuagcgucaacgugucccugacagccaucgcgaaucaggccaccguucugaugggccucgggaaaggauggccucuuucuaagauggacauuggcgugccccugcuggcuaucggguguuacagccaggucaacccuauuacacucaccgccgcucugcuucugcucguggcccacuaugcuaucauuggacccggccugcaggccaaagcgacgcgcgaggcccaaaagagagcugccgcuggcaucaugaaaaauccuacagucgacgggaugaccgugaucgaucuggacccgauucccuacgauccuaaguuugaaaagcagcucggacagguuaugcuucuggugcugugcgucacacaggugcucaugaugcggaccaccugggcccugugugaggcccuuacacuggcgacgggccccaucuccacccucugggaagggaacccuggacgcuucuggaauacaaccauugcuguuagcauggccaacaucuuuagaggcucuuaucuggcuggggccggacuccuguucuccauuaugaaaaacacagccaauacccggcgcggcacgggcaacacaggggagacccuuggagagaaguggaaaaauagacugaacgcucugggcaagagcgaauuucaaaucuacaaaaagucugggauccaggagguggaccggacccucgccaaagaaggaauuaagcgcggcgagacagaucaucacgcggucuccagagggagcgccaagcugcggugguucguggagagaaaucuugugacccccgaaggaaaaguugucgaccugggcugcggccgcgggggauggucuuauuacuguggcgggcucaagaacgugaaagaggugaagggacugacaaaaggcgggccgggacaugaagaaccuauccccaugagcacguauggcuggaaucugguccggcuccaguccggcguugauguguucuuuacacccccugaaaagugcgacacacuucugugugauauuggggagucuagccccaacccuaccguggaggcuggaagaacacugcgcguccucaaucugguggaaaacuggcuuaauaacaauacccaauucugcaucaagguucugaacccguacaugcccuccgugauugagaaaauggaagcccuccagcggaaguacggcggggcucuggucagaaauccucugagccgcaacuccacgcacgagauguauugggugucuaacgccagcggaaauaucguuuccucugugaacaugaucagccggaugcucauuaauagauuuaccaugcgccacaaaaaggcgacauacgaacccgacgucgaucuuggcuccgggacccggaacaucggaauugagucugagacaccuaaucuggacaucauuggcaaaagaaucgaaaagaucaagcaggagcaugaaaccagcuggcacuaugaucaggaccaucccuacaaaacaugggccuaucacggcuccuacgagaccaagcaaacggggagcgcuucuuccauggugaacggagugguccgccugcucacaaaaccgugggacguuauuccuauggugacccagauggccaugaccgauacaacgcccuucggccagcagcggguguuuaaggaaaaagucgacaccagaacacaagagccuaaggaggggaccaagaaacugaugaagaucacagcugaauggcuuuggaaagagcugggaaagaaaaagacccccagaauguguacaagagaagaguucacccggaaagugcgcagcaaugccgcucucggcgccauuuuuacggaugagaacaaguggaagucugcgagagaagccguugaggacuccggguucugggaacugguggauaaagagcggaaucugcaccucgaaggaaagugcgagaccugugucuauaacaugaugggcaaaagagagaagaaacugggcgaauuugggaaggcuaagggaagccgggccaucugguacauguggcuuggcgcucgcuuccuggaguuugaagcccucggguuccugaaugaggaccauugguuuucuagagaaaacucccuuagcggaguggagggcgaggggcugcacaaacucggcuacauucugcgggauguuuccaagaaagaaggaggcgccauguaugcggacgauacagcugggugggacacccgcaucacacuggaggaucucaagaaugaagagauggugaccaaccauauggaaggagagcacaaaaagcuggccgaggccauuuucaaacuuacguaccagaauaaagucgugagaguucagcggccuacaccccgcggcaccgugauggacaucaucagcagacgggaccagcgcgggucuggacaagucgugacauauggccugaacaccuucacgaacauggaagcucagcucauuagacagauggagggggaaggcgucuuuaagagcauccaacagcugaccgugaaagaggagauugccguuaagaauuggcuuauccgggugggacgcgaaagacugucccggauggcuauuucuggcgaugacugcgucgugaaaccgcucgaugaccgcuucgccagcgcgcugacagcccugaacgauauggggaaggugagaaaggacauccagcagugggagccuucccggggauggaaugauuggacccaaguucccuuuugcucucaucacuuccacgaacucaucaugaaagacggcagagugcuggucgugcccugucgcaaccaggaugagcuuauugggcgggcuagaaucagccagggagccggcuggucccugcgcgaaacagcuugccucgggaagucuuacgcccagauguggagccugauguauuuucaucggagagaccuucgccuggcggccaaugcuauuuguuccgccguuccuagccacuggaucccgaccucucggacaaccugguccauucaugcuacgcacgaguggaugacaaccgaggauaugcucaccguguggaacagagucuggauccaagaaaaucccuggauggaggacaaaacaccuguggaaagcugggaggaaauccccuaccugggcaagcgcgaggaucaguggugcggaucucugauuggccucaccucccgggccacaugggcuaaaaacauccagacggccauuaaucaggucagaagccugaucgggaacgaggaauauaccgacuacaugccuuccaugaagcgcuuccggagagaggaagaggaagcgggagugcuuugguga

SEQ ID NO: 19627 - RNA, 9876 nt, Artificial Sequence
  derived and/or modified CDS sequence (opt5) from DENV-2__KM279574__SS-prME
accgccggcaucauuaucaugaugauucccaccgugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauacaauuaccuacaauugcccgcugcuuagacaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaagaucagacccacguucgcggcuggacuucugcuccggaaacugacauccaaggagcucaugaugaccacaaucggcauugugcugcuuucucaaagcaccaucccugaguccauucuggaacucaccgaugcccuggcccuggggaugauggugcuuaaaaucguccgcaauauggagaaguaucagcuggcuguuacaauuauggccauccucugcgugcccaacgcggugauccugcagaaugcuuggaaagucucuuguacgacccucgccgugguuagcguguccccucugcuucugacaagcucucaacagaaggccgacuggauuccccucgcucugaccaucaagggacugaacccuacagccauuuuucuuaccacgcuguccagaacaagcaaaaagcggucuuggccccucaaugaagcuaucauggccgucggcaugguguccauucuggcgagcucucuccugaaaaacgauaucccgaugaccgggccucuuguugccggaggccugcugaccgugugcuacguccucacaggccgcuccgcugaccuggagcuugaaagagccgcugacgugcggugggaggagcaggccgaaaucagcggguccagccccauucugucuaucaccauuagcgaggauggauccaugucuaucaagaaugaagaggaggaacagacacucacgauucugauccgcaccggccuccuggucauuagcgggcuuuucccuguguccauccccaucacagccgcugcgugguaucugugggagguuaaaaagcaaagagccggagugcugugggacgucccgucuccucccccugugggcaaagcugaacucgaggauggggccuaccggauuaagcagaagggaauccugggcuauagccagauuggcgccgggguuuacaaagaaggaaccuuucacacaauguggcaugugacccgcggcgcuguccuuaugcacaaggggaaaagaaucgagcccuccugggccgacgugaagaaagaucugauuucuuacggaggcggguggaagcucgagggagaauggaaggagggcgaagaggugcagguucuggcgcucgaacccggcaaaaacccucgggcuguccaaacgaagccggggcuguucaaaaccaacacaggaaccaucggcgccgugagccuugacuuuucccccgggacaagcggaucuccuaucguggauaagaaaggcaaggucguggggcuguauggaaauggcguugugaccagauccggcacauacgucagcgccauugcucagacggagaagucuaucgaggacaaccccgaaauugaggaugacaucuuccgcaaaaagcggcugaccauuauggaucuccauccuggggccggaaaaacaaagagauaucugcccgcgaucgugcgcgaagcuaucaaacggggccuuagaacccugauucucgccccuacccgcguuguggccgcugagauggaagaggcccugcgggggcucccgaucagauaccagacacccgcuauucgcgccgagcacacgggacgggaaaucgucgaccugaugugucaugcgaccuucacaaugagacuucuguccccuauucgggugcccaauuauaaccugaucauuauggaugaggcccacuuuaccgacccugcuagcaucgccgcucgcggcuacaucuccacaagaguugaaaugggggaggccgccggcauuuucaugaccgcuacgcccccgggaucucgggacccuuuuccccagagcaaugcgcccaucauggaugaggaaaaggagauuccugaacgcuccuggaacagcggccacgagugggugacagacuucaaggggaaaaccgucugguuugugcccucuaucaaggccggaaaugauauugcugccugccuccgcaagaacggcaagaaagugauccaacugucccggaagaccuucgacagcgaauauaucaagacaagaaccaaugauugggacuuugucguuacaaccgauauuucugagaugggggccaacuucaaagcugagcgcgugaucgacccucggagauguaugaagccggugauucuuacggauggagaggaacgcgucauccuggccggccccaugccugugacacauagcuccgcggcucagcggagagggcgcguuggccggaaucccaaaaacgaaaaugaccaguacauuuacaugggagagccucucgaaaacgaugaggacugcgcccacuggaaggaggccaaaaugcugcuggacaauaucaacacccccgaaggcaucauuccgucuauguuugagccugaaagagagaagguggaugcuaucgacggggaauaucgccucagaggagaggcccggaaaacauucgucgaucuuaugcgcagaggcgaccugcccguguggcuggcguaccggguugccgcugaggggauuaacuaugccgaucgcagaugguguuuugacggagugaagaauaaccaaauccucgaagagaaugucgaaguggagauuuggaccaaggagggcgaacggaaaaagcugaaaccuagauggcuugaugcucgcaucuacagcgacccccuggcccucaaggaguucaaagaguucgcugccgggcggaagucccugacgcugaaccucauuaccgagaugggcagacuuccuacauuuaugacccagaaggcgaaaaaugcccuggauaaccuggcuguccuccauacagccgaagcuggaggccgcgccuauaaucacgcccugucugagcuucccgagacccuggaaacacuccugcugcucacccuucuggcuacggugacagggggaaucuuccuguuucucaugagcggcaaggggaucggaaaaaugacccugggcaugugcugcauuaucaccgcguccauucuucugugguacgcccagauccagccgcacuggauugcugccagcaucauccucgaguucuuucugauuguucugcucaucccugaacccgagaagcaacggacaccccaggacaaccagcuuaccuauguggugauugccauccugacagucguugcugccacgauggcgaaugaaaugggcuuccuggagaaaaccaagaaggauuuugggcucggaucuauuacaacccagcaaccugaguccaacauccuggacaucgaucuuagaccggccagcgcuuggacacuguacgccguggcuaccacguucauuacccccaugcuccggcauuccaucgaaaauucuagcgugaacgucucccugacagccauugcgaaucaggccaccgugcugaugggccucgggaaaggauggccucuuucuaagauggacaucggcguuccccugcuggcuauuggguguuacagccaggugaacccuaucacacucaccgccgcucugcuucugcucgucgcccacuaugcuauuaucggacccggccugcaggccaaagcgacgcgcgaggcccaaaagagagcugccgcuggcaucaugaaaaauccuacaguggacgggaugaccgucauugaucuggacccgauccccuacgauccuaaguuugaaaagcagcucggacaggugaugcuucugguucugugcgugacacagguccucaugaugcggaccaccugggcccugugugaggcccuuacacuggcgacgggccccauuuccacccucugggaagggaacccuggacgcuucuggaauacaaccaucgcugugagcauggccaacauuuuuagaggcucuuaucuggcuggggccggacuccuguucuccaucaugaaaaacacagccaauacccggcgcggcacgggcaacacaggggagacccuuggagagaaguggaaaaauagacugaacgcucugggcaagagcgaauuucaaaucuacaaaaagucugggauucaggagguugaccggacccucgccaaagaaggaaucaagcgcggcgagacagaucaucacgcgguguccagagggagcgccaagcugcggugguucgucgagagaaaucuugugacccccgaaggaaaagugguugaccugggcugcggccgcgggggauggucuuauuacuguggcgggcucaagaacgucaaagaggugaagggacugacaaaaggcgggccgggacaugaagaaccuauucccaugagcacguauggcuggaaucuggugcggcuccaguccggcgucgauguuuucuuuaccucucccgaaaagugcgacacacuucugugugauaucggggagagcuccccuaaccccaccguggaggcuggaagaacacugcgcgugcucaaucuggucgaaaacuggcuuaauaacaauacccaauucugcauuaaggugcugaacccuuacaugccgagcguuaucgagaaaauggaagcccuccagcggaaguacggcggggcucuggugagaaauccccugucccgcaacucuacgcacgagauguauugggucagcaacgccuccggaaauaucgugucuagcguuaacaugauuucccggaugcucaucaauagauuuaccaugcgccacaaaaaggcgacauacgaaccugacguggaucuuggcucugggacccggaacauuggaaucgagagcgagacacccaaucuggacauuaucggcaaaagaaucgaaaagauuaagcaggagcaugaaaccuccuggcacuaugaucaggaccauccuuacaaaacaugggccuaucacggcagcuacgagaccaagcaaacggggucugcuuccagcauggucaacggaguggugcgccugcucacaaaacccugggacgucaucccgaugguuacccagauggccaugaccgauacaacgccuuucggccagcagcggguguuuaaggaaaaaguggacaccagaacacaagagcccaaggaggggaccaagaaacugaugaagauuacagcugaauggcuuuggaaagagcugggaaagaaaaagaccccucgcauguguacaagagaagaguucacccggaaaguccgcucuaaugccgcucucggcgccaucuuuacggaugagaacaaguggaaguccgcgagagaagccguggaggacagcggguucugggaacugguugauaaagagcggaaucugcaccucgaaggaaagugcgagaccuguguguauaacaugaugggcaaaagagagaagaaacugggcgaauuugggaaggcuaagggaucucgggccauuugguacauguggcuuggcgcucgcuuccuggaguuugaagcccucggguuccugaaugaggaccauugguuuuccagagaaaacagccuuuccggagucgagggcgaggggcugcacaaacucggcuacauccugcgggaugugagcaagaaagaaggaggcgccauguaugcggacgauacagcugggugggacacccgcauuacacuggaggaucucgaaaaugaggaaaugguuaccaaccauauggagggagagcacaagaaacuggccgaagccaucuucaaacuuacguaccagaauaagguggucagagugcagcggcccacaccucgcggcaccguuauggacaucauuucuagacgggaccagcgcgggagcggacaaguggucacauauggccugaacaccuucacgaacauggaggcucagcucaucagacagauggaaggggagggcguguuuaaauccauucaacagcugaccgucaaggaggaaaucgccgugaaaaauuggcuuacacggguuggacgcgagagacugucucggauggcuauuagcggcgaugacugcguggucaagccccucgaugaccgcuucgccuccgcgcugaccgcccugaacgauauggggaaagugagaaaggacauccagcagugggaaccgucucggggauggaaugauuggacacaagugccuuuuugcagccaucacuuccacgagcucaucaugaaggacggcagaguucuggugguccccugucgcaaccaggaugaacuuauugggcgggcuagaaucucccagggagccggcuggucucugcgcgagaccgcuugccucgggaaaagcuacgcccagauguggucccugauguauuuucaucggagagaccuucgccuggcggccaaugcuauuuguagcgccgugcccucucacuggaucccuacaucccggaccacguggagcauucaugcuacacacgaguggaugaccaccgaagauaugcucacaguuuggaacagaguguggauccaagagaauccguggauggaagacaagacccccgucgagucuugggaagagaucccuuaccugggcaaacgcgaggaucaguggugcggaucccugauuggccucacaagccgggccacgugggcuaagaacauccagaccgccauuaaucaggugagaucccugaucgggaacgaagaguauacagacuacaugcccucuaugaaacgcuuccggagagaagaggaagaggcgggaguccuuugguga

SEQ ID NO: 19628 - RNA, 9876 nt, Artificial Sequence
  derived and/or modified CDS sequence (opt5) from DENV-2__KM279568__SS-prME
accgccggaaucauuaucaugaugauucccaccgugauggcuuuccaccugacgaccagaaacggggagccucauaugaucgugagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggugccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaaucacaccccaguccagcaucacagaagcugagcugaccggcuacgggacgguuaccauggaauguucuccucggacaggacuugacuucaaugagauggugcugcuccagauggaaaacaaggccuggcugguccaccgccaaugguuucuugaucugccccucccguggcugccuggcgcugacacccagggguccaacuggauucagaaagagacacuggugaccuucaagaauccccacgccaagaaacaggauaucguugugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauugucaucagagugcaguacgagggcgacgggagcccuugcaaaauccccuucgagauuauggaucucgaaaagcgccacguucugggacggcugaucacggugaaucccauugucaccgagaaagacucuccugugaacaucgaagcugagccgcccuuuggcgauuccuacauuaucauugggguugaaccuggccagcucaagcugagcugguucaaaaagggaucuagcaucggccagauguuugagacaaccaugagaggggccaagcgcauggccauccuuggagacacagcuugggauuucggcucccucggcgggguguuuaccucuauugggaaagcccuccaucaagucuucggggcgaucuauggcgcugccuuuagcggaguguccuggacgaugaagauucugaucggcgugguuauuacauggaucgggaugaauagccggucuaccucccugagcgucucucuugugcucgugggagucgugacccuguaccugggcguuauggugcaggccgacuccgggugugucgugagcuggaaaaacaaggagcucaaaugcggauccggcaucuucauuacagauaauguucacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaagucaaacugaccaucaugacaggagacauuaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggaguuuucacaaccaauaucuggcuuaaacugaaggaacggcaagauguguuuugugacuccaaacucaugagcgcugccauuaaggacaacagagcgguccacgccgauaugggcuacuggaucgagucugcucugaacgacacauggaaaaucgaaaaggccuccuucauugaggucaagagcugccacuggcccaaaucucauacccuguggagcaauggcgugcuugaguccgaaaugaucauuccuaagaacuucgcugggcccgucagccagcacaauuaucgcccgggauaccauacgcagacagccggcccuuggcaccucgggcggcuggagauggauuuugacuucugugaaggaaccaccguuguggugacagaggauugcggcaacagagggcccucucugcggaccacgacagccuccggaaaacucaucaccgaauggugcugucgcagcugcacacugcccccucuuagauaccggggcgaggacggcuguugguaugggauggagauuagaccgcugaaggaaaaagaggaaaaucucgucaacucccuggugaccgcuggacauggccagaucgauaauuuuucucuggggguucuuggaauggcgcuguuccuggaggaaaugcugcgcacacgggugggcaccaagcacgccauucuccuggucgcugugagcuuuguuacgcuuaucaccgggaacauguccuucagagaccugggacgcgugauggucauggugggcgccacaaugaccgaugacaucggcauggggguuacauaccucgcccugcuggcugccuuuaaggugagacccaccuucgcggcuggacuucugcuccggaaacugacgucuaaggagcucaugaugacaaccauuggcaucguccugcuuagccaauccacaauuccugagucuauccuggaacucaccgaugcccuggcccuggggaugauggugcuuaaaauugugcgcaauauggagaaguaucagcuggcugucaccaucauggccaucagcugcguucccaacgcggugauucuccagaaugcuuggaaaguguccuguacaacgcuggccgucgugagcguuucuccucuccugcuuaccuccagccaacagaaggccgacuggaucccccuggcucucacaauuaagggacugaacccuaccgccaucuuucugacaacccuuucuagaacguccaaaaagcggagcuggccccugaaugaagcuauuauggccgugggcauggucucuauccucgcguccagccugcucaaaaacgauaucccgaugacagggccucugguggccggaggccuucugaccguuugcuacgugcugaccggccgcuccgcugaccucgagcuggaaagagccgcugacguccggugggaggagcaggccgaaauuagcgggucuagccccauccuuuccauuacaaucucugaggauggaagcauguccauuaagaaugaagaggaggaacagacccugacaauccucauucgcacgggccugcucgugaucucugggcuguucccugucagcauccccauuaccgccgcugcgugguaucuuugggaggugaaaaagcaaagagccggaguucugugggacgugccguccccucccccugucggcaaagcugaacuggaggauggggccuaccggaucaagcagaagggcauucucggcuauucucagaucggcgccgggguguacaaagaaggaacauuucacaccauguggcauguuacacgcggcgcugugcugaugcacaaggggaaaagaauugagcccagcugggccgacgucaagaaagaucuuaucuccuacggaggcggguggaagcuggagggagaauggaaggagggcgaagagguccaggugcucgcgcuggaacccggcaaaaacccucgggcuguucaaaccaagccgggacucuucaaaacgaacaccggaacaaucggcgccgucagccuggacuuuucucccgggaccuccggaagcccuauuguggauaagaaaggcaagguggucgggcuuuauggaaauggcgugguuacaagaucuggcaccuacguguccgccaucgcucagacagaaaagagcauugaggacaaccccgaaaucgaggaugacauuuuccgcaaaaagcggcugacgaucauggaucugcauccuggggccggaaaaaccaagagauaucuccccgcgaucguccgcgaagcuauuaaacggggccugagaacacuuauccuggccccuacccgcgugguugccgcugagauggaagaggcccuccgggggcugccgauuagauaccagacccccgcuauccgcgccgagcacacaggacgggaaauuguggaccucaugugucaugcgacguucaccaugagacugcuuuccccuauccggguccccaauuauaaccugauuaucauggaugaggcccacuuuacagacccugcuucuaucgccgcucgcggcuacauuagcaccagaguggaaaugggggaggccgccggcaucuucaugacagcuacacccccgggaucccgggacccuuuuccccagagcaaugcgcccauuauggaugaggaacgcgagaucccugaaagaucuuggaacuccggccacgaguggguuacggacuucaaggggaagacagugugguuuguccccagcauuaaagccggaaaugauaucgcugccugccugcggaagaacggcaaaaaggugauccaacucucuagaaaaaccuucgacagcgaauauauuaagacccgcacaaaugauugggacuuuguggucaccacagauaucuccgagaugggggccaacuucaaggcugagcggguuauugacccuagacgcuguaugaaaccggugauccugaccgauggagaggaacgggugauucuugccggccccaugccugucacgcauucuagcgcggcucagagacgcgggcgggugggcagaaaucccaagaacgaaaaugaccaguacaucuacaugggagagccucuggaaaacgaugaggacugcgcccacuggaaagaggccaagaugcuccuggacaauaucaacacacccgaaggcauuaucccguccauguuugagccugaacgcgagaaaguugaugcuauugacggggaauauagacugcggggagaggcccgcaagaccuucguggaucucaugagacggggcgaccuucccgucuggcuggcguaccgcguggccgcugaggggaucaacuaugccgauagacggugguguuuugacggaguuaaaaauaaccaaauucuggaagagaauguggaagucgagaucuggacaaaggagggcgaaagaaagaaacucaagccucgcuggcuggaugcucggauuuacucugacccccuugcccugaaagaguucaaggaguucgcugccgggagaaaaagccucacccugaaccugaucacggagaugggccgccucccuaccuuuaugacacagaaggcgaagaaugcccuugauaaccuggcugugcugcauaccgccgaagcuggaggccgggccuauaaucacgcccucuccgagcugcccgagacacuugaaacccugcuccugcugacacuccuugcuaccgucacagggggaaucuuccuguuucugaugagcggcaaagggauuggaaagaugacacucggcaugugcugcaucauuaccgcgucuauccugcuuugguacgcccagauucagccgcacuggaucgcugccuccaucauucuggaguucuuucucaucgugcugcugauuccugaacccgagaaacaaagaacaccccaggacaaccagcucacauauguugugaucgccauucuuaccguggucgcugccacaauggcgaaugaaaugggcuuccuggagaagacgaaaaaggauuuugggcugggaagcaucaccacacagcaaccugaguccaacauccucgacauugaucugcggccggccucugcuuggacccuuuacgccguugcuacaaccuucaucacgcccaugcugcgccauagcauugaaaauuccucugugaacgugagccucaccgccaucgcgaaucaggccacaguccugaugggccuggggaagggauggccucucuccaaaauggacauuggcgugccccuucuggcuaucggguguuacagccagguuaacccuauuacccugacagccgcucuccugcuucugguggcccacuaugcuaucaucggacccggccuccaggccaaggcgaccagagaggcccaaaaacgggcugccgcuggcauuaugaagaauccuacggucgacgggaugacagugaucgaucuggacccgauucccuacgauccuaaauuugaaaagcagcugggacaggucaugcuccuugugcugugcguuacccaggugcugaugaugcgcacaaccugggcccucugugaggcccugacccuugcgacaggccccaucucuacgcugugggaagggaacccuggaagauucuggaauaccacaauugcugucuccauggccaacaucuuucggggcagcuaucucgcuggggccggacugcuguucucuaucaugaagaacaccgccaauacacgcagaggcaccggcaacacgggggagacacucggagagaaauggaagaaucggcuuaacgcucugggcaaauccgaauuucaaauuuacaagaaaagcgggauccaggagguggaccgcacccuggccaaggaaggaauuaaaagaggcgagaccgaucaucacgcgguuucucgggggagcgccaagcucagaugguucguggagcgcaaucuggucacacccgaaggaaaggugguggaccuuggcugcggcagagggggaugguccuauuacuguggcgggcugaaaaacguuaaggaggucaaaggacucaccaagggcgggccgggacaugaagaaccuauccccaugucuacauauggcuggaaucuggugagacugcagagcggcguggaugucuucuuuacgcccccugaaaaaugcgacacccuccuuugugauauuggggaguccagccccaacccuacaguugaggcuggacgcacccugcgggugcugaaucucguggaaaacuggcugaauaacaauacacaauucugcaucaagguccuuaacccguacaugcccuccgugaucgagaagauggaagcccugcagagaaaauacggcggggcucucguucgcaauccucugucucggaacagcacccacgagauguauuggguguccaacgccucuggaaauauugucagcuccgugaacaugaucucuagaaugcugauuaaucgcuuuacgaugcggcacaagaaagcgaccuacgaacccgacguugaucucggcagcgggacaagaaacaucggaauugaguccgagaccccuaaucuugacaucaucggcaagcgcauugagaagaucaagcaggagcaugaaacaagcuggcacuaugaucaggaccaucccuacaagaccugggccuaucacggcucuuacgagacaaaacaaaccggguccgcuagcucuauggugaacggagucgugcggcugcugacgaagccgugggacgugauuccuauggucacacagauggccaugaccgauaccacacccuucggccagcagagaguuuuuaaagaaaagguggacacgcgcacccaagagccuaaagaggggacaaagaagcucaugaaaaucaccgcugaauggcuguggaaggagcuuggcaaaaagaaaacacccagaauguguacccgggaagaguucacacgcaaggugagauccaaugccgcucugggcgccauuuuuaccgaugagaacaaauggaaaagcgcgcgggaagccgucgaggacucuggguucugggaacucguggauaaggagagaaaucugcaccuggaaggaaaaugcgagacguguguuuauaacaugaugggcaagcgggagaaaaagcucggcgaauuugggaaagcuaagggaucccgcgccaucugguacauguggcugggcgcuagauuccuugaguuugaagcccugggguuccucaaugaggaccauugguuuagccgggaaaacucccugagcggaguggagggcgaggggcuucacaagcugggcuacauucuccgcgaugucucuaaaaaggaaggaggcgccauguaugcggacgauaccgcugggugggacacaagaaucacccuggaggaucugaaaaaugaagagauggugacaaaccauauggaaggagagcacaagaaacucgccgaggccaucuucaagcugaccuaccagaauaagguugugcggguccagcgcccuacgcccagaggcacagugauggacauuaucagccggcgcgaccagagaggguccggacaaguugugaccuauggccuuaacacauucaccaacauggaagcucagcugauucggcagauggagggggaaggcgucuuuaaaucuauccaacagcucacggugaaggaggagauugccgucaaaaauuggcugauccgcgugggaagagaacggcuuagccgcauggcuaucuccggcgaugacugcguugugaagccgcuggaugacagauucgccucugcgcucaccgcccugaacgauauggggaaaguccggaaggacauucagcagugggagccuagcagaggauggaaugauuggacacaagugcccuuuugcucccaucacuuccacgaacugaucaugaaggacggccgcgugcucguugugcccugucggaaccaggaugagcugauugggagagcucgcaucucucagggagccggcuggagccuucgggaaaccgcuugccuggggaaauccuacgcccagauguggagccucauguauuuucauagacgcgaccugcggcuugcggccaaugcuauuuguucugccgucccuucccacuggaucccgacaagcagaaccacauggucuauccaugcuacccacgaguggaugacgacagaggauaugcugaccguguggaaccgcguuuggauucaagaaaaucccuggauggaggacaagaccccuguggaauccugggaggaaauccccuaccucggcaaacgggaggaucaguggugcggaagccugauuggccugacauccagagccaccugggcuaagaacauccagacagccauuaaucagguccgcucucucaucgggaacgaggaauauacggacuacaugccuagcaugaaacgguucagacgggaggaagaggaagcgggagugcugugguga

SEQ ID NO: 19629 - RNA, 9876 nt, Artificial Sequence
  derived and/or modified CDS sequence (opt5) from DENV-2__KM279569__SS-prME
accgccggaaucauuaucaugaugauucccaccgugauggcuuuccaccugacgaccagaaacggggagccucauaugaucgucagccggcaggaaaagggaaaaucccuccuguuuaagacagagaauggcguuaacaugugcacccuuauggccauggaccugggggaacucugugaggauaccauuaccuacaauugcccgcugcuucgccaaaacgaacccgaggacaucgauuguuggugcaauucuacaagcaccugggugacguauggaaccuguacagcgaccggcgagcacagacgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggacccuuagaccgcagccuacggagcucaaguacagcuggaaagcguggggaaaggccaagaugcuguccaccgaacugcacaaucauacauuccucauugauggccccgagaccgcugaaugcccuaacacaaaucgcgccuggaacagccuggagguggaggacuauggguuuggagucuucaccacaaauaucuggcuuaaacugaaggaacggcaagauguguuuugugacucuaaacucauguccgcugccauuaaggacaacagagcggugcacgccgauaugggcuacuggaucgagagcgcucugaacgacaccuggaaaauugaaaaggccucuuucaucgaggucaaguccugccacuggcccaaaagccauacgcuguggucuaauggcguucuugagagcgaaaugaucauuccuaagaacuucgcugggcccgugucccagcacaauuaucgcccgggauaccauacacagaccgccggcccuuggcaccucgggcggcuggagauggauuuugacuucugugaaggaaccacaguggucgugaccgaggauugcggcaacagagggcccagccugcggacgacaaccgccucuggaaaacucaucacagaauggugcugucgcuccugcacccugcccccucuuagauaccggggcgaggacggcuguugguaugggauggagauuagaccgcugaaggaaaaagaggaaaaucucguuaacagccuggugacagcuggacauggccagaucgauaauuuuucccuggggguccuuggaauggcgcuguuccuggaggaaaugcugcgcacccgggugggcacgaagcacgccauucuccugguugcugugucuuuugucacccuuaucacagggaacaugagcuucagagaccugggacgcgugaugguuauggugggcgccaccaugacagaugacauuggcaugggggucaccuaccucgcccugcuggcugccuuuaaggugagacccacguucgcggcuggacuucugcuccggaaacugacauccaaggagcucaugaugaccacaaucggcaucgugcugcuuucucaaagcaccauuccugaguccauccuggaacucaccgaugcccuggcccuggggaugaugguccuuaaaauuguucgcaauauggagaaguaucagcuggcugugacaaucauggccauucucugcgugcccaacgcggucauccugcagaaugcuuggaaagugucuuguacgacccucgccguugugagcgucuccccucugcuucugacaagcucucaacagaaggccgacuggaucccccucgcucugaccauuaagggacugaacccuacagccaucuuucuuaccacgcuguccagaacaagcaaaaagcggucuuggccccucaaugaagcuauuauggccgugggcaugguuuccauccuggcgagcucucuccugaaaaacgauauuccgaugaccgggccucuuguggccggaggccugcugaccgucugcuacgugcucacaggccgcuccgcugaccuggagcuugaaagagccgcugacguccggugggaggagcaggccgaaaucagcggguccagccccauccugucuauuaccaucagcgaggauggauccaugucuauuaagaaugaagaggaggaacagacacucacgauccugauucgcaccggccuccuggugaucagcgggcuuuucccuguuuccauucccaucacagccgcugcgugguaucugugggaggugaaaaagcaaagagccggaguccugugggacgugccgucuccucccccuguuggcaaagcugaacucgaggauggggccuaccggaucaagcagaagggcauucugggcuauagccagaucggcgccgggguguacaaagaaggaaccuuucacacaauguggcaugucacccgcggcgcugugcuuaugcacaaggggaaaagaauugagcccuccugggccgacgugaagaaagaucugaucucuuacggaggcggguggaagcucgagggagaauggaaggagggcgaagagguucagguccuggcgcucgaacccggcaaaaacccucgggcugugcaaacgaagccggggcuguucaaaaccaacacaggaaccauuggcgccgugagccuugacuuuucccccgggacaagcggaucuccuaucgucgauaagaaaggcaaggugguugggcuguauggaaauggcguggucaccagauccggcacauacgugagcgccaucgcucagacggagaagucuauugaggacaaccccgaaaucgaggaugacauuuuccgcaaaaagcggcugaccaucauggaucuccauccuggggccggaaaaacaaagagauaucugcccgcgauuguucgcgaagcuaucaaacggggccuuagaacccugauccucgccccuacccgcguggucgccgcugagauggaagaggcccugcgggggcucccgauuagauaccagacacccgcuauccgcgccgagcacacgggacgggaaauuguggaccugaugugucaugcgaccuucacaaugagacuucuguccccuauccggguucccaauuauaaccugauuaucauggaugaggcccacuuuaccgacccugcuagcauugccgcucgcggcuacaucuccacaagaguggaaaugggggaggccgccggcaucuucaugaccgcuacgcccccgggaucucgggacccuuuuccccagagcaaugcgcccauuauggaugaggaaaaggagaucccugaacgcuccuggaacagcggccacgagugggucacagacuucaaggggaaaaccgugugguuugugcccucuauuaaggccggaaaugauaucgcugccugccuccgcaagaacggcaagaaagucauucaacugucccggaagaccuucgacagcgaauauaucaagacaagaaccaaugauugggacuuuguugugacaaccgauaucucugagaugggggccaacuucaaagcugagcgcgugauugacccucggagauguaugaagccggucauccuuacggauggagaggaacgcgugauucuggccggccccaugccuguuacacauagcuccgcggcucagcggagagggcgcgugggccggaaucccaaaaacgaaaaugaccaguacaucuacaugggagagccucucgaaaacgaugaggacugcgcccacuggaaggaggccaaaaugcugcuggacaauauuaacacccccgaaggcaucaucccgucuauguuugagccugaaagagagaaggucgaugcuauugacggggaauaucgccucagaggagaggcccggaaaacauucguggaucuuaugcgcagaggcgaccugcccguuuggcuggcguaccggguggccgcugaggggaucaacuaugccgaucgcagaugguguuuugacggagucaagaauaaccaaauucucgaagagaauguggaagucgagaucuggaccaaggagggcgaacggaaaaagcugaaaccuagauggcuugaugcucgcauuuacagcgacccccuggcccucaaggaguucaaagaguucgcugccgggcggaagucccugacgcugaaccucaucaccgagaugggcagacuuccuacauuuaugacccagaaggcgaaaaaugcccuggauaaccuggcugugcuccauacagccgaagcuggaggccgcgccuauaaucacgcccugucugagcuucccgagacccuggaaacacuccugcugcucacccuucuggcuacgguuacagggggaauuuuccuguuucucaugagcggcaaggggaucggaaaaaugacccugggcaugugcugcaucauuaccgcguccauccuucugugguacgcccagauucagccgcacuggaucgcugccagcauuauccucgaguucuuucugaucgugcugcucauuccugaacccgagaagcaacggacaccccaggacaaccagcuuaccuauguggucaucgccauucugacaguuguggcugccacgauggcgaaugaaaugggcuuccuggagaaaaccaagaaggauuuugggcucggaucuaucacaacccagcaaccugaguccaacauucuggacaucgaucuuagaccggccagcgcuuggacacuguacgccguggcuaccacguucaucacccccaugcuccggcauuccauugaaaauucuagcgucaacgugucccugacagccaucgcgaaucaggccaccguucugaugggccucgggaaaggauggccucuuucuaagauggacauuggcgugccccugcuggcuaucggguguuacagccaggucaacccuauuacacucaccgccgcucugcuucugcucguggcccacuaugcuaucauuggacccggccugcaggccaaagcgacgcgcgaggcccaaaagagagcugccgcuggcaucaugaaaaauccuacagucgacgggaugaccgugaucgaucuggacccgauucccuacgauccuaaguuugaaaagcagcucggacagguuaugcuucuggugcugugcgucacacaggugcucaugaugcggaccaccugggcccugugugaggcccuuacacuggcgacgggccccaucuccacccucugggaagggaacccuggacgcuucuggaauacaaccauugcuguuagcauggccaacaucuuuagaggcucuuaucuggcuggggccggacuccuguucuccauuaugaaaaacacagccaauacccggcgcggcacgggcaacacaggggagacccuuggagagaaguggaaaaauagacugaacgcucugggcaagagcgaauuucaaaucuacaaaaagucugggauccaggagguggaccggacccucgccaaagaaggaauuaagcgcggcgagacagaucaucacgcggucuccagagggagcgccaagcugcggugguucguggagagaaaucuugugacccccgaaggaaaaguugucgaccugggcugcggccgcgggggauggucuuauuacuguggcgggcucaagaacgugaaagaggugaagggacugacaaaaggcgggccgggacaugaagaaccuauccccaugagcacguauggcuggaaucugguccggcuccaguccggcguugauguguucuuuacacccccugaaaagugcgacacacuucugugugauauuggggagucuagccccaacccuaccguggaggcuggaagaacacugcgcguccucaaucugguggaaaacuggcuuaauaacaauacccaauucugcaucaagguucugaacccguacaugcccuccgugauugagaaaauggaagcccuccagcggaaguacggcggggcucuggucagaaauccucugagccgcaacuccacgcacgagauguauugggugucuaacgccagcggaaauaucguuuccucugugaacaugaucagccggaugcucauuaauagauuuaccaugcgccacaaaaaggcgacauacgaacccgacgucgaucuuggcuccgggacccggaacaucggaauugagucugagacaccuaaucuggacaucauuggcaaaagaaucgaaaagaucaagcaggagcaugaaaccagcuggcacuaugaucaggaccaucccuacaaaacaugggccuaucacggcuccuacgagaccaagcaaacggggagcgcuucuuccauggugaacggagugguccgccugcucacaaaaccgugggacguuauuccuauggugacccagauggccaugaccgauacaacgcccuucggccagcagcggguguuuaaggaaaaagucgacaccagaacacaagagccuaaggaggggaccaagaaacugaugaagaucacagcugaauggcuuuggaaagagcugggaaagaaaaagacccccagaauguguacaagagaagaguucacccggaaagugcgcagcaaugccgcucucggcgccauuuuuacggaugagaacaaguggaagucugcgagagaagccguugaggacuccggguucugggaacugguggauaaagagcggaaucugcaccucgaaggaaagugcgagaccugugucuauaacaugaugggcaaaagagagaagaaacugggcgaauuugggaaggcuaagggaagccgggccaucugguacauguggcuuggcgcucgcuuccuggaguuugaagcccucggguuccugaaugaggaccauugguuuucuagagaaaacucccuuagcggaguggagggcgaggggcugcacaaacucggcuacauucugcgggauguuuccaagaaagaaggaggcgccauguaugcggacgauacagcugggugggacacccgcaucacacuggaggaucucaagaaugaagagauggugaccaaccauauggaaggagagcacaaaaagcuggccgaggccauuuucaaacuuacguaccagaauaaagucgugagaguucagcggccuacaccccgcggcaccgugauggacaucaucagcagacgggaccagcgcgggucuggacaagucgugacauauggccugaacaccuucacgaacauggaagcucagcucauuagacagauggagggggaaggcgucuuuaagagcauccaacagcugaccgugaaagaggagauugccguuaaggauuggcuuauccgggugggacgcgaaagacugucccggauggcuauuucuggcgacgauugcgucgugaaaccgcucgacgaucgcuucgccagcgcgcugacagcccugaaugacauggggaaggugagaaaggauauccagcagugggagccuucccggggauggaacgacuggacccaaguucccuuuugcucucaucacuuccacgaacucaucaugaaagauggcagagugcuggucgugcccugucgcaaucaggacgagcuuauugggcgggcuagaaucagccagggagccggcuggucccugcgcgaaacagcuugccucgggaagucuuacgcccagauguggagccugauguauuuucaucggagagaucuucgccuggcggccaacgcuauuuguuccgccguuccuagccacuggaucccgaccucucggacaaccugguccauucaugcuacgcacgaguggaugacaaccgaggacaugcucaccguguggaauagagucuggauccaagaaaaccccuggauggaggauaaaacaccuguggaaagcugggaggaaauccccuaccugggcaagcgcgaggaccaguggugcggaucucugauuggccucaccucccgggccacaugggcuaaaaauauccagacggccauuaaccaggucagaagccugaucgggaaugaggaauauaccgacuacaugccuuccaugaagcgcuuccggagagaggaagaggaagcgggagugcuuugguga

SEQ ID NO: 19630 - RNA, 9876 nt, Artificial Sequence
  derived and/or modified CDS sequence (opt5) from DENV-2__KM279570__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggccgucacagaggauugcggcaacagagggcccucucugcggaccacgacagcuuccggaaaacucaucaccgaauggugcugucgcagcugcacacugcccccucuuagauaccggggcgaggacggcuguugguaugggauggagauuagaccgcugaaggaaaaagaggaaaaucucgugaacucccugguuaccgcgggacauggccagaucgauaauuuuucucugggggugcuuggaauggcccucuuccuggaggaaaugcugcgcacacgggucggcaccaagcacgcuauucuccugguggccguuagcuuugugacgcuuaucaccgggaacauguccuucagagaccugggacgcgucauggugaugguuggcgccacaaugaccgaugacauuggcaugggggugacauaccucgcucugcuggccgcguuuaaggucagacccaccuucgcugccggacuucugcuccggaaacugacgucuaaggagcucaugaugacaaccaucggcaucgugcugcuuagccaauccacaauuccugagucuauccuggaacucaccgaugcccuggcucuggggaugauggugcuuaaaauuguccgcaauauggagaaguaucagcuggccguuaccaucauggcgauucucugcgugcccaacgcugugauccugcagaaugccuggaaagucagcuguacaacgcucgccgugguuuccgugagcccucugcuucugaccucuucccaacagaaggcugacuggaucccccucgcccugacaauuaagggacugaacccuaccgcuaucuuucuuacaacccugagcagaacgucuaaaaagcgguccuggccccucaaugaagccauuauggcggucggcauggugagcauccuggccucuucccuccugaaaaacgauauuccgaugacagggccucuuguugcuggaggccugcugaccgugugcuacguccucaccggccgcagcgccgaccuggagcuugaaagagcugccgacgugcggugggaggagcaggccgaaaucuccgggagcucucccauccugagcauuacaaucuccgaggauggaucuaugagcauuaagaaugaagaggaggaacagacccucacaauccugauucgcacgggccuccuggucaucuccgggcuuuucccugugucuauucccaucaccgcugcggccugguaucugugggagguuaaaaagcaaagagcuggagugcugugggacgucccgagcccucccccugugggcaaagccgaacucgaggauggggccuaccggaucaagcagaagggcauucugggcuauucccagaucggcgcugggguuuacaaagaaggaacauuucacaccauguggcaugugacacgcggcgccguccuuaugcacaaggggaaaagaauugagcccucuugggcggacgugaagaaagaucugaucagcuacggaggcggguggaagcucgagggagaauggaaggagggcgaagaggugcagguucuggcucucgaacccggcaaaaacccucgggccguccaaaccaagccggggcuguucaaaacgaacaccggaacaauuggcgccgugucccuugacuuuagccccgggaccucuggauccccuaucguggauaagaaaggcaaggucguggggcuguauggaaauggcguugugacaagaagcggcaccuacgucucugcuaucgcccagacagagaaguccauugaggacaaccccgaaaucgaggaugacauuuuccgcaaaaagcggcugacgaucauggaucuccauccuggggcgggaaaaaccaagagauaucugcccgcuauugugcgcgaagccaucaaacggggccuuagaacacugauccucgccccuacccgcguuguggcugccgagauggaagaggcucugcgggggcucccgauuagauaccagacccccgccauccgcgcggagcacacaggacgggaaauugucgaccugaugugucaugccacguucaccaugagacuucugagcccuauccgggugcccaauuauaaccugauuaucauggaugaggcucacuuuacagacccugccuccauugcugcccgcggcuacaucucuaccagaguugaaaugggggaggccgcuggcaucuucaugacagcgacacccccgggaagccgggacccuuuuccccaguccaaugcccccauuauggaugaggaacgcgagaucccugaaagaagcuggaacucuggccacgagugggugacggacuucaaggggaagacagucugguuugugcccuccauuaaagcuggaaaugauaucgccgccugccuccggaagaacggcaaaaaggugauucaacugagcagaaaaaccuucgacucugaauauaucaagacccgcacaaaugauugggacuuugucguuaccacagauaucagcgagaugggggcuaacuucaaggccgagcgggugauugacccuagacgcuguaugaaaccggugauccuuaccgauggagaggaacgggucauucuggcgggccccaugccugugacgcauuccucugcugcccagagacgcgggcggguuggcagaaaucccaagaacgaaaaugaccaguacaucuacaugggagagccucucgaaaacgaugaggacugcgcccacuggaaagaggcuaagaugcugcuggacaauauuaacacacccgaaggcaucaucccgagcauguuugagccugaacgcgagaaaguggaugccauugacggggaauauagacuccggggagaggcgcgcaagaccuucgucgaucuuaugagacggggcgaccugcccguguggcuggccuaccgcguugcugccgaggggaucaacuaugcugauagacggugguguuuugacggagugaaaaauaaccaaauucucgaagagaaugucgaaguggagaucuggacaaaggagggcgaaagaaagaaacugaagccucgcuggcuugaugcccggauuuacuccgacccccuggcucucaaagaguucaaggaguucgccgcggggagaaaaucucugacccugaaccucaucacggagaugggccgccuuccuaccuuuaugacacagaaggccaagaaugcucuggauaaccuggccguccuccauaccgcugaagccggaggccgggccuauaaucacgcucugagcgagcuucccgagacacuggaaacccuccugcugcucacacuucuggcgaccgugacagggggaauuuuccuguuucucauguccggcaaagggaucggaaagaugacacugggcaugugcugcaucauuaccgccagcauccuucugugguacgcucagauucagccgcacuggaucgccgccucuauuauccucgaguucuuucugaucguucugcucauuccugaacccgagaaacaaagaacaccccaggacaaccagcuuacauauguggugaucgcuauucugaccgucguugccgcgacaauggccaaugaaaugggcuuccuggagaagacgaaaaaggauuuugggcucggauccaucaccacacagcaaccugagagcaacauucuggacaucgaucuucggccggcuuccgccuggacccuguacgcuguggccacaaccuucaucacgcccaugcuccgccauucuauugaaaauagcuccgugaacgucucucugaccgcgaucgccaaucaggcuacagugcugaugggccucgggaagggauggccucuuagcaaaauggacauuggcguuccccugcuggccaucggguguuacucccaggugaacccuauuacccucacagcugcccugcuucugcucgucgcucacuaugccaucauuggacccggccugcaggcgaaggccaccagagaggcucaaaaacgggccgcugccggcaucaugaagaauccuacgguggacgggaugacagucaucgaucuggacccgauucccuacgauccuaaauuugaaaagcagcucggacaggugaugcuucugguucugugcgugacccagguccucaugaugcgcacaaccugggcccugugugaggcgcuuacccuggcuacaggccccaucagcacgcucugggaagggaacccuggaagauucuggaauaccacaauugccgugucuauggcuaacaucuuucggggcuccuaucuggccggggccggacugcuguucagcauuaugaagaacaccgcuaauacacgcagaggcaccggcaacacgggggagacacuuggagagaaauggaagaaucggcugaacgcccugggcaaaucugaauuucaaaucuacaagaaauccgggauccaggagguugaccgcacccucgcgaaggaaggaauuaaaagaggcgagaccgaucaucacgccgugagccgggggucugcuaagcugagaugguucgucgagcgcaaucuugugacacccgaaggaaaggugguugaccugggcugcggcagagggggauggagcuauuacuguggcgggcucaaaaacgucaaggaggugaaaggacugaccaagggcgggccgggacaugaagaaccuauccccauguccacauauggcuggaaucuggugagacuccagucuggcgucgauguuuucuuuacgcccccugaaaaaugcgacacccuucugugugauauuggggagagcucccccaacccuacaguggaggccggacgcacccugcgggugcucaaucuggucgaaaacuggcuuaauaacaauacacaauucugcaucaaggugcugaacccguacaugcccagcguuauugagaagauggaagcucuccagagaaaauacggcggggcccuggugcgcaauccucugucccggaacucuacccacgagauguauugggucagcaacgcguccggaaauaucgugucuagcguuaacaugaucuccagaaugcucauuaaucgcuuuacgaugcggcacaagaaagccaccuacgaacccgacguggaucuuggcucugggacaagaaacaucggaauugagagcgagaccccuaaucuggacaucauuggcaagcgcaucgagaagaucaagcaggagcaugaaacauccuggcacuaugaucaggaccaucccuacaagaccugggcuuaucacggcagcuacgagacaaaacaaaccgggucugccuccagcauggucaacggaguggugcggcugcucacgaagccgugggacgucauuccuaugguuacacagauggcuaugaccgauaccacacccuucggccagcagagaguguuuaaagaaaagguggacacgcgcacccaagagccuaaagaggggacaaagaagcugaugaaaaucaccgccgaauggcuuuggaaggagcugggcaaaaagaaaacacccagaauguguacccgggaagaguucacacgcaaggucagaucuaaugcugcccucggcgcgauuuuuaccgaugagaacaaauggaaguccgcccgggaagcuguggaggacagcggguucugggaacugguugauaaggagagaaaucugcaccucgaaggaaaaugcgagacguguguguauaacaugaugggcaagcgggagaaaaagcugggcgaauuugggaaagccaagggaucucgcgcuaucugguacauguggcuuggcgccagauuccuggaguuugaagcccucggguuccugaaugaggaccauugguuuucccgggaaaacagccuuuccggagucgagggcgaggggcugcacaagcucggcuacauucugcgcgaugugagcaaaaaggaaggaggcgcgauguaugcugacgauaccgccgggugggacacaagaaucacccuggaggaucucaaaaaugaagagaugguuacaaaccauauggaaggagagcacaagaaacuggccgaggcuauuuucaaacuuaccuaccagaauaaggugguccgggugcagcgcccuacgcccagaggcacaguuauggacaucaucucucggcgcgaccagagagggagcggacaaguggucaccuauggccugaacacauucaccaacauggaagcccagcucauucggcagauggagggggaaggcguguuuaaauccauccaacagcugacggucaaggaggagauugcugugaaaaauuggcuuauccgcguuggaagagaacggcugucucgcauggccauuagcggcgaugacugcguggucaagccgcucgaugacagauucgcguccgcccugaccgcucugaacgauauggggaaagugcggaaggacauccagcagugggagccuucuagaggauggaaugauuggacacaagugcccuuuugcagccaucacuuccacgaacucaucaugaaggacggccgcguucuggugguccccugucggaaccaggaugagcuuauugggagagcccgcaucucccagggagcuggcuggucucugcgggaaaccgccugccucgggaaaagcuacgcgcagauguggucccugauguauuuucauagacgcgaccuucggcuggccgcuaaugccauuuguagcgcugugccuucucacuggaucccgacauccagaaccacauggagcauucaugccacccacgaguggaugacgacagaggauaugcucaccguuuggaaccgcguguggauccaagaaaaucccuggauggaggacaagaccccugucgaaucuugggaggaaauccccuaccugggcaaacgggaggaucaguggugcggaucccugauuggccucacaagcagagcuaccugggccaagaacauccagacagcgauuaaucaggugcgcucccugaucgggaacgaggaauauacggacuacaugccuucuaugaaacgguucagacgggaggaagaggaagccggaguccuuugguga

SEQ ID NO: 19631 - RNA, 9876 nt, Artificial Sequence
  derived and/or modified CDS sequence (opt5) from DENV-2__KM279596__SS-prME
accgccggaaucauuaucaugaugauucccaccgugauggcuuuccaccugacgaccagaaacggggaaccucauaugaucgucagccggcaggaaaagggaaaaucccuccuguuuaagaccgagaauggaguuaacaugugcacccuuauggccauggaccugggggaacucugugaggauaccauuaccuacaauugcccgcugcuucgccaaaacgaacccgaggacaucgauuguuggugcaauucuacgagcaccugggugacguauggaaccuguacagcgaccggcgagcaccggcgggaaaaacgcuccguggcucuggucccucauguggggaugggacucgagacaagaaccgaaacguggaugucuagcgagggcgccuggaagcacgcccagcggaucgagacauggauucugcgccaucccggcuucaccaucauggcugccauucuggcuuacacaaucgggaccaccuauuuucagagaguucucauuuucauccugcuuacagccgugacgccuuccauggcgaugcggugcauuggaaucucuaaccgcgacuuugucgaaggcgugagcgggggauccuggguugauaucgugcuggagcacggcagcugugucaccacaauggccaaaaauaagcccacccucgacuucgaacugauuaagacagaggcuaaacaccuugccacccugagaaaguacugcguggaagcuaaacucacgaacacaaccaccgccucucgguguccuacacagggggagccgucccugaaugaggaacaagauaagcgcuuugugugcaaacauagcauggucgacagaggauggggcaacggcugugggcuguucggaaagggcgggaucguuaccugcgcgauguuuacaugcaagaaaaauauggagggaaagguggugcagcccgaaaaccucgaguauacgauugucaucaccccucacucuggcgaagagaaugccguggggaacgauacaggaaaacauggcaaggagauuaaaguuacaccccaguccagcaucacagaagcugagcugaccggcuacgggacggugaccauggaauguucuccucggacaggacuugacuucaaugagaugguccugcuccagauggaaaacaaggccuggcuggugcaccgccaaugguuucuugaucugccccucccguggcugccuggcgcugacacccagggguccaacuggauccagaaagagacacugguuaccuucaagaauccccacgccaagaaacaggauguggucgugcucggaagccaagagggcgccaugcauacggcucugacaggggcgaccgaaauucagauguccucuggcaaccuucuguuuacaggacaccucaagugcagacugcggauggacaaacuucagcugaagggcaugagcuauuccauguguaccgggaaauucaaggucgugaaggagaucgccgaaacccaacauggaacaauuguuaucagagugcaguacgagggcgacgggagcccuugcaaaauucccuucgagaucauggaucucgaaaagcgccacguccugggacggcugaucacggugaaucccauuguuaccgagaaagacucuccugugaacaucgaagcugagccgcccuuuggcgauuccuacauuaucauuggggucgaaccuggccagcucaagcugagcugguucaaaaagggaucuagcaucggccagauguuugagacaaccaugagaggggccaagcgcauggccauucuuggagacacagcuugggauuucggcucccucgggggaguguuuaccucuaucggcaaagcccuccaucaaguguucggggcgaucuauggcgcugccuuuagcggaguuuccuggacgaugaagauucugaucggcgucgugauuacauggaucgggaugaauagccggucuaccucccugagcgugucucuuguccucgugggaguugugacccuguaccugggcgucauggugcaggccgacuccggguguguugugagcuggaaaaacaaggagcucaaaugcggauccggcauuuucaucacagauaauguccacaccuggacagaacaguauaaguuucagcccgagucuccuagcaagcuggcuuccgccauccaaaaagcucacgaagaggggauuuguggcaucagaucugugacgcgccuugaaaaccugauguggaagcagauuacccccgagcucaaucauauccugacagagaacgaaguuaaacugaccauuaugacaggagacaucaagggcaucaugcaggccgggaaacggagccuuagaccgcagccuaccgagcucaaguacuccuggaaagcguggggaaaggccaagaugcugagcacggaacugcacaaucauaccuuccucauugauggccccgagacagcugaaugcccuaacaccaaucgcgccuggaacucucuggagguggaggacuauggguuuggagucuucacaaccaauaucuggcuuaaacugaaggaacggcaagauguguuuugugacuccaaacucaugagcgcugccauuaaggacaacagagcggugcacgccgauaugggcuacuggaucgagucugcucugaacgacacauggaaaauugaaaaggccuccuucaucgaggucaagagcugccacuggcccaaaucucauacccuguggagcaauggcguucuugaguccgaaaugaucauuccuaagaacuucgcugggcccgugagccagcacaauuaucgcccgggauaccauacgcagacagccggcccuuggcaccucgggcggcuggagauggauuuugacuucugugaaggaaccaccguggccgucacagaggauugcggcaacagagggcccucucugcggaccacgacagcuuccggaaaacucaucaccgaauggugcugucgcagcugcacacugcccccucuuagauaccggggcgaggacggcuguugguaugggauggagauuagaccgcugaaggaaaaagaggaaaaucucgugaacucccugguuaccgcgggacauggccagaucgauaauuuuucucugggggugcuuggaauggcccucuuccuggaggaaaugcugcgcacacgggucggcaccaagcacgcuauucuccugguggccguuagcuuugugacgcuuaucaccgggaacauguccuucagagaccugggacgcgucauggugaugguuggcgccacaaugaccgaugacauuggcaugggggugacauaccucgcucugcuggccgcguuuaaggucagacccaccuucgcugccggacuucugcuccggaaacugacgucuaaggagcucaugaugacaaccaucggcaucgugcugcuuagccaauccacaauuccugagucuauccuggaacucaccgaugcccuggcucuggggaugauggugcuuaaaauuguccgcaauauggagaaguaucagcuggccguuaccaucauggcgauucucugcgugcccaacgcugugauccugcagaaugccuggaaagucagcuguacaacgcucgccgugguuuccgugagcccucugcuucugaccucuucccaacagaaggcugacuggaucccccucgcccugacaauuaagggacugaacccuaccgcuaucuuucuuacaacccugagcagaacgucuaaaaagcgguccuggccccucaaugaagccauuauggcggucggcauggugagcauccuggccucuucccuccugaaaaacgauauuccgaugacagggccucuuguugcuggaggccugcugaccgugugcuacguccucaccggccgcagcgccgaccuggagcuugaaagagcugccgacgugcggugggaggagcaggccgaaaucuccgggagcucucccauccugagcauuacaaucuccgaggauggaucuaugagcauuaagaaugaagaggaggaacagacccucacaauccugauucgcacgggccuccuggucaucuccgggcuuuucccugugucuauucccaucaccgcugcggccugguaucugugggagguuaaaaagcaaagagcuggagugcugugggacgucccgagcccucccccugugggcaaagccgaacucgaggauggggccuaccggaucaagcagaagggcauucugggcuauucccagaucggcgcugggguuuacaaagaaggaacauuucacaccauguggcaugugacacgcggcgccguccuuaugcacaaggggaaaagaauugagcccucuugggcggacgugaagaaagaucugaucagcuacggaggcggguggaagcucgagggagaauggaaggagggcgaagaggugcagguucuggcucucgaacccggcaaaaacccucgggccguccaaaccaagccggggcuguucaaaacgaacaccggaacaauuggcgccgugucccuugacuuuagccccgggaccucuggauccccuaucguggauaagaaaggcaaggucguggggcuguauggaaauggcguugugacaagaagcggcaccuacgucucugcuaucgcccagacagagaaguccauugaggacaaccccgaaaucgaggaugacauuuuccgcaaaaagcggcugacgaucauggaucuccauccuggggcgggaaaaaccaagagauaucugcccgcuauugugcgcgaagccaucaaacggggccuuagaacacugauccucgccccuacccgcguuguggcugccgagauggaagaggcucugcgggggcucccgauuagauaccagacccccgccauccgcgcggagcacacaggacgggaaauugucgaccugaugugucaugccacguucaccaugagacuucugagcccuauccgggugcccaauuauaaccugauuaucauggaugaggcucacuuuacagacccugccuccauugcugcccgcggcuacaucucuaccagaguugaaaugggggaggccgcuggcaucuucaugacagcgacacccccgggaagccgggacccuuuuccccaguccaaugcccccauuauggaugaggaacgcgagaucccugaaagaagcuggaacucuggccacgagugggugacggacuucaaggggaagacagucugguuugugcccuccauuaaagcuggaaaugauaucgccgccugccuccggaagaacggcaaaaaggugauucaacugagcagaaaaaccuucgacucugaauauaucaagacccgcacaaaugauugggacuuugucguuaccacagauaucagcgagaugggggcuaacuucaaggccgagcgggugauugacccuagacgcuguaugaaaccggugauccuuaccgauggagaggaacgggucauucuggcgggccccaugccugugacgcauuccucugcugcccagagacgcgggcggguuggcagaaaucccaagaacgaaaaugaccaguacaucuacaugggagagccucucgaaaacgaugaggacugcgcccacuggaaagaggcuaagaugcugcuggacaauauuaacacacccgaaggcaucaucccgagcauguuugagccugaacgcgagaaaguggaugccauugacggggaauauagacuccggggagaggcgcgcaagaccuucgucgaucuuaugagacggggcgaccugcccguguggcuggccuaccgcguugcugccgaggggaucaacuaugcugauagacggugguguuuugacggagugaaaaauaaccaaauucucgaagagaaugucgaaguggagaucuggacaaaggagggcgaaagaaagaaacugaagccucgcuggcuugaugcccggauuuacuccgacccccuggcucucaaagaguucaaggaguucgccgcggggagaaaaucucugacccugaaccucaucacggagaugggccgccuuccuaccuuuaugacacagaaggccaagaaugcucuggauaaccuggccguccuccauaccgcugaagccggaggccgggccuauaaucacgcucugagcgagcuucccgagacacuggaaacccuccugcugcucacacuucuggcgaccgugacagggggaauuuuccuguuucucauguccggcaaagggaucggaaagaugacacugggcaugugcugcaucauuaccgccagcauccuucugugguacgcucagauucagccgcacuggaucgccgccucuauuauccucgaguucuuucugaucguucugcucauuccugaacccgagaaacaaagaacaccccaggacaaccagcuuacauauguggugaucgcuauucugaccgucguugccgcgacaauggccaaugaaaugggcuuccuggagaagacgaaaaaggauuuugggcucggauccaucgcuacccagcaaccugagagcaacauucuggacaucgaucuucggccggccuccgcuuggacacuguacgccguggcgaccacauucaucacccccaugcuccgccauucuauugaaaauagcuccgugaacgucucucugacggccaucgcuaaucaggccaccgugcugaugggccucgggaagggauggccucuuagcaaaauggacauuggcguuccccugcuggcuaucggguguuacucccaggugaacccuauuacacucaccgccgcucugcuucugcucgucgcccacuaugcgaucauuggacccggccugcaggccaaggcuacaagagaggcccaaaaacgggcugccgccggcaucaugaagaauccuaccguggacgggaugacggucaucgaucuggacccgauucccuacgauccuaaauuugaaaagcagcucggacaggugaugcuucugguucugugcgugacacagguccucaugaugcgcaccacaugggcgcugugugaggcucuuacccuggccaccggccccaucagcacacucugggaagggaacccuggaagauucuggaauacgaccauugcugugucuauggccaacaucuuucggggcuccuaucuggccggggcuggacugcuguucagcauuaugaagaacacagccaauacccgcagaggcacaggcaacaccggggagacgcuuggagagaaauggaagaaucggcugaacgcgcugggcaaaucugaauuucaaaucuacaagaaauccgggauccaggagguugaccgcacacucgccaaggaaggaauuaaaagaggcgagaccgaucaucacgcugugagccgggggucugccaagcugagaugguucgucgagcgcaaucuugugacccccgaaggaaaggugguugaccugggcugcggcagagggggauggagcuauuacuguggcgggcucaaaaacgucaaggaggugaaaggacugacaaagggcgggccgggacaugaagaaccuauccccauguccaccuauggcuggaaucuggugagacuccagucuggcgucgauguuuucuuuacacccccugaaaaaugcgacacgcuucugugugauauuggggagagcucccccaacccuaccguggaggcuggacgcacacugcgggugcucaaucuggucgaaaacuggcuuaauaacaauacccaauucugcaucaaggugcugaacccguacaugcccagcguuauugagaagauggaagcccuccagagaaaauacggcggggcgcuggugcgcaauccucugucccggaacucuacacacgagauguauugggucagcaacgccuccggaaauaucgugucuagcguuaacaugaucuccagaaugcucauuaaucgcuuuaccaugcggcacaagaaagcuacguacgaacccgacguggaucuuggcucugggaccagaaacaucggaauugagagcgagacaccuaaucuggacaucauuggcaagcgcaucgagaagaucaagcaggagcaugaaaccuccuggcacuaugaucaggaccaucccuacaagacaugggccuaucacggcagcuacgagaccaaacaaacagggucugcuuccagcauggucaacggaguggugcggcugcucaccaagccgugggacgucauuccuaugguuacgcagauggccaugacagauaccacccccuucggccagcagagaguguuuaaagaaaagguggacacacgcacgcaagagccuaaagaggggaccaagaagcugaugaaaaucacagcugaauggcuuuggaaggagcugggcaaaaagaaaacccccagaauguguacacgggaagaguucacccgcaaggucagaucuaaugccgcgcucggcgccauuuuuacagaugagaacaaauggaaguccgcucgggaagccguggaggacagcggguucugggaacugguugauaaggagagaaaucugcaccucgaaggaaaaugcgagaccuguguguauaacaugaugggcaagcgggagaaaaagcugggcgaauuugggaaagcuaagggaucucgcgccaucugguacauguggcuuggcgccagauuccuggaguuugaagcgcucggguuccugaaugaggaccauugguuuucccgggaaaacagccuuuccggagucgagggcgaggggcugcacaagcucggcuacauucugcgcgaugugagcaaaaaggaaggaggcgcuauguaugccgacgauacggccgggugggacaccagaaucacacuggaggaucucaaaaaugaagagaugguuaccaaccauauggaaggagagcacaagaaacuggcugaggccauuuucaaacuuacauaccagaauaaggugguccgggugcagcgcccuacccccagaggcacgguuauggacaucaucucucggcgcgaccagagagggagcggacaaguggucacauauggccugaacaccuucacaaacauggaagcucagcucauucggcagauggagggggaaggcguguuuaaauccauccaacagcugaccgucaaggaggagauugccgugaaaaauuggcuuauccgcguuggaagagaacggcugucucgcauggcgauuagcggcgaugacugcguggucaagccgcucgaugacagauucgccuccgcucugacggcccugaacgauauggggaaagugcggaaggacauccagcagugggagccuucuagaggauggaaugauuggacccaagugcccuuuugcagccaucacuuccacgaacucaucaugaaggacggccgcguucuggugguccccugucggaaccaggaugagcuuauugggagagcucgcaucucccagggagccggcuggucucugcgggaaacagcgugccucgggaaaagcuacgcccagauguggucccugauguauuuucauagacgcgaccuucggcuggcugccaaugcuauuuguagcgccgugccuucucacuggaucccgaccuccagaacaaccuggagcauucaugcuacacacgaguggaugaccacggaggauaugcucacaguuuggaaccgcguguggauccaagaaaaucccuggauggaggacaagaccccugucgaaucuugggaggaaauccccuaccugggcaaacgggaggaucaguggugcggaucccugauuggccucaccagcagagccacaugggcgaagaacauccagaccgccauuaaucaggugcgcucccugaucgggaacgaggaauauacagacuacaugccuucuaugaaacgguucagacgggaggaagaggaagcuggaguccuuugguga

SEQ ID NO: 19632 - RNA, 9876 nt, Artificial Sequence
  derived and/or modified CDS sequence (opt5) from DENV-2__FJ850072__SS-prME
accgccggagugaucauuaugcugauccccacggcuauggccuuccaccucacgaccagaaauggggaaccucauaugauuguuggacggcaggaaaagggcaagagccugcuuuuuaagacagaggacgggguuaauaugugcacccugauggcgauggaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauccugcgccaucccggguucgccauuauggcugccauccucgcuuacacaauuggaaccacccacuuucagagagcccugaucuucauucuucugacagcgguggccccuagcaugacgaugcggugcaucggcauuuccaaccgcgauuuugucgaaggggugucuggaggcagcuggguugacaucgugcucgagcacggguccugugucaccacaauggcuaagaauaagcccacccuggauuucgaacuuaucaaaacagaggccaagcagccugcuacccugagaaaauauugcauugaagccaagcucacgaacacaaccaccgagagccgguguccgacacaaggagagcccucucugaaugaagaacaggacaaacgcuuuaucugcaagcauuccaugguggauagaggcuggggcaacggguguggacuguucggcaaaggcgggauugugaccugcgcgauguuuacaugcaaaaagaauauggaagggaaagucguucucccugagaaccuggaauacacgaucgugauuacaccccacagcggggaggagcaugccgugggaaaugacacaggcaagcacggcgaagagaucaaaaucaccccucagucuuccauuacagaagcugagcuuaccggguauggaacggucaccauggaauguagcccccggacaggccuggauuucaacgagauggugcuccugcagauggaggaaaaggccuggcuuguucaccgccaaugguuucuggaccucccgcugccuuggcugcccggggcugauacccagggaucuaauuggauccagaaagagacacucgugaccuucaagaacccucaugccaagaaacaggacgucgugguucugggcucccaagaaggggccaugcacacggcucuuacaggcgcgaccgagauucagaugagcuccggaaaucugcucuuuacaggccaucugaagugcagacuucggauggacaaacugcagcucaaggggaugucuuacagcauguguaccggaaaauucaagaucgugaaggagauugccgaaacccaacacggcacaaucgucaucagagugcaguaugagggggauggaucccccugcaaaauucccuucgaaaucauggaccuggagaagcgccaugcucugggccggcucauuacggucaacccuaucgugaccgaaaaagauagcccgguuaacauugaggccgagcccccuuuuggggacucuuacaucauuaucggcguggaacccggacagcugaaacuuaauugguucaaaaagggcuccagcaucgggcagauguuugagacaaccaugagaggagccaagcgcauggcuauucugggcgauacagccugggacuucgggucucucggaggcgucuuuaccagcaucgggaaagcgcugcaccaaguguucggcgcuauuuacggagccgccuuuuccggcguuucuuggacgaugaagauccugauuggggugaucaucacauggauuggaaugaacagccgguccaccagccuuucugucucccucgugcuggugggcguugucacccuguaucucggggcuauggugcaggccgauagcggauguguggucucuuggaaaaauaaggaacugaaaugcggcuccgggaucuucauuacagacaacgugcacaccuggacagagcaguacaaguuucagccugaaagccccuccaaacuugcuucugccauccaaaaagcgcaugaggagggcauuuguggaaucagaagcguuacgcgccuggaaaaucucauguggaagcagaucaccccggagcugaaccacauucuguccgaaaaugaggugaaacuuacaaucaugaccggcgauauuaaggggaucaugcaggccggaaaacggucucucagaccucagcccacagaacugaaguauagcuggaaaaccuggggcaaggcuaagaugcuguccacggagagccauaaccaaaccuuccucauugacgggccugagacagccgaaugccccaauaccaaccgcgcuuggaacucucuggaggucgaagauuacggauuuggcguguucacaaccaacaucuggcuuaaacugcgggagaagcaggacgucuuuugugacuccaaacucaugagcgccgcgaucaaggauaauagagccgugcacgcugacaugggcuauuggauugagucugcccugaacgauacauggaaaauggaaaaggcuuccuucaucgaggucaagagcugccacuggccuaaaucucauacccuguggagcaauggggugcuugaauccgagaugauuauccccaagaacuucgccggaccgguuagccagcacaacuaccgcccuggcuaucauacgcagacagccgggcccuggcaccucggaaaacuggaaauggacuuugauuucugugagggcaccaccguggucgugacagaggacugcgggaaucggggacccucucugagaaccacgacagcuuccggcaagcucauuaccgaauggugcugucggagcugcacacugccuccgcuucgcuacagaggcgaggauggguguugguacggaauggaaauccggccccugaaagagaaggaagagaaccucgugaauagccuggucaccgcgggccaugggcaaauugacaacuuuucucugggaguucuuggcauggcccucuuccuggaggaaaugcugagaacacgcguggggaccaagcacgcuauccuccugguggccgucagcuuugugacgcuuaucaccggaaauauguccuuccgggaucugggcagaguuauggugauggucggcguggccaugacagacgauauugggaugggaguuaccuaucucgcucugcuggccgcguuuaaagugcgcccuacauucgcugccggccuucugcucagaaagcugaccucuaaagagcucaugauggccacgaucgggauuacacugcuuagccaguccaccauccccgaaacaauucuggagcucaccgacgcucuggcccugggaaugaugguccuuaagaucgugcggaacauggaaaaauaccagcuggcgguuaccaucaugacaauuucuugcgugccuaaugcuaugauccuccugaacgccuggaaggucagcuguacgauucucgccgugguguccgucagcccccugcuucugaccucuucccaacagaagacagauuggaucccucucgcucugaccauuaaaggccugaaucccacagccaucuuucuuaccacgcugagccgcacaucuaagaaaagauccuggccgcucaacgaggcuguuauggccguggggauggugagcauccuggcgucuucccuccugaagaaugacauuccuaugaccggaccccuugucgccggcggccugcugaccgugugcuauguucucacagggcggagcgcugaccuggagcuugaacgcgccaccgaugugaaaugggaggaccaggcugaaaucuccggaagcucuccuauucugagcaucacaauuuccgaggauggcucuaugagcaucaagaacgaggaagaggaacagacgcucaccauucugaucagaacagggcuccuggucaucuccggaguguuccccguuucuauuccgaucaccgccgccgcuugguaccuuugggaggugaaaaagcaacgggcgggcguccugugggacgugccuucucccccucccgucgaaaaggccgagcuggaggauggggcuuaucgcauuaaacagagaggaauccucggcuacucccagauuggcgccgggguguauaaggaaggaacauuucacaccauguggcauguuacgcggggcgccgugcugaugcaccgcgggaaaagaaucgagcccuccugggcugacgucaagaaagaucuuaucagcuacggaggcggguggaagcuggaaggagaguggaaggaaggcgaggaggugcagguucucgcccuggaaccuggcaaaaauccgcgggcggugcaaaccaagcccggacucuucaaaacaaacaccggaacaauuggcgcugucucccuggacuuuagcccugggaccucuggaucccccaucguggauagaaagggcaaagugguugggcuuuacggaaauggcgucgugacacgcagcggcgccuaugugucugccauugcucagacggagaaguccaucgaagacaacccugagauugaagaugacaucuuccggaagaaaagacugaccaucauggaucugcaucccggggccggaaagacaaaacgcuaccucccugcgauuguccgggaggcuaucaagagaggccugcgcacccuuauucuggccccgacccgggugguugccgcugagauggaagaggcccucagagggcugcccauccgcuaucagaccccugcuauucgggccgaacacacgggaagagagaucguggaccucaugugucaugcgaccuucacaaugcggcugcuuagccccguccgcgugccuaacuacaaucugauuaucauggacgaggcccacuuuaccgaucccgcuuccaucgccgcuagaggcuauauuucuacacggguugaaaugggggaggccgccggcaucuucaugaccgcuacgccgccuggaagccgcgaccccuuuccccaguccaacgcgccuauuauggaugaagagagagaaauccccgagcggagcuggaacucuggccacgagugggugacagacuucaaagggaagaccgucugguuugugccuuccauuaaggccggaaacgauaucgcugccugccugcgcaagaauggcaagaaaguuauccaacucagccgcaagaccuucgacucugaauacgugaaaacacgggccaacgauugggacuuugucgugaccacagauauuagcgagaugggggcuaauuucagagccgaacgcgugaucgacccgcggagauguaugaagcccgucauucugaccgauggagaggaacgcguuauccuugcgggcccuaugcccgugacgcauuccucugcugcccagcggagagggcgcgugggcagaaacccuaagaaugagaacgaccaguauauuuacaugggagagccccuggaaaaugacgaggauugcgcccacuggaaagaagcuaagaugcuccuggacaacaucaauacaccggagggcaucauuccuagcauguuugaacccgagcgggagaaagucgaugccaucgacggggaauaccgccugagaggagaggcgcggaagaccuucguggaucucaugcgcagaggcgaccuuccuguuuggcuggccuaucggguggcugccgaagggauuaacuacgcugauagacgcugguguuuugacggaaucaaaaauaaccaaauucuggaggagaacgucgaaguggagaucuggacaaaggaaggcgagcggaaaaagcucaagcccagauggcuggaugcccgcauuuauuccgacccucuugcucugaaagaguucaaggaguucgccgcggggcggaaaucucucacccugaaucugaucacggagaugggcagacuccccaccuuuaugacacagaaggcccggaacgcucuugauaaucuggccguucugcauaccgcugaagccggaggccgcgccuacaaccacgcucucagcgagcugccggaaacacuugagacccugcuccugcugacacuccuugcgaccgugacagggggaaucuuccuguuucugauguccggcaaagggauuggaaagaugacacucggcaugugcugcaucauuaccgccagcauccugcuuugguaugcucagauucagccucacuggaucgccgccucuaucauucuggaguucuuucucaucguccugcugauucccgagcccgagaagcaaagaaccccucaggacaaucagcucacauacguggucaucgcuauucuuaccgugguugccgcgacaauggccaacgaaaugggcuuccuggagaaaacgaagaaagaucuggggcucggauccaucaccacacaggaaagcgaguccaauauccuggacauugaccuucggccggcuucugccuggacccuguaugcuguggccacaaccuuuaucacgcccaugcuccgccauagcauugaaaacuccucugugaaugucagccugaccgcgaucgccaaccaagcuacaguucugaugggccucgggaagggauggccucuuuccaaaauggauauuggcgugccccugcuggccaucggguguuacagccaggugaauccuauuacccucacagcugcccugcuuucucuggucgcucacuacgccaucaucggacccggccuccaggcgaaggccaccagagaggcucagaagcgggccgcugccggcauuaugaaaaacccuacgguggacgggaucacaguuauugaucuggagccgauccccuaugacccuaaguucgaaaaacaacugggacaggugaugcuccuuauucugugcgucacccaggugcugaugaugcgcacaaccugggcccucugugaggcgcugacccuugcuacaggccccaucuccacgcugugggaagggaauccuggaagauuuuggaacaccacaaucgccgucagcauggcuaauauuuuccggggcucuuaccucgccggggccggacugcuguuuuccaucaugaagaacaccacaaauacccgcagaggcacgggcaacauuggggagacacucggagagaaauggaaaagccggcuuaacgcucugggcaagucugaguuccagaucuauaaaagaagcgggauucaagagguggaucgcacccuggccaaggaaggaaucaaacggggcgagaccgaccaucacgcgguuuccagagggucugccaagcuccgcugguuuguggaacggaauauggucacacccgagggaaaagugguugaucugggcugcggcagagggggauggagcuacuauuguggcgggcuuaagaacgugcgcgaggucaaaggacugaccaagggcgggccgggacaugaagaaccuauccccauguccacauacggcuggaaucucgugcggcugcagagcggcguggacguuuucuucacgcccccugaaaagugcgauacccugcucugugacauuggggaguccucucccaacccuacaaucgaagcuggaagaacccuucgcguccugaaucugguggagaacuggcucaauaacaauacacaguuuugcauuaaagugcugaacccguauaugcccagcgucaucgagaagauggaaacccuucaacggaaauacggcggggcccugguuagaaauccucucucccgcaacucuacgcacgagauguacugggugagcaaugcuaccggaaacauuguguccucugucaauaugaucagccggaugcugaucaacagauucacaaugaagcacaaaaaggccaccuaugaacccgauguggaccugggcuccgggacacgcaacauuggaaucgagagcgaaauuccuaaucucgauaucauuggcaagagaaucgagaaaauuaagcaggagcaugaaaccucuuggcacuacgaccaggaccaucccuauaaaacaugggcguaccacggcuccuaugagaccaagcagacggggagcgccucuuccaugguuaacggagugguccggcuucugacaaaaccgugggaugugguuccuauggugacccaaauggcuaugaccgacacaacgcccuuuggccagcagcgcgucuucaaggaaaagguggauaccagaacacaggagccuaaagaggggaccaagaaacugaugcggaucacagccgaauggcucuggaaggagcugggcaagaagaagacccccagaauguguacacgggaagaguuuacccgcaaagugagaagcaaugcugcccuuggcgcuaucuucacggacgaaaacaaguggaaaucugcccgggaggcggucgaggauucccgcuuuugggaacugguugacagagagcggaaucuccaccuggaagggaagugcgagaccuguguguacaacaugaugggaaaacgcgaaaagaaacugggcgaguucggcaaggccaaggggagcagagcuauuugguauauguggcucggagcccgguuucuggaguucgaagcucuuggcuuucugaaugaggaucauugguucucccgcgggaacagccucucuggaguggaaggcgaggggcugcacagacuuggcuacauccugcgggacgucagcaaaaaggaaggaggcgccauguacgccgaugacacagcggggugggauacccgcauuacacucgaggaccugaaaaaugaggaaauggugaccaaccauaugaagggagagcacaaaaagcuggcugaagccguuuuuaagcucacguaucaaaauaaaguggucagagugcagcggccuacaccccgcggcaccguuauggacaucauuuccagacgggaucagagagggucuggacaggugggcacauacgggcugaacaccuucacgaauauggaggcccaacuuauccgccagauggagggcgaaggaaucuucaagagcauucagcaucugaccgucacagaggaaaucgcugugcaaaacuggcucgcccggguuggcagagagcgccugucccggauggcuauuucuggggacgauugcguggucaaaccgcuugacgauagauuugccagcgcgcugaccgcccucaaugacaugggaaaggugcgcaaagauauccagcagugggaaccuucccggggcuggaacgacuggacacagguccccuucugcucucaccacuuucaugagcuggugaugaaggaugggagaaugcugguugugcccugucgcaaccaagacgagcucauuggacgggcuagaaucagccagggcgccggguggucccugaaggaaaccgcuugccuuggcaaaagcuaugcccagauguggacacugauguacuuccaccgccgggaucucagacuggcggccaaugcuaucuguucugccgucccuucccauugggugccgaccagccggacgacauggucuauucacgcuaagcacgaguggaugaccaccgaagacaugcuugccguguggaacagaguuuggauccaggagaaucccuggauggaagauaaaacaccuguggaguccugggaggaaguccccuaucugggaaagcgcgaggaccaauggugcggcagccucauugggcugaccucccgggcuacaugggccaaaaacauccagacggcgauuaaucaggugagaucucugaucggaaacgaagaguacaccgacuauaugccuagcaugaagcgcuuuagacgggaagaggaggaagccggcguucucugguga

SEQ ID NO: 19633 - RNA, 9876 nt, Artificial Sequence
  derived and/or modified CDS sequence (opt5) from DENV-2__JN819419__SS-prME
accgccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggccauugaucucggagaacugugugaggacacaaucaccuacaagugcccgcuucugcgccaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcguggaagcuaagcucacaaacaccaccacagagagccgguguccgacccaaggagagcccucucugaaugaggaacaggacaaacgcuuuauuugcaagcauuccauggucgauagaggcuggggcaacggguguggacuguucggcaaaggcgggaucguuacaugcgccauguuuacgugcaaaaagaauauggaagggaaaguggugcagccugagaaccucgaauacaccauugucaucacaccccacagcggggaggagcaugcggugggaaaugacaccggcaagcacggcaaagaaauuaagaucacaccucagucuuccaucaccgaggccgaacugacgggguauggaaccguuacaauggaguguagcccccggaccggccuugauuucaacgaaauggugcugcuccaaauggaggacaaggcuuggcugguccaccgccagugguuucuugaucugccgcucccuuggcugcccggggccgacacacagggaucuaauuggauucagaaggagacccuggugacguucaagaacccucaugcuaaaaagcaagacguugugguccucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgauugucaucagagugcaguaugagggggacggaucccccugcaagauccccuucgaaauuauggaucucgagaaacgccauguucugggccggcugaucaccgugaacccuauugucacagaaaaggacagcccggugaacaucgaggccgaacccccuuuuggggauucuuacauuaucauuggcguugagcccggacagcucaaacugaauugguucaagaagggcuccagcaucgggcaaauguuugagaccacaaugagaggagcuaaacgcauggccauccuuggcgacaccgccugggauuucgggucucugggaggcguguuuacgagcauugggaaggcucuccaccaggucuucggcgccaucuacggagcggcuuuuuccggcgugucuuggacaaugaaaauucugaucggggugauuaucaccuggaucggaaugaacagccgguccaccagccugucuguuucccuuguccucgugggcguggucacacuguaucugggggccauggugcaggccgacagcggauguguugugucuuggaagaauaaagaacucaagugcggcuccgggauuuucaucaccgauaacguccacacauggacggagcaguacaaguuucaaccugaaagccccuccaaacuggcuucugccauucagaaggcucaugaggaaggcaucuguggaauuagaagcgugacccgccuugagaaucugauguggaaacagaucacaccggagcucaaccacauccuguccgaaaaugagguuaagcugaccauuaugacaggcgacaucaaagggauuaugcaggccggaaagcggucucuuagaccucaacccaccgaacucaaauauagcuggaagacguggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacaaacauuuggcugaaacuucgggagaaacaggacguguuuugugauuccaagcugaugagcgccgcuaucaaagacaauagagccguucacgcggauaugggcuauuggaucgaaucugcccucaacgacaccuggaagauggagaaggcuuccuucauugaggugaaaagcugccacuggccuaagucucauacgcuguggagcaaugggguccuggaauccgagaugaucauucccaaaaacuucgccggaccggugagccagcacaacuaccgcccuggcuaucauacacaaaccgcugggcccuggcaccuuggaaagcucgaaauggauuuugacuucugugagggcaccacaguggucguuaccgaagauugcgggaaucggggacccucucugagaacgacaaccgccuccggcaaacugaucacagaguggugcugucggagcugcacccucccuccgcugcgcuacagaggcgaggacggguguugguacggaauggaaauucggccccuuaaggagaaggaagagaaccuggugaauagccucgugacagccggccaugggcagaucgauaacuuuucucugggaguccugggcauggcucuuuuccucgaagagaugcugagaacccgcguggggacgaaacacgcgauucugcucguugccgugagcuuugucacccugaucacaggaaauauguccuuccgggaccuuggcagagugaugguuauggugggcgcuaccaugacagaugacaucgggaugggagucaccuaucuggcccuccuggccgcuuuuaaggugcgcccuacguucgccgcgggccugcuucugagaaaacucacaucuaaggagcugaugauggcuaccauugggguugcccuccugagccaguccacaauccccgaaaccauucuugagcugaccgaugcccucgcucugggaaugauggcccugaaaaucgugaagaacauggaaaaguaccaacuugcggucacaauuauggcuaucucuugcgugccuaaugccgugauccugcagaacgccuggaaagucagcuguacgauucucgcugccguuuccgugagcccccugcuccugaccucuucccagcagaaggcugacuggaucccucuugcccugacaauuaaaggccucaaucccaccgcgaucuuucugacaacccugagccggacgucuaagaaacgcuccuggccgcuuaacgaggccauuauggcuguggggauggucagcauccuggccucuucccuccugaagaaugacaucccuaugacaggaccccucguggcuggcggccugcuuaccguuugcuaugugcugaccgggagaagcgccgaucuggaacucgagcgggccgcugacgucaaaugggaggaucaagcggaaauuuccggaagcucuccuauccugagcauuacaaucuccgaggacggcucuaugagcauuaagaacgaagaggaggaacagacccuuacaauccugauucgcacggggcuccuggugaucuccggaguuuuccccgugucuaucccgauuaccgccgcugccugguaccucugggaggucaagaaacagagagccggcgugcugugggaugucccuucucccccucccguggggaaggcugaacuugaggacggagccuaucggaucaaacagcgcggcauucugggcuacucccaaaucggggcgggaguuuauaaggaaggcacauuucacaccauguggcaugugacaagaggggcuguccugaugcaccggggaaaacgcauugagcccuccugggccgaugugaagaaggaccucguuagcuacggcgggggauggaaacuggagggcgaauggaaggagggcgaagaggugcagguccuugcccuggaaccugggaaaaauccgagagcugugcagaccaagcccggaaucuucaaaacgaacaccggcaauaucggggccgugucccucgauuuuagcccuggaacaucuggcucccccauuguugaccggaaggggaaggucgugggacuguacggcaacggcguggucaccagaagcggggcguaugugucugcuaucgcccagacagagaaauccauugaggauaacccugaaaucgaggacgauauuuuccgcaagaaacggcucaccaucauggaccugcaucccggagccggcaagacaaaaagauaccuuccugcuaucguucgcgaagccauuaagcgggggcugagaacgcugauccucgcuccgacccgcguggucgccgcggagauggaagaggcccugcggggacuucccauuagauaucaaaccccugcuauccgcgccgagcacaccggccgggaaauuguggaccugaugugucaugcuaccuucacaaugagacuccugagccccguucgggugccuaauuacaaccucaucauuauggaugaggcccacuuuacggaccccgccuccaucgcugcgcgcggguauaucucuaccagagucgaaaugggcgaggccgcuggaauuuucaugacagccaccccgccuggcagccgggaucccuuuccccaguccaaugccccuaucauggacgaggaacgcgagauucccgaaagaagcuggaacucugggcacgagugggugacagauuucaagggaaaaaccguuugguuugugccuuccaucaaggcuggcaaugacauugccgcgugccugcggaaaaacgggaagaaagucauccagcuuagcagaaagacguucgauucugaauacgugaagacacgcgcuaaugacugggauuuuguggucaccaccgacaucagcgagaugggagccaacuucaaagccgagcggguuauugauccgagacgcuguaugaagcccgugauccugacagacggcgaggaacgggugauucuggcugggccuaugcccgucacccauuccucugccgcgcaaagacgcggccggaucggaagaaauccuaaaaacgaaaaugaccaguauauuuacaugggcgagccccucgaaaacgaugaggacugcgcccacuggaaggaggcuaaaaugcugcuugauaauaucaacacaccggaagggaucauuccuagcauguuugagcccgaacgcgagaagguggacgccaucgauggagaauacagacugcggggcgaggcucgcaaaaccuucguugaccucaugagaagaggggaucugccuguguggcuggccuauaaggucgcugccgagggaauuaauuacgcggaccgcagaugguguuuugauggcaucaagaacaaccagauucucgaagagaauguggaaguugagaucuggacgaaagagggggaacggaagaaacuuaagcccagauggcuggacgcccgcauuuauuccgauccucuggcucucaaagaguucaaggaguucgccgcuggccggaagucucugacacuuaaccugaucaccgagaugggaagacuccccacauuuaugacccagaaagcccgcaaugcccuggacaaccuggcugugcuccauacggcggaagccggcgggaaggcuuacaaucacgcccuuagcgagcugccggagacccuggaaacacuccugcuucugacccuccuggccacagucaccggaggcaucuuccuguuucucauguccgggaaaggaauuggcaagaugacacuuggcaugugcugcaucauuaccgcuagcauccugcugugguaugcccaaauucagccucacuggaucgcggccucuaucauucucgaguucuuucugaucgugcuucugauucccgaacccgagaaacagcggacgccucaggauaaccaacucacauacgucgugaucgcuauucugaccguuguggccgcuaccauggccaaugaaaugggguuccuggagaagacaaagaaagaccucggacuuggcuccaucaccacacaggagagcgaauccaacauccuggacauugaucugagaccggcgucugccuggacgcucuaugcuguggccaccacauuugucacccccaugcugcggcauagcaucgaaaauuccucuguuaacgugagccuuacagcuauugccaaucaggcuaccgugcugauggggcucggaaagggcuggccucuguccaaaauggacaucggggcgccccugcucgcgauuggauguuacagccaggucaacccuaucacgcuuaccgccgcucugcugcuccugguggcccacuacgcuauuaucggccccggccuucaagccaaggccacacgcgaagcgcagaaaagagcugccgcugggaucaugaagaauccuaccguugauggaauuacagugaucgaccuggagccgauucccuaugauccuaaguucgaaaaacagcucggccaggucaugcugcugauccucugcgugacccaaguccuuaugaugcggacgacaugggcccugugugaggcccugacccucgcuacagggcccauuucuacccugugggagggaaacccuggccgcuuuuggaauaccacaaucgccguguccauggcgaacaucuucagagggagcuaccuugccggagcuggccugcucuuuucuauuaugaagaauacgaccaacacacggcgcggcaccgggaacaucggagaaacacugggcgagaaauggaaguccagacugaaugcccucgggaaaagcgaguuccagauuuauaagaaaucuggaauccaggagguugaccggacccuugcuaaggagggcauuaagcgcggggaaacggaucaucacgccgugagcagaggauccgcgaaacugcggugguuugucgagagaaacauggugacacccgaaggcaagguuguggaccugggcugcgggcgcggaggcuggucuuacuauugugggggacucaaaaauguccgggaggugaagggccugaccaaagggggaccgggccaugaagaaccuauccccaugagcaccuacggcuggaaccuugugagacugcaauccgggguugaugucuucuucacacccccugagaagugcgacacccuccugugugauaucggagaaagcucccccaauccuacaauugaggccggccgcacgcugcgggugcucaaccuuguggaaaauuggcugaacaauaacacccaguuuugcaucaagguccugaauccguauaugcccucuguuauugagaaaauggaaacacuccagagaaaguacgggggagcucuggugcgcaacccucuuagcagaaauuccacccacgagauguacugggugucuaacgccacaggcaauaucgucagcuccgugaacaugauuucuagaaugcugaucaaccgcuucaccaugaaacacaagaaagcuacguaugagcccgacguugaucucgggagcggaacccggaauaucggcauugaauccgagaucccuaaccuggacauuaucggcaagagaauugaaaagaucaaacaggagcaugaaacaagcuggcacuacgaccaagaucaucccuauaagaccugggccuaccacgggucuuaugagacaaaacagaccggauccgcuagcucuauggugaauggcgucgugcgccugcucacaaagccgugggacguugugccuauggucacccagauggccaugacggauacaacccccuuugggcagcaacggguguucaaagagaagguggacaccagaacacaggaaccuaaggagggaacgaagaaacuuaugaaaauuaccgcggaauggcuguggaaagagcugggcaaaaagaaaaucccccgcauguguacaagagaggaauuuacccggaagguccgcuccaacgccgcucucggggccaucuucacagaugagaauaaguggaaaagcgcuagagaagccguugaggacggacgguuuugggaacugguggauagagagcggaaccuucaccuggagggcaagugcgaaaccuguguguacaauaugaugggcaaacgcgagaagaaacucggggaguucggaaaggccaagggcucuagagcgauuugguauauguggcugggggcucgguuucuggaguucgaagcccucggauuucugaacgaggaccauugguucucccgcggcaauagccuuuccggggucgagggcgaaggacugcacagacucggcuacauccugcgggaugugagcaaaaaggaagggggagccauguacgcugacgauacagccggcugggacacccgcauuacgcuugaagaccugaaaaacgaggaaaugguuaccaaucauaugaagggggagcacaaaaagcucgcugaggccaucuuuaagcugacauaucagaacaaaguggucagagugcagcggccuacaccccgcggaacaguuauggauauuaucucuagacgggaccaacgcggcagcggacaggugggcaccuacggacugaauacguucacaaacauggaagcgcagcucaucagacaaauggagggcgaagggauuuucaaguccauccagcaucugaccgucacagaggagauugccgugcagaauuggcuugcucggguuggacgcgaaagacugacccggauggccaucucuggcgaugacugcguggucaaaccgauugaugacagauuugcuaacgcccucacggcgcugaacgauauggggaaggugcgcaaagacauccagcaaugggagccuagccggggauggaaugauuggacccagguccccuucugcucccaccacuuucaugaacuugugaugaaggacggcagaguucuggugguccccugucgcaaccaggaugagcucaucgggcgggccagaauuucucagggcgcuggauggagccugaaggaaacagccugccugggcaaauccuaugcucaaauguggacccucauguacuuccaccgccgggaccugagacuugccgcuaaugccaucuguucugcggugccuagccauugggugccgacaucccgcaccacauggagcauucacgccaagcacgaguggaugaccacggaggauaugcuggcuguuuggaaccggguguggauccaggaaaaucccuggauggaggacaaaacaccugucgaaucuugggaggaagugcccuaucucgggaagagagaggaccaguggugcggaucccugauuggccuuaccagccgcgccaccugggccaaaaacauccagacagcuauuaaucaaguucggucucugaucgggaacgaggaauacaccgauuauaugccuuccaugaagagauuucggagagaggaagaggaagccggagugcucugguga

SEQ ID NO: 19634 - RNA, 9876 nt, Artificial Sequence
  derived and/or modified CDS sequence (opt5) from DENV-2__FJ850074__SS-prME
accgccggagugaucguuaugcugauucccacaguuauggcuuuccaccucacgacccggaacggggagccucauaugaucgugggacggcaggaaaagggcaagagccugcuuuuuaagacagaggacggggugaauaugugcacccugauggccauugaucucggagaacugugugaggacacaaucaccuacaagugcccccuucugcgccaaaacgaacccgaggauauugacuguuggugcaauuccacaucuaccugggucacguauggcaccuguacaaccacaggggagcacagacgggaaaagcgcagcguggcgcucguuccucaugugggaaugggccuggagaccagaacggaaacauggauguccucugagggcgcuuggaagcacguccagcggaucgagaccuggauccugcgccaucccggguucacaaugauggccgccauucucgcuuacaccaucggaaccacacacuuucagagagcccugauuuucauccuucugacggcuguggccccuagcaugaccaugcggugcauuggcaucuccaaccgcgauuuuguugaaggggugucuggaggcagcugggucgacauugugcucgagcacggguccugugugacaaccauggcgaagaauaagcccacacuggauuucgaacuuaucaagaccgaggccaagcagccugcuacgcugagaaaauauugcgucgaagccaagcucacaaacaccaccacagagagccgguguccgacccaaggagagcccucucugaaugaggaacaggacaaacgcuuuaucugcaagcauuccaugguugauagaggcuggggcaacggguguggacuguucggcaaaggcgggauugugacaugcgcuauguuuacgugcaaaaagaauauggaagggaaagugguccagccugagaaccucgaauacaccaucgugauuacaccccacagcggggaggagcaugccguuggaaaugacaccggcaagcacggcaaagaaaucaagauuacaccucagucuuccaucaccgaggcggaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauccagaaggagacccugguuacguucaagaacccucaugccaaaaagcaagacguggucgugcucggcucccaggaaggggcuaugcacacagcccugaccggcgccacagagauucagaugagcuccggaaaucuucuguuuaccggccaucucaaaugcagacugcggauggauaaacuucaacugaaagggaugucuuacagcauguguaccggaaaguucaagaucgucaaagaaauugcugagacacagcacggcacgaucgugauuagaguucaguaugagggggacggaucccccugcaagauccccuucgaaaucauggaucucgagaaacgccaugugcugggccggcugauuaccgucaacccuaucgugacagaaaaggacagcccgguuaacauugaggcggaacccccuuuuggggauucuuacaucauuaucggcguggagcccggacagcucaaacugaauugguucaagaagggcuccagcauugggcaaauguuugagaccacaaugagaggagccaaacgcauggcuauccuuggcgacaccgccugggauuucgggucucugggaggcgucuuuacgagcaucgggaaggcccuccaccagguguucggcgcuauuuacggagccgcguuuuccggcgugucuuggacaaugaaaauccugauugggguuaucauuaccuggaucggaaugaacagccgguccaccagccugucugucucccuugugcucgugggcgucgugacacuguaucugggggcuaugguucaggccgacagcggauguguggucucuuggaagaauaaagaacucaagugcggcuccgggaucuucauuaccgauaacgugcacacauggacggagcaguacaaguuucaaccugaaagccccuccaaacuggccucugcuauccagaaggcccaugaggaaggcauuuguggaaucagaagcguuacccgccuugagaaucugauguggaaacagauuacaccggagcucaaccacauccuguccgaaaaugaggugaagcugaccaucaugacaggcgacauuaaagggaucaugcaggcuggaaagcggucucuuagaccucaacccaccgaacucaaauauagcuggaagacguggggcaaggccaaaaugcugccuaccgagucccauaaccagacauuccugauugaugggcccgaaaccgcggagugcccuaauacaaaccgcgccuggaauagccucgaggucgaagacuacggauuuggcguguucaccacaaacaucuggcugaaacuucgggagaaacaggacgucuuuugugauucuaagcugauguccgcugccauuaaagacaauagagcugugcacgccgauaugggcuauuggaucgaaagcgcgcucaacgacaccuggaagauggagaaggccucuuucaucgaggucaaauccugccacuggcccaagagccauacgcuguggucuaauggggugcuggaaagcgagaugauuaucccgaaaaacuucgcuggaccugugucccagcacaacuaccgccccggcuaucauacacaaaccgccgggcccuggcaccuuggaaagcucgaaauggauuuugacuucugugagggcaccacagucguugugaccgaagauugcgggaaucggggaccuagccugagaacgacaaccgcuucuggcaaacugauuacagaguggugcugucgguccugcacccucccgccccugcgcuacagaggcgaggacggguguugguacggaauggaaauccggccucuuaaggagaaggaagagaaccuggugaauagccucgucacagccggccaugggcagauugauaacuuuucccugggagugcugggcauggcccuuuuccucgaagagaugcugagaacccgcguugggacgaaacacgcuauccugcucguggcggucucuuuugugacccugauuacaggaaauaugagcuuccgggaccuuggcagaguuauggugauggucggcgccaccaugacagaugacaucgggaugggagugaccuaucuggcucuccuggccgccuuuaagguucgccccacguucgcugccggccugcuucugagaaaacucacauccaaggagcugaugauggcgaccaucgggguggcucuccugucucagagcacaauuccugaaaccauccuugagcugaccgaugcccucgcccugggaaugauggcucugaaaauugucaagaacauggaaaaguaccaacuugccgugacaaucauggcgauuuccugcgugcccaaugcugucauccugcagaacgccuggaaaguuucuuguacgauccucgccgcugugagcguguccccucugcuccugaccagcucucagcagaaggccgacuggauuccccuugcucugacaaucaaaggccucaauccgaccgccauuuuucugacaacccugucccggacgagcaagaaacgcucuuggccucuuaacgaggcgaucauggccgucgggaugguguccauucuggcuagcucucuccugaagaaugacauccccaugacaggaccucucguugccggcggccugcuuaccgugugcuauguccugaccgggagauccgcugaucuggaacucgagcgggccgccgacgugaaaugggaggaucaagcugaaaucagcggauccagccccauucugucuaucacaauuagcgaggacggcuccaugucuaucaagaacgaagaggaggaacagacccuuacaauucugauccgcacggggcuccugguuauuagcggaguguucccggucuccaucccuaucaccgcggccgcuugguaccucugggaggugaagaaacagagagccggcguccugugggaugugcccucuccuccgcccguugggaaggccgaacuugaggacggagcuuaucggauuaaacagcgcggcauccugggcuacagccaaauuggggccggaguguauaaggaaggcacauuucacaccauguggcaugucacaagaggggcggugcugaugcaccggggaaaacgcaucgagccuuccugggcugauguuaagaaggaccucgugucuuacggcgggggauggaaacuggagggcgaauggaaggagggcgaagagguccaggugcuugcccuggaaccggggaaaaaucccagagccgugcagaccaagccuggaauuuucaaaacgaacaccggcacaaucggggcuguuagccucgauuuuucccccggaaccagcggcucuccuaucgucgaccggaaggggaagguggugggacuguacggcaauggcgucgugacaagauccggggccuauguuagcgcgauugcucagaccgagaaaucuaucgaggauaaccccgaaauugaggacgauaucuuccgcaagaaacggcucacaauuauggaccugcauccuggagccggcaagacgaaaagauaccuuccggccaucgugcgcgaagcuaucaagcgggggcugagaacccugauucucgcccccacacgcgucguggcugccgagauggaagaggcgcugcggggacuuccuaucagauaucaaacccccgccauucgcgcugagcacaccggccgggaaaucguugaccugaugugucaugccacauucacgaugagacuccuguccccugugcggguccccaacuacaaucucauuaucauggaugaggcucacuuuaccgacccggccagcauugccgcucgcggguauaucuccacaagaguggaaaugggcgaggcggccggaaucuucaugaccgcuacaccucccggcucucgggaucccuuuccucagagcaacgcccccauuauggacgaggaacgcgagaucccugaaagauccuggaauagcgggcacgaguggguuaccgauuucaagggaaaaacggugugguuugucccgucuauuaaggccggcaacgacaucgcugccugccugcggaaaaaugggaagaaagugauucagcuuuccagaaagacauucgauagcgaauacgugaagacccgcucuaacgacugggauuuugucguuaccacagacaucagcgagaugggagcgaauuucaaagcugagcgggugaucgaucccagacgcuguaugaagccugugauucugaccgacggcgaagaacgggucauccuggccgggcccaugccugugacacauuccucugccgcucaaagacgcggccggauuggaagaaaccccaaaaaugaaaacgaccaguauaucuacaugggcgagccgcucgaaaaugaugaggacugcgcccacuggaaggaggcgaaaaugcugcuugauaacauuaauaccccugaagggaucauccccagcauguuugagccugaacgcgagaagguugacgccauugauggagaauacagacugcggggcgaggcucgcaaaacguucguggaccucaugagaagaggggaucugcccgucuggcuggccuauaagguggcugccgagggaaucaacuacgcugaccgcagaugguguuuugauggcauuaagaauaaccagauccucgaagagaacguugaaguggagauuuggacaaaagagggggaacggaagaaacuuaagccuagauggcuggacgcccgcaucuauuccgauccccuggcgcucaaagaguucaaggaguucgccgcuggccggaagucucugacccuuaaucugauuacagagaugggaagacucccgaccuuuaugacgcagaaagcccgcaacgcucuggacaaucuggccguccuccauaccgccgaagcuggcgggaaggcguacaaccacgcccuuagcgagcugccugagacacuggaaacccuccugcuucugacacuccuggcuaccgugacaggaggcaucuuccuguuucucauguccgggaaaggaaucggcaagaugacccuuggcaugugcugcauuaucacggccagcauucugcugugguaugcccaaauccagccccacuggauugcugccucuaucauccucgaguucuuucugauuguccuucugauccccgaaccugagaaacagcggacaccgcaggauaaucaacucaccuacgugguuauugcgauccugaccgugguggccgcuacaauggccaacgaaaugggguuccuggagaagaccaagaaagaccucggacuuggcuccauuacaacgcaggagagcgaauccaauauccuggacaucgaucugagacccgcuucugccuggacccucuaugcggucgccacaaccuuuguuacaccuaugcugcggcauagcauugagaacuccucugugaaugugagccuuaccgcuaucgccaaccaggcuacgguccugauggggcucggaaagggcuggccccuguccaaaauggacauuggggugccucugcucgccaucggauguuacagccagguuaaucccauuacccuuacagcugcccugcugcuccugguggcgcacuacgccaucauuggcccuggccuucaagcuaaggccacccgcgaagcucagaaaagagccgccgcggggaucaugaagaacccgacagucgauggaaucaccgugauugaccuggagcccaucccuuaugaucccaaguucgaaaaacagcucggccaggucaugcugcugauucucugcgugacgcaaguucuuaugaugcggacaaccugggcucugugugaggcccugacacucgcuaccgggccuaucucuacccugugggagggaaaucccggccgcuuuuggaacacaacgauugccguguccauggccaauaucuucagagggagcuaccuugcuggagccggccugcucuuuucuaucaugaagaacaccacaaauacccggcgcggcacagggaacauuggagaaacccugggcgagaaauggaaguccagacugaacgcgcucgggaaaagcgaguuccagaucuauaagaaaucuggcauucaggaggucgaccggacgcuugccaaggagggcaucaagcgcggggaaacagaucaucacgcugugagcagaggauccgccaaacugcggugguuuguugagagaaauauggugaccccggaaggcaaggucguggaccugggcugcgggcgcggaggcuggucuuacuauugugggggacucaaaaacgugcgggagguuaagggccugaccaaagggggaccuggccaugaagaacccauucccaugagcacauacggcuggaaucuugucagacugcaauccgggguggauguguucuucaccccucccgagaagugcgacacacuccugugugauaucggagaaagcuccccuaacccgacgaucgaggcuggccgcacccugcggguccucaaucuuguugaaaacuggcugaauaacaauacacaguuuugcauuaaggugcugaaccccuauaugccuucugugaucgagaaaauggaaacccuccagagaaaguacgggggagcccugguccgcaauccccuuagccggaacuccacacacgagauguacugggugucuaaugcgaccggcaacauuguuagcuccgugaauaugaucucuagaaugcugauuaaccgcuucacgaugaaacacaagaaagccaccuaugagccugacgucgaucucgggagcggaacacggaacaucggcaucgaauccgagauucccaaucuggacaucauuggcaagagaaucgaaaagauuaaacaggagcaugaaaccagcuggcacuacgaccaagaucauccguauaagacaugggcuuaccacgggucuuaugagaccaaacagacaggauccgccagcucuauggugaacggcguugugcgccugcucaccaagccuugggacgucgugcccauggugacgcagauggcuaugacagauaccaccccuuuugggcagcaacgggucuucaaagagaagguugacacaagaacgcaggaacccaaggagggaaccaagaaacuuaugaaaaucacagccgaauggcuguggaaagagcugggcaaaaagaaaaccccucgcauguguacaagagaggaauuuacccggaaggugcgcuccaaugcugcccucggggcgauuuucacagaugagaacaaguggaaaagcgccagagaagcuguggaggacggacgguuuugggaacuggucgauagagagcggaaucuucaccuggagggcaagugcgaaaccuguguguacaacaugaugggcaaacgcgagaagaaacucggggaguucggaaaggccaagggcucuagagcuaucugguauauguggcugggggcccgguuucuggaguucgaagcccucggauuucugaaugaggaccauugguucucccgcggcaacagccuuuccgggguugagggcgaaggacugcacagacucggcuacauccugcgggaugugagcaaaaaggaagggggagcgauguacgcugacgauacggccggcugggacacccgcauuacacuugaagaccugaaaaaugaggaaauggucaccaaccauaugaagggggagcacaaaaagcucgccgaggcuaucuuuaagcugacauaucagaauaaagugguuagagugcagcggcccaccccgcgcggaacggucauggauauuaucucuagacgggaccaacgcggcagcggacaggugggcacauacggacugaacaccuucacaaauauggaagcccagcucauuagacaaauggagggcgaagggaucuucaaguccauccagcaucugaccguuacggaggagauugcugugcagaacuggcuugcccgggucggacgcgaaagacugacccggauggcgaucucuggcgaugacugcguggucaaaccuauugaugacagauuugccaaugcucucacagcccugaacgauauggggaaggugcgcaaagacauccagcaaugggagcccagccggggauggaacgauuggacccagguucccuucugcucccaccacuuucaugaacuugugaugaaggacggcagaguccugguggugccuugucgcaaucaggaugagcucauugggcgggcuagaaucucucagggcgccggauggagccugaaggaaacagcgugccugggcaaauccuaugcccaaauguggacccucauguacuuccaccgccgggaccugagacuugcugccaacgcuaucuguucugccguuccgagccauugggugcccacaucccgcaccacguggagcauucacgcuaagcacgaguggaugacaaccgaggauaugcuggccgucuggaaucggguguggauccaggaaaacccuuggauggaggacaaaacccccguugaaucuugggaggaagugccuuaucucgggaagagagaggaccaguggugcggaucccugauuggccuuacaagccgcgcgaccugggccaaaaauauccagacagcuauuaaccaaguccggucucugaucgggaaugaggaauacacggauuauaugcccuccaugaagagauuucggagagaggaagaggaagccggagugcucugguga

SEQ ID NO: 19635 - RNA, 9876 nt, Artificial Sequence
  derived and/or modified CDS sequence (opt5) from DENV-2__FJ850076__SS-prME
accgccggcgcuaucgugaugcugauucccacagucauggccuuccaccucacgacccggaacggggagccucauaugaucguuggacggcaggaaaagggcaagagccugcuuuuuaagacagaggacggggugaauaugugcacccugauggcgauugaucucggagaacugugugaggacacaaucaccuacaagugcccccuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaaugauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacauuguccucgagcacggguccugugugacaaccauggccaagaauaagcccacacuggauuucgaacuuaucaaaaccgaggcuaagcagccugccacgcugagaaaauauugcguggaagcuaagcucacaaacaccaccacagagagccgguguccgacccaaggagagcccucucugaaugaggaacaggacaaacgcuuuaucugcaagcauuccauggucgauagaggcuggggcaacggguguggacuguucggcaaaggcgggauuguuacaugcgccauguuuacgugcaaaaagaauauggaagggaaaguggugcagccugagaaccucgaauacaccaucgucauuacaccccacagcggggaggagcaugcggugggaaaugacaccggcaagcacggcaaagaaaucaagauuacaccucagucuuccaucaccgaggccgaacugacgggguauggaaccguuacaauggaguguagcccccggaccggccuugauuucaacgaaauggugcugcuccaaauggaggacaaggcuuggcugguccaccgccagugguuucuugaucugccgcucccuuggcugcccggggccgacacacagggaucuaauuggauccagaaggagacccuggugacguucaagaacccucaugcuaaaaagcaagacguugugguccucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgugaaagaaauugcggagacacagcacggcacgaucgucauuagagugcaguaugagggggacggaucccccugcaagauccccuucgaaaucauggaucucgagaaacgccauguucugggccggcugauuaccgugaacccuaucgucacagaaaaggacagcccggugaacauugaggccgaacccccuuuuggggauucuuacaucauuaucggcguugagcccggacagcucaaacugaauugguucaagaagggcuccagcauugggcaaauguuugagaccacaaugagaggagcuaaacgcauggccauccuuggcgacaccgccugggauuucgggucucugggaggcguguuuacgagcaucgggaaggcucuccaccaggucuucggcgccauuuacggagcggcuuuuuccggcgugucuuggacaaugaaaauccugauuggggugaucauuaccuggaucggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagauuacaccggagcucaaccacauccuguccgaaaaugagguuaagcugaccaucaugacaggcgacauuaaagggaucaugcaggccggaaagcggucucuuagaccucaacccaccgaacucaaauauagcuggaagacguggggcaaggcgaaaaugcugccuaccgagucccauaaccagacauuccugauugaugggcccgaaaccgccgagugcccuaauacaaaccgcgcuuggaauagccucgagguggaagacuacggauuuggcgucuucaccacaaacaucuggcugaaacuucgggagaaacaggacguguuuugugauucuaagcugauguccgccgcuauuaaagacaauagagccguucacgcggauaugggcuauuggaucgaaagcgcccucaacgacaccuggaagauggagaaggcuucuuucaucgaggugaaauccugccacuggcccaagagccauacgcuguggucuaaugggguccuggaaagcgagaugauuaucccgaaaaacuucgccggaccugugucccagcacaacuaccgccccggcuaucauacacaaaccgcugggcccuggcaccuuggaaagcucgaaauggauuuugacuucugugagggcaccacaguggucguuaccgaagauugcgggaaucggggaccuagccugagaacgacaaccgccucuggcaaacugauuacagaguggugcugucgguccugcacccucccgccccugcgcuacagaggcgaggacggguguugguacggaauggaaauccggccucuuaaggagaaggaagagaaccuggugaauagccucgugacagccggccaugggcagauugauaacuuuucccugggaguccugggcauggcucuuuuccucgaagagaugcugagaacccgcguggggacgaaacacgcgauccugcucguugccgugucuuuugucacccugauuacaggaaauaugagcuuccgggaccuuggcagagugaugguuauggugggcgcuaccaugacagaugacaucgggaugggagucaccuaucuggcccuccuggccgcuuuuaaggugcgccccacguucgccgcgggccugcuucugagaaaacucacauccaaggagcugaugauggcuaccaucgggguugcccuccugucucagagcacaauuccugaaaccauccuugagcugaccgaugcccucgcucugggaaugauggcccugaaaauugugaagaacauggaaaaguaccaacuugcggucacaaucauggcuauuuccugcgugcccaaugccgugauccugcagaacgccuggaaagucucuuguacgauccucgcugccguuagcguguccccucugcuccugaccagcucucagcagaaggcugacuggauuccccuugcccugacaaucaaaggccucaauccgaccgcgauuuuucugacaacccugucccggacgagcaagaaacgcucuuggccucuuaacgaggccaucauggcuguggggauggucuccauucuggccagcucucuccugaagaaugacgugcccaugacaggaccucucguugcuggcggccugcuuaccgugugcuauguccugaccgggagauccgccgaucuggaacucgagcgggccgcugacgugaaaugggaggaucaagcggaaaucagcggauccagccccauccugucuauuacaaucagcgaggacggcuccaugucuauuaagaacgaagaggaggaacagacccuuacaauccugauucgcacggggcuccugguuaucagcggaguguucccggucuccauuccuaucaccgccgcugccugguaccucugggaggugaagaaacagagagccggcguccugugggaugugcccucuccuccgcccguugggaaggcugaacuugaggacggagccuaucggaucaaacagcgcggcauucugggcuacagccaaaucggggcgggaguguauaaggaaggcacauuucacaccauguggcaugucacaagaggggcugugcugaugcaccggggaaaacgcauugagccuuccugggccgauguuaagaaggaccucgugucuuacggcgggggauggaaacuggagggcgaauggaaggagggcgaagagguccaggugcuugcccuggaaccggggaaaaaucccagagcugugcagaccaagccuggaaucuucaaaacgaacaccggcacaauuggggccguuagccucgauuuuucccccggaaccagcggcucuccuaucgucgaccggaaggggaagguggugggacuguacggcaauggcgucgugacaagauccggggcguauguuagcgcuaucgcccagaccgagaaaucuauugaggauaaccccgaaaucgaggacgauauuuuccgcaagaaacggcucacaaucauggaccugcauccuggagccggcaagacgaaaagauaccuuccggcuauugugcgcgaagccaucaagcgggggcugagaacccugauccucgcucccacacgcgucguggccgcggagauggaagaggcccugcggggacuuccuauuagauaucaaacccccgcuauccgcgccgagcacaccggccgggaaauuguugaccugaugugucaugcuacauucacgaugagacuccuguccccugugcggguccccaacuacaaucucaucauuauggaugaggcccacuuuaccgacccggccagcaucgcugcgcgcggguauauuuccacaagaguggaaaugggcgaggccgcuggaaucuucaugaccgccacaccucccggcucucgggaucccuuuccucagagcaacgcccccaucauggacgaggaacgcgagauuccugaaagauccuggaauagcgggcacgaguggguuaccgauuucaagggaaaaacggugugguuugucccgucuaucaaggcuggcaacgacauugccgcgugccugcggaaaaaugggaagaaagugauccagcuuuccagaaagacauucgauagcgaauacgugaagacccgcucuaacgacugggauuuugucguuaccacagacauuagcgagaugggagcuaauuucaaagccgagcgggugaucgaucccagacgcuguaugaagccugugauccugaccgacggcgaagaacgggucauucuggccgggcccaugccugugacacauuccucugcugcccaaagacgcggccggaucggaagaaaccccaaaaaugaaaacgaccaguauauuuacaugggcgagccgcucgaaaaugaugaggacugcgcgcacuggaaggaggccaaaaugcugcuugauaacaucaauaccccugaagggauuauccccagcauguuugagccugaacgcgagaagguugacgcuaucgauggagaauacagacugcggggcgaggcccgcaaaacguucguggaccucaugagaagaggggaucugcccgucuggcuggcuuauaagguggccgcugagggaauuaacuacgccgaccgcagaugguguuuugauggcaucaagaauaaccagauucucgaagagaacguugaaguggagaucuggacaaaagagggggaacggaagaaacuuaagccuagauggcuggacgcgcgcauuuauuccgauccccuggcccucaaagaguucaaggaguucgcugccggccggaagucucugacccuuaaucugaucacagagaugggaagacucccgaccuuuaugacgcagaaagcucgcaacgcccuggacaaucuggccguccuccauaccgcugaagcgggcgggaaggccuacaaccacgcucuuagcgagcugccugagacacuggaaacccuccugcuucugacacuccuggccaccgugacaggaggcauuuuccuguuucucauguccgggaaaggaaucggcaagaugacccuuggcaugugcugcaucauuacggccagcauccugcugugguaugcucaaauucagccccacuggaucgccgcgucuauuauccucgaguucuuucugaucguccuucugauucccgaaccugagaaacagcggacaccgcaggauaaucaacucaccuacgugguuaucgccauucugaccgugguggcugccacaauggcuaacgaaaugggguuccuggagaagaccaagaaagaccucggacuuggcuccaucacaacgcaggagagcgaauccaauauucuggacaucgaucugagacccgccucugcguggacccucuaugccgucgcuacaaccuuuguuacaccuaugcugcggcauagcaucgagaacuccucugugaaugugagccuuaccgccauugcuaaccaggccacgguccugauggggcucggaaagggcuggccccuguccaaaauggacaucggggugccucugcucgcuauuggauguuacagccagguuaaucccaucacccuuacagccgcgcugcugcuccugguggcccacuacgcuauuaucggcccuggccuucaagccaaggcuacccgcgaagcccagaaaagagccgcggcugggauuaugaagaacccgacagucgauggaaucaccgugaucgaccuggagcccauuccuuaugaucccaaguucgaaaaacagcucggccaggucaugcugcugauccucugcgugacgcaaguucuuaugaugcggacaaccugggcccugugugaggcucugacacucgccaccgggccuauuucuacccugugggagggaaaucccggccgcuuuuggaacacaacgaucgccguguccauggcuaauauuuucagagggagcuaccuugccggagcgggccugcucuuuucuaucaugaagaacaccacaaauacccggcgcggcacagggaacaucggagaaacccugggcgagaaauggaaguccagacugaacgcccucgggaaaagcgaguuccagauuuauaagaaaucuggaauccaggaggucgaccggacgcuugcuaaggagggcauuaagcgcggggaaacagaucaucacgccgugagcagaggauccgcuaaacugcggugguuuguugagagaaauauggugaccccggaaggcaaggucguggaccugggcugcgggcgcggaggcuggucuuacuauugugggggacucaaaaacgugcgggagguuaagggccugaccaaagggggaccuggccaugaagaacccauccccaugagcacauacggcuggaaucuugucagacugcaauccgggguggauguguucuucaccccucccgagaagugcgacacacuccugugugauauuggagaaagcuccccuaacccgacgaucgaggccggccgcacccugcggguccucaaucuuguugaaaacuggcugaauaacaauacacaguuuugcaucaaggugcugaaccccuauaugccuucugugauugagaaaauggaaacccuccagagaaaguacgggggagcgcugguccgcaauccccuuagccggaacuccacacacgagauguacugggugucuaaugccaccggcaacaucguuagcuccgugaauaugauuucuagaaugcugaucaaccgcuucacgaugaaacacaagaaagcuaccuaugagccugacgucgaucucgggagcggaacacggaacauuggcaucgaauccgagauccccaaucuggacauuaucggcaagagaauugaaaagaucaaacaggagcaugaaaccagcuggcacuacgaccaagaucauccguauaagacaugggccuaccacgggucuuaugagaccaaacagacaggauccgcuagcucuauggugaacggcguugugcgccugcucaccaagccuugggacgucgugcccauggugacgcagauggccaugacagauaccaccccuuuugggcagcaacgggucuucaaagagaagguugacacaagaacgcaggaacccaaggagggaaccaagaaacuuaugaaaauuacagcugaauggcuguggaaagagcugggcaaaaagaaaaccccucgcauguguacaagagaggaauuuacccggaaggugcgcuccaaugccgcgcucggggccaucuucacagaugagaacaaguggaaaagcgcuagagaagccguggaggacggacgguuuugggaacuggucgauagagagcggaaucuucaccuggagggcaagugcgaaaccuguguguacaacaugaugggcaaacgcgagaagaaacucggggaguucggaaaggcuaagggcucuagagccauuugguauauguggcugggggcccgguuucuggaguucgaagcgcucggauuucugaaugaggaccauugguucucccgcggcaacagccuuuccgggguugagggcgaaggacugcacagacucggcuacauccugcgggaugugagcaaaaaggaagggggagcuauguacgccgacgauacggccggcugggacacccgcaucacacuugaagaccugaaaaaugaggaaauggucaccaaccauaugaagggggagcacaaaaagcucgcugaggccauuuuuaagcugacauaucagaauaaagugguuagagugcagcggcccaccccgcgcggaacggucauggauaucauuucuagacgggaccaacgcggcagcggacaggugggcacauacggacugaacaccuucacaaauauggaagcucagcucaucagacaaauggagggcgaagggauuuucaaguccauccagcaucugaccguuacggaggagaucgccgugcagaacuggcuugcgcgggucggacgcgaaagacugacccggauggccauuucuggcgaugacugcguggucaaaccuaucgaugacagauuugcuaaugcccucacagcucugaacgauauggggaaggugcgcaaagacauucagcaaugggagcccagccggggauggaacgauuggacccagguucccuucugcucccaccacuuucaugaacuugugaugaaggacggcagaguccugguggugccuugucgcaaucaggaugagcucaucgggcgggccagaauuucucagggcgcgggauggagccugaaggaaacagccugccugggcaaauccuaugcucaaauguggacccucauguacuuccaccgccgggaccugagacuugccgcuaacgccaucuguucugcuguuccgagccauugggugcccacaucccgcaccacguggagcauccacgccaagcacgaguggaugacaaccgaggauaugcuggcggucuggaaucggguguggauucaggaaaacccuuggauggaggacaaaacccccguugaaucuugggaggaagugccuuaucucgggaagagagaggaccaguggugcggaucccugaucggccuuacaagccgcgccaccugggcuaaaaauauucagacagccaucaaccaaguccggucucugauugggaaugaggaauacacggauuauaugcccuccaugaagagauuucggagagaggaagaggaagccggagugcucugguga

SEQ ID NO: 19636 - RNA, 9876 nt, Artificial Sequence
  derived and/or modified CDS sequence (opt5) from DENV-2__GQ868640__SS-prME
accgccggagcuaucgugaugcugauucccacagucauggccuuccaccucacgacccggaacggggagccucauaugaucguuggacggcaggaaaagggcaagagccugcuuuuuaagacagaggacggggugaauaugugcacccugauggcgauugaucucggagaacugugugaggacacaaucaccuacaagugcccccuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaaugauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacauuguccucgagcacggguccugugugacaaccauggccaagaauaagcccacacuggauuucgaacuuaucaaaaccgaggcuaagcagccugccacgcugagaaaauauugcguggaagcuaagcucacaaacaccaccacagagagccgguguccgacccaaggagagcccucucugaaugaggaacaggacaaacgcuuuaucugcaagcauuccauggucgauagaggcuggggcaacggguguggacuguucggcaaaggcgggauuguuacaugcgccauguuuacgugcaaaaagaauauggaagggaaaguggugcagccugagaaccucgaauacaccaucgucauuacaccccacagcggggaggagcaugcggugggaaaugacaccggcaagcacggcaaagaaaucaagauuacaccucagucuuccaucaccgaggccgaacugacgggguauggaaccguuacaauggaguguagcccccggaccggccuugauuucaacgaaauggugcugcuccaaauggaggacaaggcuuggcugguccaccgccagugguuucuugaucugccgcucccuuggcugcccggggccgacacacagggaucuaauuggauccagaaggagacccuggugacguucaagaacccucaugcuaaaaagcaagacguugugguccucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgugaaagaaauugcggagacacagcacggcacgaucgucauuagagugcaguaugagggggacggaucccccugcaagauccccuucgaaaucauggaucucgagaaacgccauguucugggccggcugauuaccgugaacccuaucgucacagaaaaggacagcccggugaacauugaggccgaacccccuuuuggggauucuuacaucauuaucggcguugagcccggacagcucaaacugaauugguucaagaagggcuccagcauugggcaaauguuugagaccacaaugagaggagcuaaacgcauggccauccuuggcgacaccgccugggauuucgggucucugggaggcguguuuacgagcaucgggaaggcucuccaccaggucuucggcgccauuuacggagcggcuuuuuccggcgugucuuggacaaugaaaauccugauuggggugaucauuaccuggaucggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagauuacaccggagcucaaccacauccuguccgaaaaugagguuaagcugaccaucaugacaggcgacauuaaagggaucaugcaggccggaaagcggucucuuagaccucaacccaccgaacucaaauauagcuggaagacguggggcaaggcgaaaaugcugccuaccgagucccauaaccagacauuccugauugaugggcccgaaaccgccgagugcccuaauacaaaccgcgcuuggaauagccucgagguggaagacuacggauuuggcgucuucaccacaaacaucuggcugaaacuucgggagaaacaggacguguuuugugauucuaagcugauguccgccgcuauuaaagacaauagagccguucacgcggauaugggcuauuggaucgaaagcgcccucaacgacaccuggaagauggagaaggcuucuuucaucgaggugaaauccugccacuggcccaagagccauacgcuguggucuaaugggguccuggaaagcgagaugauuaucccgaaaaacuucgccggaccugugucccagcacaacuaccgccccggcuaucauacacaaaccgcugggcccuggcaccuuggaaagcucgaaauggauuuugacuucugugagggcaccacaguggucguuaccgaagauugcgggaaucggggaccuagccugagaacgacaaccgccucuggcaaacugauuacagaguggugcugucgguccugcacccucccgccccugcgcuacagaggcgaggacggguguugguacggaauggaaauccggccucuuaaggagaaggaagagaaccuggugaauagccucgugacagccggccaugggcagauugauaacuuuucccugggaguccugggcauggcucuuuuccucgaagagaugcugagaacccgcguggggacgaaacacgcgauccugcucguugccgugucuuuugucacccugauuacaggaaauaugagcuuccgggaccuuggcagagugaugguuauggugggcgcuaccaucacagaugacaucgggaugggagucaccuaucuggcccuccuggccgcuuuuaaggugcgccccacguucgccgcgggccugcuucugagaaaacucacauccaaggagcugaugauggcuaccauugggguugcccuccugucucagagcacaaucccugaaaccauucuugagcugaccgaugcccucgcucugggaaugauggcccugaaaaucgugaagaacauggaaaaguaccaacuugcggucacaauuauggcuaucuccugcgugcccaaugccgugauccugcagaacgccuggaaagucucuuguacgauucucgcugccguuagcguguccccucugcuccugaccagcucucagcagaaggcugacuggaucccccuugcccugacaauuaaaggccucaauccgaccgcgaucuuucugacaacccugucccggacgagcaagaaacgcucuuggccucuuaacgaggccauuauggcuguggggauggucuccauccuggccagcucucuccugaagaaugacgugcccaugacaggaccucucguugcuggcggccugcuuaccgugugcuauguccugaccgggagauccgccgaucuggaacucgagcgggccgcugacgugaaaugggaggaucaagcggaaaucagcggauccagccccauucugucuaucacaauuagcgaggacggcuccaugucuaucaagaacgaagaggaggaacagacccuuacaauucugauccgcacggggcuccugguuauuagcggaguguucccggucuccaucccuaucaccgccgcugccugguaccucugggaggugaagaaacagagagccggcguccugugggaugugcccucuccuccgcccguugggaaggcugaacuugaggacggagccuaucggauuaaacagcgcggcauccugggcuacagccaaauuggggcgggaguguauaaggaaggcacauuucacaccauguggcaugucacaagaggggcugugcugaugcaccggggaaaacgcaucgagccuuccugggccgauguuaagaaggaccucgugucuuacggcgggggauggaaacuggagggcgaauggaaggagggcgaagagguccaggugcuugcccuggaaccggggaaaaaucccagagcugugcagaccaagccuggaauuuucaaaacgaacaccggcacaaucggggccguuagccucgauuuuucccccggaaccagcggcucuccuaucgucgaccggaaggggaagguggugggacuguacggcaauggcgucgugacaagauccggggcguauguuagcgcuauugcccagaccgagaaaucuaucgaggauaaccccgaaauugaggacgauaucuuccgcaagaaacggcucacaauuauggaccugcauccuggagccggcaagacgaaaagauaccuuccggcuaucgugcgcgaagccaucaagcgggggcugagaacccugauucucgcucccacacgcgucguggccgcggagauggaagaggcccugcggggacuuccuaucagauaucaaacccccgcuauucgcgccgagcacaccggccgggaaaucguugaccugaugugucaugcuacauucacgaugagacuccuguccccugugcggguccccaacuacaaucucauuaucauggaugaggcccacuuuaccgacccggccagcauugcugcgcgcggguauaucuccacaagaguggaaaugggcgaggccgcuggaaucuucaugaccgccacaccucccggcucucgggaucccuuuccucagagcaacgcccccauuauggacgaggaacgcgagaucccugaaagauccuggaauagcgggcacgaguggguuaccgauuucaagggaaaaacggugugguuugucccgucuauuaaggcuggcaacgacaucgccgcgugccugcggaaaaaugggaagaaagugauucagcuuuccagaaagacauucgauagcgaauacgugaagacccgcucuaacgacugggauuuugucguuaccacagacaucagcgagaugggagcuaauuucaaagccgagcgggugaucgaucccagacgcuguaugaagccugugauucugaccgacggcgaagaacgggucauccuggccgggcccaugccugugacacauuccucugcugcccaaagacgcggccggauuggaagaaaccccaaaaaugaaaacgaccaguauaucuacaugggcgagccgcucgaaaaugaugaggacugcgcgcacuggaaggaggccaaaaugcugcuugauaacauuaauaccccugaagggaucauccccagcauguuugagccugaacgcgagaagguugacgcuauugauggagaauacagacugcggggcgaggcccgcaaaacguucguggaccucaugagaagaggggaucugcccgucuggcuggcuuauaagguggccgcugagggaaucaacuacgccgaccgcagaugguguuuugauggcauuaagaauaaccagauccucgaagagaacguugaaguggagauuuggacaaaagagggggaacggaagaaacuuaagccuagauggcuggacgcgcgcaucuauuccgauccccuggcccucaaagaguucaaggaguucgcugccggccggaagucucugacccuuaaucugauuacagagaugggaagacucccgaccuuuaugacgcagaaagcucgcaacgcccuggacaaucuggccguccuccauaccgcugaagcgggcgggaaggccuacaaccacgcucuuagcgagcugccugagacacuggaaacccuccugcuucugacacuccuggccaccgugacaggaggcaucuuccuguuucucauguccgggaaaggaaucggcaagaugacccuuggcaugugcugcauuaucacggccagcauucugcugugguaugcucaaauccagccccacuggauugccgcgucuaucauccucgaguucuuucugauuguccuucugauccccgaaccugagaaacagcggacaccgcaggauaaucaacucaccuacgugguuauugccauccugaccgugguggcugccacaauggcuaacgaaaugggguuccuggagaagaccaagaaagaccucggacuuggcuccauuacaacgcaggagagcgaauccaauauccuggacaucgaucugagacccgccucugcguggacccucuaugccgucgcuacaaccuuuguuacaccuaugcugcggcauagcauugagaacuccucugugaaugugagccuuaccgccaucgcuaaccaggccacgguccugauggggcucggaaagggcuggccccuguccaaaauggacauuggggugccucugcucgcuaucggauguuacagccagguuaaucccauuacccuuacagccgcgcugcugcuccugguggcccacuacgcuaucauuggcccuggccuucaagccaaggcuacccgcgaagcccagaaaagagccgcggcugggaucaugaagaacccgacagucgauggaaucaccgugauugaccuggagcccaucccuuaugaucccaaguucgaaaaacagcucggccaggucaugcugcugauucucugcgugacgcaaguucuuaugaugcggacaaccugggcccugugugaggcucugacacucgccaccgggccuaucucuacccugugggagggaaaucccggccgcuuuuggaacacaacgauugccguguccauggcuaauaucuucagagggagcuaccuugccggagcgggccugcucuuuucuaucaugaagaacaccacaaauacccggcgcggcacagggaacauuggagaaacccugggcgagaaauggaaguccagacugaacgcccucgggaaaagcgaguuccagaucuauaagaaaucuggcauucaggaggucgaccggacgcuugcuaaggagggcaucaagcgcggggaaacagaucaucacgccgugagcagaggauccgcuaaacugcggugguuuguugagagaaauauggugaccccggaaggcaaggucguggaccugggcugcgggcgcggaggcuggucuuacuauugugggggacucaaaaacgugcgggagguuaagggccugaccaaagggggaccuggccaugaagaacccauucccaugagcacauacggcuggaaucuugucagacugcaauccgggguggauguguucuucaccccucccgagaagugcgacacacuccugugugauaucggagaaagcuccccuaacccgacgaucgaggccggccgcacccugcggguccucaaucuuguugaaaacuggcugaauaacaauacacaguuuugcauuaaggugcugaaccccuauaugccuucugugaucgagaaaauggaaacccuccagagaaaguacgggggagcgcugguccgcaauccccuuagccggaacuccacacacgagauguacugggugucuaaugccaccggcaacauuguuagcuccgugaauaugaucucuagaaugcugauuaaccgcuucacgaugaaacacaagaaagcuaccuaugagccugacgucgaucucgggagcggaacacggaacaucggcaucgaauccgagauucccaaucuggacaucauuggcaagagaaucgaaaagauuaaacaggagcaugaaaccagcuggcacuacgaccaagaucauccguauaagacaugggccuaccacgggucuuaugagaccaaacagacaggauccgcuagcucuauggugaacggcguugugcgccugcucaccaagccuugggacgucgugcccauggugacgcagauggccaugacagauaccaccccuuuugggcagcaacgggucuucaaagagaagguugacacaagaacgcaggaacccaaggagggaaccaagaaacuuaugaaaaucacagcugaauggcuguggaaagagcugggcaaaaagaaaaccccucgcauguguacaagagaggaauuuacccggaaggugcgcuccaaugccgcgcucggggccauuuucacagaugagaacaaguggaaaagcgcuagagaagccguggaggacggacgguuuugggaacuggucgauagagagcggaaucuucaccuggagggcaagugcgaaaccuguguguacaacaugaugggcaaacgcgagaagaaacucggggaguucggaaaggcuaagggcucuagagccaucugguauauguggcugggggcccgguuucuggaguucgaagcgcucggauuucugaaugaggaccauugguucucccgcggcaacagccuuuccgggguugagggcgaaggacugcacagacucggcuacauccugcgggaugugagcaaaaaggaagggggagcuauguacgccgacgauacggccggcugggacacccgcauuacacuugaagaccugaaaaaugaggaaauggucaccaaccauaugaagggggagcacaaaaagcucgcugaggccaucuuuaagcugacauaucagaauaaagugguuagagugcagcggcccaccccgcgcggaacggucauggauauuaucucuagacgggaccaacgcggcagcggacaggugggcacauacggacugaacaccuucacaaauauggaagcucagcucauuagacaaauggagggcgaagggaucuucaaguccauccagcaucugaccguuacggaggagauugccgugcagaacuggcuugcgcgggucggacgcgaaagacugacccggauggccaucucuggcgaugacugcguggucaaaccuauugaugacagauuugcuaaugcccucacagcucugaacgauauggggaaggugcgcaaagacauccagcaaugggagcccagccggggauggaacgauuggacccagguucccuucugcucccaccacuuucaugaacuugugaugaaggacggcagaguccugguggugccuugucgcaaucaggaugagcucauugggcgggccagaaucucucagggcgcgggauggagccugaaggaaacagccugccugggcaaauccuaugcucaaauguggacccucauguacuuccaccgccgggaccugagacuugccgcuaacgccaucuguucugcuguuccgagccauugggugcccacaucccgcaccacguggagcauucacgccaagcacgaguggaugacaaccgaggauaugcuggcggucuggaaucggguguggauccaggaaaacccuuggauggaggacaaaacccccguugaaucuugggaggaagugccuuaucucgggaagagagaggaccaguggugcggaucccugauuggccuuacaagccgcgccaccugggcuaaaaauauccagacagccauuaaccaaguccggucucugaucgggaaugaggaauacacggauuauaugcccuccaugaagagauuucggagagaggaagaggaagccggagugcucugguga

SEQ ID NO: 19637 - RNA, 9876 nt, Artificial Sequence
  derived and/or modified CDS sequence (opt5) from DENV-2__FJ850078__SS-prME
accgccggcgugaucgucaugcugauucccacaguuauggcuuuccaccucacgaccagaaacggggagccucauaugaucgugggacggcaggaaaagggcaaaagccugcuuuuuaagacagaggacggggugaauaugugcacccugauggccauugaucucggagaacugugugaggacacaaucaccuacaaaugcccgcuucugcgccaaaacgaacccgaggauauugacuguuggugcaauuccacaucuaccugggucacguauggcaccuguacaaccacaggggagcacagacgggaaaagcgcagcguggcgcucguuccucaugugggaaugggccuggagaccagaacggaaacauggauguccucugagggcgcuuggaaacacguccagcggaucgagaccuggauccugcgccaucccggguucacaaugauggccgccauucucgcuuacaccaucggaaccacacacuuucagagagcccugauuuucauccuucugacggcuguggccccuagcaugaccaugcggugcauuggcaucuccaaccgcgauuuuguugaaggggugucuggaggcagcugggucgacauugugcucgagcacggguccugugugacaaccauggcgaagaauaagcccacacuggauuucgaacuuaucaaaaccgaggccaagcagccugcuacgcugagaaaauauugcgucgaagccaagcucacaaacaccaccacagagagccgguguccgacccaaggagagcccucucugaaugaagagcaggacaaacgcuuuaucugcaagcauuccaugguugauagaggcuggggcaacggguguggacuguucggcaaggggggaauugugacaugcgcuauguuuacgugcaaaaagaauauggaaggcaaagugguccagccugagaaccucgaauacaccaucgugauuacaccccacagcggggaggagcaugccguuggaaaugacaccggcaagcacggcaaagaaaucaagauuacaccucagucuuccaucaccgaggcggaacugacgggguauggaaccgugacaauggaguguagcccccggaccggccuugauuucaacgaaaugguccugcuccaaauggaggacaaagccuggcuggugcaccgccagugguuucuugaucugccgcucccuuggcugcccggggcugacacacagggaucuaauuggauccagaaggagacccugguuacguucaagaacccucaugccaaaaagcaagacguggucgugcucggcucccaggaaggggcuaugcacacagcccugaccggcgccacagagauucagaugagcuccggaaaucuucuguuuaccggccaucucaaaugcagacugcggauggauaagcuucaacugaaagggaugucuuacagcauguguaccggaaaguucaagaucgucaaagaaauugcugagacacagcacggcacgaucgugauuagaguucaguaugagggggacggaucccccugcaagauccccuucgaaaucauggaucucgagaaacgccaugugcugggccggcugauuaccgucaacccuaucgugacagaaaaggacagcccgguuaacauugaggcggaacccccuuuuggggauucuuacaucauugugggcgucgagcccggacagcucaaacugaauugguucaagaagggcuccagcaucgggcaaauguuugagaccacaaugagaggagccaaacgcauggcuauucuuggcgacaccgccugggauuucgggucucugggaggcguguuuacgagcaucgggaaggcccuccaccagguguucggcgcuaucuacggagccgcguuuaacggcguuuccuggacaaugaaaauucugaucggggucauuaucaccuggauuggaaugaauucucggagcaccucccugagcgugucucuugugcucgucggcgugguuacacuguaucugggggcuauggugcaggccgacuccggaugugucgugagcuggaagaacaaagaacucaagugcggcucugggaucuucaucaccgauaauguucacacauggacggagcaguacaaguuucaaccugaaucccccagcaaacuggccuccgcuauucagaaggcccaugaggaaggcaucuguggaauuagaucugugacccgccuugagaaccugauguggaaacagaucacaccggagcucaaucacauucugagcgaaaacgaggucaagcugaccaucaugacaggcgacaucaaagggauuaugcaggcuggaaagcggucccuuagaccucaacccaccgaacucaaauauucuuggaagacguggggcaaggccaaaaugcugccuaccgagagccauaaucagacauuccugaucgaugggcccgaaaccgcggagugcccuaacgccaaucgcgcuuggaacucccucgagguggaagacuacggauuuggcguuuucacaaccaauauuuggcugaagcuucgggagaaacaggacguguuuugugauagcaagcugaugucugccgcuaucaaagacaacagagccguccacgcggauaugggcuauuggauugaauccgcccucaaugacacauggaagauggagaaggcuagcuucaucgaggugaaaucuugccacuggcccaagucccauacccuguggagcaacggggugcuggaaucugagaugaucauuccgaaaaacuucgccggaccugucagccagcacaauuaccgccccggcuaucauacgcaaacagcugggcccuggcaccuuggaaagcucgaaauggauuuugacuucugugagggcaccaccguuguggugacagaagauugcgggaaccggggaccuucccugagaaccacgacagccagcggcaaacugaucaccgaguggugcugucggucuugcacacucccgccccugcgcuacagaggcgaggacggguguugguacggaauggaaauucggccucuuaaggagaaggaagagaaucuggucaacucccucgugaccgccggccaugggcagaucgauaauuuuagccugggaguucugggcauggcucuuuuccucgaagagaugcugagaacacgcguggggaccaaacacgcgauucugcucgucgccguguccuuuguuacgcugaucaccggaaacaugucuuuccgggaccuuggcagagugauggucauggugggcgcuacaaugaccgaugacauugggaugggaguuacauaucuggcccuccuggccgcuuuuaaggugcgccccaccuucgccgcgggccugcuucugagaaaacucacgagcaaggagcugaugauggcuacaaucggggucgcccuccugucccagucuaccaucccugaaacaauucuugagcugaccgaugcccucgcucugggaaugauggcccugaaaaucgugaagaauauggaaaaguaccaacuugcggugaccauuauggcuaucagcugcguccccaacgccguuauucugcagaaugccuggaaaguguccuguacaauccucgcugccgugucugucagcccucugcuccugacguccagccagcagaaggcugacuggaucccccuugcccugaccauuaaaggccucaacccgacagcgaucuuucugaccacacugucucggaccuccaagaaacgcagcuggccucuuaaugaggccgugauggcuguugggauggugucuauucuggccuccagccuccugaagaacgacauccccaugacgggaccucucgucgcuggcggccugcuuacagugugcuauguucugaccgggagaucugccgaucuggaacucgagcgggccgcugacgugaaaugggaggaucaagcggaaauuuccggaagcucccccauccugagcaucaccauuucugaggacggcagcauguccaucaagaaugaagaggaggaacagacacuuaccauucugauccgcacagggcuccuggucauuucuggaguguucccggucagcaucccuauuacggccgcugccugguaccucugggaggugaagaaacagagagccggcguucugugggaugugcccuccccuccccccgucgaaaaggcugagcuugaagacggggccuaucggaucaaacagcgcggaauccugggcuacucucaaauuggcgcggggguguauaaggagggaaccuuucacacaauguggcauguuaccagaggcgcugugcugaugcaccgggggaaacgcaucgagccuagcugggccgaugucaagaaggaccucguguccuacggaggcggguggaaacuggaaggagaguggaaggaaggcgaggaagugcagguucuugcccuggagccgggcaaaaaccccagagcuguccagacaaagccugggauuuucaaaaccaauacgggaaccaucggcgccgugucucucgauuuuagccccgggacauccggaagcccuauuguggaccggaagggcaaggucguggggcuguacggaaacggcguugugaccagaucuggcgcguaugucuccgcuaucgcccagacagagaaaagcaucgaagauaaccccgagauugaagacgauaucuuccgcaagaaacggcucaccauuauggaccugcauccuggggccggaaagacaaaaagauaccuuccggcuaucgugcgcgaggccauuaagcggggccugagaacgcugauccucgcucccacccgcguuguggccgcggaaauggaggaggcccugcgggggcuuccuaucagauaucaaacacccgcuauucgcgccgaacacaccggacgggagaucgucgaccugaugugucaugcuaccuucacaaugagacuccugucuccugugcggguucccaauuacaaccucauuaucauggaugaagcccacuuuacggacccggccuccauugcugcgcgcggcuauaucagcaccagaguggagaugggggaggccgcuggcauuuucaugacagccaccccucccggaucccgggaucccuuuccucagucuaaugcccccaucauggacgaagagcgcgaaaucccugagagaagcuggaacuccggccacgaaugggucacagauuucaaggggaaaaccgugugguuugugccgagcauuaaggcuggaaaugacaucgccgcgugccugcggaaaaacggcaagaaagucauucagcuuucuagaaagacguucgauuccgaguacguuaagacacgcagcaaugacugggauuuuguggugaccaccgacaucucugagaugggggcuaacuucaaagccgaacgggucauugaucccagacgcuguaugaagccugugauccugacagacggagaggaacggguuauccuggccggccccaugccugugacccauagcuccgcugcccaaagacgcgggcggauuggcagaaaucccaaaaacgagaaugaccaguauaucuacaugggagaaccgcucgagaacgaugaggacugcgcgcacuggaaggaagccaaaaugcugcuugauaauauuaacacaccugagggcaucauucccucuauguuugaaccugagcgcgaaaaggucgacgcuaucgauggggaguacagacugcggggagaggcccgcaaaaccuucguggaccucaugagacggggcgaucugcccguuuggcuggcuuauaagguggccgcugaagggaucaauuacgccgaccgcagaugguguuuugauggaauuaagaacaaccagauccucgaggaaaaugucgagguggagauuuggacgaaagaaggcgagcggaagaaacuuaagccuagauggcuggacgcgcgcaucuauagcgauccccuggcccucaaagaauucaaggaguucgcugccgggcggaagucccugacacuuaaccugauuaccgaaaugggcagacucccgacauuuaugacccagaaagcucgcaaugcccuggacaaccuggccguccuccauacggcugaggcgggaggcaaggccuacaaucacgcucuuucugagcugccugaaacccuggagacacuccugcuucugacccuccuggccacagugaccgggggaaucuuccuguuucucaugagcggcaaagggauuggaaagaugacacuuggcaugugcugcaucaucaccgccuccauucugcugugguaugcucaaauccagccccacuggauugccgcgagcaucauucucgaauucuuucugaucguucuucugauccccgagccugaaaaacagcggacgccgcaggauaaccaacucacauacguggugauugccauccugaccgucguugcugccaccauggcuaaugagaugggcuuccuggagaagacaaagaaagaccucgggcuuggaucuauuaccacacaggaauccgagagcaacauccuggacauugaucugagacccgccuccgcguggacgcucuaugccguggcuaccacauuugugaccccuaugcugcggcauucuaucgaaaauagcuccgucaacgugucucuuacagccaucgcuaaucaggccaccguucugaugggccucgggaagggauggccccugagcaaaauggacauuggcgugccucugcucgcuaucggguguuacucccaggucaaccccauuacgcuuaccgccgcgcugcugcuccugguggcccacuacgcuaucauuggaccuggccuucaagccaaggcuacacgcgaggcccagaaaagagccgcggcuggcaucaugaagaauccgaccgucgaugggauuacagugaucgaccuggaacccaucccuuaugaucccaaguucgagaaacagcucggacagguuaugcugcugauucucugcgugacccaaguccuuaugaugcggacgacaugggcccugugugaggcucugacccucgccacaggcccuaucagcacccugugggaagggaaccccggacgcuuuuggaauaccacaauugccgugucuauggcuaacaucuucagaggcuccuaccuugccggggcgggacugcucuuuagcauuaugaagaauacgaccaacacacggcgcggcaccggcaacaucggggagacacugggagaaaaauggaagucuagacugaaugcccucggcaaauccgaguuccagaucuauaagaaaagcgggauucaggagguugaccggacccuugcuaaggaaggaaucaagcgcggcgagacggaucaucacgccgugucuagagggagcgcuaaacugcggugguuugucgaaagaaacauggugacaccggagggaaaggugguugaccugggcugcggccgcgggggaugguccuacuauuguggcgggcucaaaaauguccgggaagugaagggacugaccagaggcgggccuggacaugaggagcccauucccaugucuaccuacggcuggaaccuugugcgccugcaaagcggcgucgauguuuucuucacaccucccgaaaaaugcgacacccuccugugugauaucggggaguccagcccuaauccgacaauugaagccggacggacgcugagagugcucaaccuuguggagaauuggcugaacaauaacacccaguuuugcaucaagguccugaaucccuauaugccuuccgugaucgaaaagauggagacacuccagcgcaaauacggcggggcgcugguucggaacccccuuucuagaaauagcacccacgagauguacuggguguccaacgccacaggaaauauugucucuagcgugaacaugaucucccgcaugcugauuaaccgguucaccaugaagcacaaaaaggcuacguaugaaccugacguugaucucggcucugggaccagaaauaucggaauugagagcgaaauccccaaccuggacaucauuggcaaacgcaucgagaagauuaagcaggaacaugagacauccuggcacuacgaccaagaucauccguauaaaaccugggccuaccacggcagcuaugagacaaagcagaccgggucugcuuccagcauggugaauggagucgugcggcugcucacaaaaccuugggacgugguccccaugguuacccagauggccaugacggauacaaccccuuuuggccagcaaagaguguucaaggaaaaaguggacacccgcacacaggagcccaaggaagggacgaagaaacuuaugaagaucaccgcugaguggcuguggaaagagcugggaaagaaaaagacaccuagaauguguacccgggaagaguuuacacgcaaagucagaucuaacgccgcgcucggcgccauuuucaccgaugaaaauaaguggaaguccgcucgggaggccguggaagacgggagauuuugggagcugguugaucgggagcgcaaccuucaccuggaaggaaaaugcgagacauguguguacaauaugaugggcaagagagaaaaaaagcucggcgaguucgggaaagcuaagggaagccgggccaucugguauauguggcugggcgcccgcuuucuggaauucgaggcgcucggguuucugaacgaggaccauugguucucuagaggaaauucccuuagcggcgucgaaggggagggccugcaccggcucggauacauucugcgcgauguguccaagaaagaaggcggggcuauguacgccgacgauaccgccggaugggacacgagaaucacccuugaggaccugaagaacgaagagaugguuacaaaucauaugaaaggcgagcacaagaaacucgcugaagccaucuuuaagcugaccuaucagaacaaggugguccgggugcagcgccccacaccgagagggaccguuauggauauuaucagccggcgcgaccaaagaggaucuggccagguggggacguacggccugaauacauucaccaacauggaggcucagcucauucggcaaauggaaggagagggcaucuucaaaagcauucagcaucugacagucaccgaggaaaucgccgugcagaauuggcuugcgcgcgucgggagagagcggcugacgagaauggccaucuccggagaugacugcgugguuaagccuauugaugaccgcuuugcuaacgcccucaccgcucugaacgauaugggcaaagugcggaaggacauccagcaaugggaacccucuagaggguggaaugauuggacacagguccccuucugcagccaccacuuucaugagcuugugaugaaagacggacgcgugcugguugugccuugucggaaccaggaugaacucauuggcagagcccgcaucucccagggggcgggcuggucucugaaggagaccgccugccugggaaagagcuaugcucaaauguggacacucauguacuuccaccggagagaccugcgccuugccgcuaaugccauuuguuccgcugucccgucucauugggugcccaccagccggacaaccugguccauccacgccaaacacgaguggaugacgacagaagauaugcuggcgguuuggaacagaguguggauccaggagaauccuuggauggaagacaagacccccgucgagagcugggaagaggugccuuaucucggcaaacgcgaggaccaguggugcgggucucugauuggacuuaccucccgggccacaugggcuaagaacauccagaccgccauuaaucaagucagaagccugaucggcaacgaagaguacacagauuauaugcccucuaugaaacgguuuagacgcgaagaggaagaggccggggugcucugguga

SEQ ID NO: 19638 - RNA, 9876 nt, Artificial Sequence
  derived and/or modified CDS sequence (opt5) from DENV-2__FJ850082__SS-prME
accgugggaguuaucguuaugcugauucccacagccauggcuuuccaccucacgacccggaacggggagccucauaugaucgugggacggcaggaaaagggcaagagccugcuuuuuaagacagagaauggggugaacaugugcacccugauggccauugaccucggagaacugugugaggauacaaucaccuacaagugcccgcuucugcgccaaaaugaacccgaggacauugauuguuggugcaacuccacaucuaccugggugacguauggcaccuguacaaccacaggggagcaccggcgggaaaagcgcagcguggcgcucguuccucaugugggaaugggccuggagaccagaacggaaacauggauguccucugagggcgcuuggaagcacguccagcggaucgagaccuggauccugcgccaucccggguucacaauuauggccgccauccucgcuuacaccauuggaaccacacacuuucagagagcccugaucuucauucuucugacggcuguggccccuagcaugaccaugcggugcaucggcauuuccaaucgcgacuuuguugaaggggugucuggaggcagcugggucgauaucgugcucgagcacggguccugugugacaaccauggcgaagaacaagcccacacuggacuucgaacuuaucaagaccgaggccaagcagccugcuacgcugagaaaauauugcgucgaagccaagcucacaaauaccaccacagagagccgguguccgacccaaggagagcccucucugaacgaggaacaggauaaacgcuuuauuugcaagcauuccaugguugacagaggcuggggcaauggguguggacuguucggcaaagggggaaucgugacaugcgcuauguuuacgugcaaaaagaacauggaaggcaaagugguccagccugagaaucucgaauacaccauugugaucacaccccacagcggggaggagcaugccguuggaaacgauaccggcaagcacggcaaagaaauuaagaucacaccucagucuuccaucaccgaggcggaacugacgggguauggaaccgugacaauggaguguagcccccggaccggccuugacuucaaugaaaugguccugcuccaaauggaggauaaagccuggcuggugcaccgccagugguuucuugaccugccgcucccuuggcugcccggggcugauacacagggaucuaacuggauucagaaggagacccugguuacguucaagaauccucaugccaaaaagcaagacguggucgugcucggcucccaggaaggggcuaugcacacagcccugaccggcgccacagagauccagaugagcuccggaaaccuucuguuuaccggccaucucaaaugcagacugcggauggacaaacuucaacugaaagggaugucuuacagcauguguaccggaaaguucaagauugucaaagaaaucgcugagacacagcacggcacgauugugaucagaguucaguaugagggggauggaucccccugcaagauccccuucgaaauuauggaccucgagaaacgccaugugcugggccggcugaucaccgucaacccuauugugacagaaaaggauagcccgguuaauaucgaggcggaacccccuuuuggggacucuuacauuaucauuggcguggagcccggacagcucaaacugaacugguucaagaagggcuccagcaucgggcaaauguuugagaccacaaugagaggagccaaacgcauggcuauccuuggcgauaccgccugggacuucgggucucugggaggcgucuuuacgagcauugggaaggcccuccaccagguguucggcgcuaucuacggagccgcguuuuccggcgugucuuggacaaugaaaauucugaucgggguuauuaucaccuggaucggaaugaauagccgguccaccagccugucugucucccuugugcucgugggcgucgugacacuguaucugggggcuaugguucaggccgauagcggauguguggucucuuggaagaacaaagaacucaagugcggcuccgggauuuucaucaccgacaaugugcacacauggacggagcaguacaaguuucaaccugaaagccccuccaaacuggccucugcuauucagaaggcccaugaggaaggcaucuguggaauuagaagcguuacccgccuugagaaccugauguggaaacagaucacaccggagcucaaucacauccuguccgaaaacgaggugaagcugaccauuaugacaggcgauaucaaagggauuaugcaggcuggaaagcggucucuuagaccucaacccaccgaacucaaauauagcuggaagacguggggcaaggccaaaaugcuguccaccgagagccauaaucagacauuccugaucgacgggccugaaaccgcggagugccccaacacaaaucgcgccuggaacucucucgaggucgaagauuacggauuuggcguguucaccacaaauauuuggcugaaacuucgggagaaacaggacgucuuuugugacuccaagcugaugagcgcugccgugaaagauaacagagcuguccacgccgacaugggcuauuggaucgaaucugcgcucaaugauaccuggaagauggagaaggccuccuucaucgaggugaaaagcugccacuggccuaagucucauacgcuguggagcaacggggugcuggaauccgagaugauuauccccaaaaacuucgcuggaccggucagccagcacaauuaccgcccuggcuaucauacacaaaccgccgggcccuggcaccuuggaaagcucgaaauggacuuugauuucugugagggcaccacaguuguggugaccgaagacugcgggaaccggggacccucucugagaacgacaaccgcuuccggcaaacugauuacagaguggugcugucggagcugcacccucccuccgcugcgcuacagaggcgaggauggguguugguacggaauggaaauccggccccuuaaggagaaggaagagaaucuggucaacucccucgugacagccggccaugggcagauugacaauuuuucucugggaguucugggcauggcccuuuuccucgaagagaugcugagaacccgcguggggacgaaacacgcuauccugcucgucgcggugagcuuuguuacccugauuacaggaaacauguccuuccgggaucuuggcagagugauggucauggugggcgccaccaugacagacgauaucgggaugggaguuaccuaucuggcucuccuggccgccuuuaaggugcgcccuacguucgcugccggccugcuucugagaaaacucacaucuaaggagcugaugauggcgaccaucggggucgcucuccugagccaguccacaauucccgaaaccauccuugagcugaccgacgcccucgcccugggaaugauggcucugaaaauugugaagaauauggaaaaguaccaacuugccgugacaaucauggcgauuucuugcgucccuaacgcuguuauccugcagaaugccuggaaagugagcuguacgauccucgccgcuguguccgucagcccccugcuccugaccucuucccagcagaaggccgauuggauuccucuugcucugacaaucaaaggccucaaccccaccgccauuuuucugacaacccugagccggacgucuaagaaacgcuccuggccgcuuaaugaggcgaucauggccguggggaugguuagcauucuggcuucuucccuccugaagaacgacaucccuaugacaggaccccucguggccggcggccugcuuaccgucugcuaugugcugaccgggagaagcgcugaccuggaacucgagcgggccgccgauguuaaaugggaggaccaagcugaaaucuccggaagcucuccuauucugagcaucacaauuuccgaggauggcucuaugagcaucaagaaugaagaggaggaacagacccuuacaauucugauccgcacggggcuccuggugauuuccggagucuuccccgugucuaucccgaucaccgcggccgcuugguaccucugggaggucaagaaacagagagccggcgugcugugggacguuccuucucccccucccguggggaaggccgaacuugaggaaggagcuuaucggauuaaacagcgcggcauccugggcuacucccaaauuggggccggagucuauaaggagggcacauuucacaccauguggcaugugacaagaggggcgguucugaugcaccggggaaaacgcaucgagcccuccugggcugaugugaagaaggaccucgucagcuacggcgggggauggaaacuggaaggcgaguggaaggaaggcgaggaaguccaggugcuugcccuggagccugggaaaaacccgagagccguucagaccaagcccggaauuuucaaaacgaauaccggcacaaucggggcugucucccucgauuuuagcccuggaaccucuggcucccccaucguggaccggaaggggaagguggucggacuguacggcaacggcgugguuacaagaagcggggccuaugugucugcgauugcucagaccgauaaauccaucgaggacaacccugaaauugaggaugacaucuuccgcaagaaacggcucacaauuauggaucugcaucccggagccggcaagacgaaaagauaccuuccugccaucguccgcgaagcuaucaagcgggggcugagaacccugauucucgccccgacacgcgugguugcugccgagauggaagaggcgcugcggggacuucccaucagauaucaaaccccugccauucgcgcugagcacaccggccgggaaaucguggaccugaugugucaugccacauucacgaugagacuccugagccccguccgggugccuaauuacaaccucauuaucauggacgaggcucacuuuaccgaucccgccuccauugccgcucgcggguauaucucuacaagaguugaaaugggcgaggcggccggaaucuucaugaccgcuacaccgccuggcagccgggaccccuuuccccaguccaaugccccuauuauggaugaggaacgcgagauccccgaaagaagcuggaacucugggcacgagugggugaccgacuucaagggaaaaacggucugguuugugccuuccauuaaggccggcaaugauaucgcugccugccugcggaaaaacgggaagaaagugauucagcuuagcagaaagacauucgacucugaauacgucaagacccgcgcgaaugauugggacuuuguugugaccacagauaucagcgagaugggagcuaacuucaaagccgagcgggugaucgacccgagacgcuguaugaagcccgucauucugaccgauggcgaagaacgggugauccuggccgggccuaugcccguuacacauuccucugcugcccaaagacgcggccggauuggaagaaauccuaaaaacgaaaaugaccaguauaucuacaugggcgagccccucgaaaacgacgaggauugcgcgcacuggaaggaggccaaaaugcugcuugacaauauuaacaccccggaagggaucaucccuagcauguuugagcccgaacgcgagaagguggaugcuauugacggagaauacagacugcggggcgaggcccgcaaaacguucgucgaucucaugagaagaggggaccugccuguguggcuggcuuauaagguugccgcugagggaaucaauuacgccgaucgcagaugguguuuugacggcauuaagaacaaccagauccucgaagagaauguggaagucgagauuuggacaaaagagggggaacggaagaaacuuaagcccagauggcuggaugcgcgcaucuauuccgacccucuggcccucaaagaguucaaggaguucgcugccggccggaagucucugacccuuaaccugauuacagagaugggaagacuccccaccuuuaugacgcagaaagcucgcaaugcccuggauaaccuggccgugcuccauaccgcugaagcgggcgggaaggccuacaaucacgcucuuagcgagcugccggagacacuggaaacccuccugcuucugacacuccuggccaccgucacaggaggcaucuuccuguuucucauguccgggaaaggaaucggcaagaugacccuuggcaugugcugcauuaucacggccagcauucugcugugguaugcucaaauccagccucacuggauugccgcgucuaucauccucgaguucuuucugauugugcuucugauccccgaacccgagaaacagcggacaccucaggacaaccaacucaccuacguugugauugccauccugaccguggucgcugccacaauggcuaaugaaaugggguuccuggagaagaccaagaaagaucucggacuuggcuccauuacaacgcaggagagcgaauccaacauccuggacaucgaccugagaccggccucugcguggacccucuaugccguugcuacaaccuuugugacacccaugcugcggcauagcauugaaaauagcucugugaacgucagccuuaccgccaucgcuaaucaggccacggugcugauggggcucggaaagggcuggccucuguccaaaauggauauugggguuccccugcucgcuaucggauguuacagccaggugaacccuauuacccuuacagccgcgcugcugcuccuggucgcccacuacgcuaucauuggccccggccuucaagccaaggcuacccgcgaagcccagaaaagagccgcggcugggaucaugaagaauccuacaguggacggaaucaccgucauugaucuggagccgauccccuaugacccuaaguucgaaaaacagcucggccaggugaugcugcugauucucugcguuacgcaagugcuuaugaugcggacaaccugggcccugugugaggcucugacacucgccaccgggcccaucucuacccugugggagggaaacccuggccgcuuuuggaauacaacgauugccgucuccauggcuaacaucuucagagggagcuaccuugccggagcgggccugcucuuuucuaucaugaagaauaccacaaacacccggcgcggcacagggaacauuggagaaacccugggcgagaaauggaaguccagacugaaugcccucgggaaaagcgaguuccagaucuauaagaaaucuggcauucaggagguggaucggacgcuugcuaaggagggcaucaagcgcggggaaacagaccaucacgccguuagcagaggauccgcuaaacugcggugguuuguggagagaaacauggucacccccgaaggcaaggugguggaucugggcugcgggcgcggaggcuggucuuacuauugugggggacucaaaaauguucgggaggucaagggccugaccaaagggggaccgggccaugaggaaccuauucccaugagcacauacggcuggaaccuugugagacugcaauccgggguggacgucuucuucacacccccugagaagugcgauacccuccugugugacaucggagaaagcucccccaauccuacgaucgaggccggccgcacccugcggguucucaaccuuguggaaaauuggcugaacaauaacacacaguuuugcauuaaggugcugaauccguauaugcccucugucaucgagaaaauggaaacccuccagagaaaguacgggggagcgcuggugcgcaacccucuuagcagaaauuccacacacgagauguacuggguuucuaacgccaccggcaauauugugagcuccgucaacaugaucucuagaaugcugauuaaccgcuucacgaugaaacacaagaaagcuaccuaugagcccgauguggaccucgggagcggaacacggaauaucggcaucgaauccgagguuccuaaccuggauauuaucggcaagagaauugaaaagaucaaacaggagcaugaaaccagcuggcacuacgaccaagaccaucccuauaagacaugggccuaccacgggucuuaugagaccaaacagacaggauccgcuagcucuauggugaauggcgucgugcgccugcucaccaagccgugggauguggucccuaugguuacgcagauggccaugacagacaccacccccuuugggcagcaacggguguucaaagagaagguggauacaagaacgcaggaaccuaaggagggaaccaagaaacuuaugaaaauuacagcugaauggcuguggaaagagcugggcaaaaagaaaaucccccgcauguguaccagagaggaauuuacacggaagguccgcuccaacgccgcgcucggggccauuuucaccgacgagaauaaguggaaaagcgcuagagaagccguggaggauggacgguuuugggaacugguugacagagagcggaaccuucaccuggagggcaagugcgaaacauguguguacaauaugaugggcaaacgcgagaagaaacucggggaguucggaaaggcuaagggcucuagagccaucugguauauguggcugggggcccgguuucuggaguucgaagcgcucggauuucugaacgaggaucauugguucucccgcggcaauagccuuuccggggucgagggcgaaggacugcacagacucggcuacauccugcgggacgugagcaaaaaggaagggggagcuauguacgccgaugacaccgccggcugggauacgcgcauuacccuugaagaccugaaaaacgaggaaaugaucacaaaucauaugaagggggagcacaaaaagcucgcugaggccauuuuuaagcugaccuaucagaacaaaguugugagaguccagcggccuacaccccgcggaaccgugauggacaucauuucuagacgggaucaacgcggcagcgggcagguuggcacguacggacugaauacauucaccaacauggaagcucagcucaucagacaaauggagggcgaagggaucuucaaguccauucagcaucugacagugaccgaggagaucgccguccagaauuggcuugcgcgggugggacgcgaaagacugacgcggauggccauuucuggcgacgauugcgucgugaaaccgaucgacgauagauuugcuaacgcccucaccgcucugaacgacauggggaagguucgcaaagauauucagcaaugggagccuagccggggauggaaugacuggacacaggugcccuucugcucccaccacuuucaugaacuugucaugaaggauggcagagugcuggugguucccugucgcaaccaggacgagcucaucgggcgggccagaaucucucagggcgcgggauggagccugaaggaaaccgccugccugggcaaauccuaugcucaaauguggacacucauguacuuccaccgccgggaucugagacuugccgcuaaugccauuuguucugcugugccuagccauugggucccgaccucccgcacaaccuggagcauccacgccaagcacgaguggaugacgacagaggacaugcuggcgguguggaaccggguuuggauucaggaaaaucccuggauggaggauaaaaccccuguggaaucuugggaggaaguccccuaucucgggaagagagaggaccaguggugcggaucccugaucggccuuaccagccgcgccacaugggcuaaaaacauucagaccgccaucaaucaagugcggucucugauugggaacgagggauacacagacuauaugccuuccaugaagagauuucggagagaagaggaagaggccggcguccucugguga

SEQ ID NO: 19639 - RNA, 9876 nt, Artificial Sequence
  derived and/or modified CDS sequence (opt5) from DENV-2__FJ850085__SS-prME
accgugggaguuaucguuaugcugauucccacagccauggcuuuccaccucacgacccggaacggggagccucauaugaucgugggacggcaggaaaagggcaagagccugcuuuuuaagacagagaauggggugaacaugugcacccugauggccauugaccucggagaacugugugaggauacaaucaccuacaagugcccgcuucugcgccaaaaugaacccgaggacauugauuguuggugcaacuccacaucuaccugggugacguauggcaccuguacaaccacaggggagcaccggcgggaaaagcgcagcguggcgcucguuccucaugugggaaugggccuggagaccagaacggaaacauggauguccucugagggcgcuuggaagcacguccagcggaucgagaccuggauccugcgccaucccggguucacaauuauggccgccauccucgcuuacaccauuggaaccacacacuuucagagagcccugaucuucauucuucugacggcuguggccccuagcaugaccaugcggugcaucggcauuuccaaucgcgacuuuguugaaggggugucuggaggcagcugggucgauaucgugcucgagcacggguccugugugacaaccauggcgaagaacaagcccacacuggacuucgaacuuaucaagaccgaggccaagcagccugcuacgcugagaaaauauugcgucgaagccaagcucacaaauaccaccacagagagccgguguccgacccaaggagagcccucucugaacgaggaacaggauaaacgcuuuauuugcaagcauuccaugguugacagaggcuggggcaauggguguggacuguucggcaaagggggaaucgugacaugcgcuauguuuacgugcaaaaagaacauggaaggcaaagugguccagccugagaaucucgaauacaccauugugaucacaccccacagcggggaggagcaugccguuggaaacgauaccggcaagcacggcaaagaaauuaagaucacaccucagucuuccaucaccgaggcggaacugacgggguauggaaccgugacaauggaguguagcccccggaccggccuugacuucaaugaaaugguccugcuccaaauggaggauaaagccuggcuggugcaccgccagugguuucuugaccugccgcucccuuggcugcccggggcugauacacagggaucuaacuggauucagaaggagacccugguuacguucaagaauccucaugccaaaaagcaagacguggucgugcucggcucccaggaaggggcuaugcacacagcccugaccggcgccacagagauccagaugagcuccggaaaccuucuguuuaccggccaucucaaaugcagacugcggauggacaaacuucaacugaaagggaugucuuacagcauguguaccggaaaguucaagauugucaaagaaaucgcugagacacagcacggcacgauugugaucagaguucaguaugagggggauggaucccccugcaagauccccuucgaaauuauggaccucgagaaacgccaugugcugggccggcugaucaccgucaacccuauuguggcggaaaaggauagcccgguuaauaucgaggccgaacccccuuuuggggacucuuacauuaucauuggcguggagcccggacagcucaaacugaacugguucaagaagggcuccagcaucgggcaaauguuugagacaaccaugagaggagcuaaacgcauggccauccuuggcgauacagccugggacuucgggucucugggaggcgucuuuaccagcauugggaaggcucuccaccagguguucggcgccaucuacggagcggcuuuuuccggcgugucuuggacgaugaaaauucugaucgggguuauuaucacauggaucggaaugaauagccgguccaccagccugucugucucccuugugcucgugggcgucgugacccuguaucugggggccaugguucaggccgauagcggauguguggucucuuggaagaacaaagaacucaagugcggcuccgggauuuucaucacagacaaugugcacaccuggacagagcaguacaaguuucaaccugaaagccccuccaaacuggcuucugccauucagaaggcucaugaggaaggcaucuguggaauuagaagcguuacgcgccuugagaaccugauguggaaacagaucaccccggagcucaaucacauccuguccgaaaacgaggugaagcugacaauuaugaccggcgauaucaaagggauuaugcaggccggaaagcggucucuuagaccucaacccacagaacucaaauauagcuggaagaccuggggcaaggcgaaaaugcuguccacggagagccauaaucagaccuuccugaucgacgggccugaaacagccgagugccccaacaccaaucgcgcuuggaacucucucgaggucgaagauuacggauuuggcguguucacaaccaauauuuggcugaaacuucgggagaaacaggacgucuuuugugacuccaagcugaugagcgccgcugugaaagauaacagagccguccacgcggacaugggcuauuggaucgaaucugcccucaaugauacauggaagauggagaaggcuuccuucaucgaggugaaaagcugccacuggccuaagucucauacccuguggagcaacggggugcuggaauccgagaugauuauccccaaaaacuucgccggaccggucagccagcacaauuaccgcccuggcuaucauacgcaaacagcugggcccuggcaccuuggaaagcucgaaauggacuuugauuucugugagggcaccaccguuguggugacagaagacugcgggaaccggggacccucucugagaaccacgacagccuccggcaaacugauuaccgaguggugcugucggagcugcacacucccuccgcugcgcuacagaggcgaggauggguguugguacggaauggaaauccggccccuuaaggagaaggaagagaaucuggucaacucccucgugaccgccggccaugggcagauugacaauuuuucucugggaguucugggcauggcucuuuuccucgaagagaugcugagaacacgcguggggaccaaacacgcgauccugcucgucgccgugagcuuuguuacgcugauuaccggaaacauguccuuccgggaucuuggcagagugauggucauggugggcgcuacaaugaccgacgauaucgggaugggaguuacauaucuggcccuccuggccgcuuuuaaggugcgcccuaccuucgccgcgggccugcuucugagaaaacucacgucuaaggagcugaugauggcuacaaucggggucgcccuccugagccaguccaccauucccgaaacaauccuugagcugaccgacgcccucgcucugggaaugauggcccugaaaauugugaagaauauggaaaaguaccaacuugcggugaccaucauggcuauuucuugcgucccuaacgccguuauccugcagaaugccuggaaagugagcuguacaauccucgcugccguguccgucagcccccugcuccugacgucuucccagcagaaggcugauuggauuccucuugcccugaccaucaaaggccucaaccccacagcgauuuuucugaccacacugagccggaccucuaagaaacgcuccuggccgcuuaaugaggccaucauggcuguggggaugguuagcauucuggccucuucccuccugaagaacgacaucccuaugacgggaccccucguggcuggcggccugcuuacagucugcuaugugcugaccgggagaagcgccgaccuggaacucgagcgggccgcugauguuaaaugggaggaccaagcggaaaucuccggaagcucuccuauucugagcaucaccauuuccgaggauggcucuaugagcaucaagaaugaagaggaggaacagacacuuaccauucugauccgcacagggcuccuggugauuuccggagucuuccccgugucuaucccgaucacggccgcugccugguaccucugggaggucaagaaacagagagccggcgugcugugggacguuccuucucccccucccguggggaaggcugaacuugaggaaggagccuaucggauuaaacagcgcggcauccugggcuacucccaaauuggggcgggagucuauaaggagggcaccuuucacacaauguggcaugugaccagaggggcuguucugaugcaccggggaaaacgcaucgagcccuccugggccgaugugaagaaggaccucgucagcuacggcgggggauggaaacuggaaggcgaguggaaggaaggcgaggaaguccaggugcuugcccuggagccugggaaaaacccgagagcuguucagacaaagcccggaauuuucaaaaccaauacgggcaccaucggggccgucucccucgauuuuagcccuggaacaucuggcucccccaucguggaccggaaggggaagguggucggacuguacggcaacggcgugguuaccagaagcggggcguaugugucugcuauugcccagacagauaaauccaucgaggacaacccugaaauugaggaugacaucuuccgcaagaaacggcucaccauuauggaucugcaucccggagccggcaagacaaaaagauaccuuccugcuaucguccgcgaagccaucaagcgggggcugagaacgcugauucucgcuccgacccgcgugguugccgcggagauggaagaggcccugcggggacuucccaucagauaucaaaccccugcuauucgcgccgagcacaccggccgggaaaucguggaccugaugugucaugcuaccuucacaaugagacuccugagccccguccgggugccuaauuacaaccucauuaucauggacgaggcccacuuuacggaucccgccuccauugcugcgcgcggguauaucucuaccagaguugaaaugggcgaggccgcuggaaucuucaugacagccaccccgccuggcagccgggaccccuuuccccaguccaaugccccuauuauggaugaggaacgcgagauccccgaaagaagcuggaacucugggcacgagugggugacagacuucaagggaaaaaccgucugguuugugccuuccauuaaggcuggcaaugauaucgccgcgugccugcggaaaaacgggaagaaagugauucagcuuagcagaaagacguucgacucugaauacgucaagacacgcgcuaaugauugggacuuuguugugaccaccgauaucagcgagaugggagccaacuucaaagccgagcgggugaucgacccgagacgcuguaugaagcccgucauucugacagauggcgaagaacgggugauccuggcugggccuaugcccguuacccauuccucugccgcgcaaagacgcggccggauuggaagaaauccuaaaaacgaaaaugaccaguauaucuacaugggcgagccccucgaaaacgacgaggauugcgcccacuggaaggaggcuaaaaugcugcuugacaauauuaacacaccggaagggaucaucccuagcauguuugagcccgaacgcgagaagguggaugccauugacggagaauacagacugcggggcgaggcucgcaaaaccuucgucgaucucaugagaagaggggaccugccuguguggcuggccuauaagguugcugccgagggaaucaauuacgcggaucgcagaugguguuuugacggcauuaagaacaaccagauccucgaagagaauguggaagucgagauuuggacgaaagagggggaacggaagaaacuuaagcccagauggcuggaugcccgcaucuauuccgacccucuggcucucaaagaguucaaggaguucgccgcuggccggaagucucugacacuuaaccugauuaccgagaugggaagacuccccacauuuaugacccagaaagcccgcaaugcccuggauaaccuggcugugcuccauacggcggaagccggcgggaaggcuuacaaucacgcccuuagcgagcugccggagacccuggaaacacuccugcuucugacccuccuggccacagucaccggaggcaucuuccuguuucucauguccgggaaaggaaucggcaagaugacacuuggcaugugcugcauuaucaccgcuagcauucugcugugguaugcccaaauccagccucacuggauugcggccucuaucauccucgaguucuuucugauugugcuucugauccccgaacccgagaaacagcggacgccucaggacaaccaacucacauacguugugauugcuauccugaccguggucgccgcuaccauggccaaugaaaugggguuccuggagaagacaaagaaagaucucggacuuggcuccauuaccacacaggagagcgaauccaacauccuggacaucgaccugagaccggcgucugccuggacgcucuaugcuguugccaccacauuugugacccccaugcugcggcauagcauugaaaauagcucugugaacgucagccuuacagcuaucgccaaucaggcuaccgugcugauggggcucggaaagggcuggccucuguccaaaauggauauugggguuccccugcucgccaucggauguuacagccaggugaacccuauuacgcuuaccgcggcccugcugcuccuggucgcucacuacgccaucauuggccccggccuucaagcuaaggccacacgcgaagcccagaaaagagcggcugccgggaucaugaagaauccuaccguggacggaaucacagucauugaucuggagccgauccccuaugacccuaaguucgaaaaacagcucggccaggugaugcugcugauucucugcguuacccaagugcuuaugaugcggacgacaugggcucugugugaggcccugacccucgccacagggcccaucucuacccugugggagggaaacccuggccgcuuuuggaauaccacaauugcugucuccauggccaacaucuucagagggagcuaccuugcgggagccggccugcucuuuucuaucaugaagaauacgaccaacacacggcgcggcaccgggaacauuggagaaacacugggcgagaaauggaaguccagacugaaugcucucgggaaaagcgaguuccagaucuauaagaaaucuggcauucaggagguggaucggacccuugccaaggagggcaucaagcgcggggaaacggaccaucacgcuguuagcagaggauccgccaaacugcggugguuuguggagagaaacauggucacacccgaaggcaaggugguggaucugggcugcgggcgcggaggcuggucuuacuauugugggggacucaaaaauguucgggaggucaagggccugaccaaagggggaccgggccaugaggaaccuauucccaugagcaccuacggcuggaaccuugugagacugcaauccgggguggacgucuucuucacacccccugagaagugcgauacccuccugugugacaucggagaaagcucccccaauccuacaaucgaggcgggccgcacgcugcggguucucaaccuuguggaaaauuggcugaacaauaacacccaguuuugcauuaaggugcugaauccguauaugcccucugucaucgagaaaauggaaacacuccagagaaaguacgggggagcccuggugcgcaacccucuuagcagaaauuccacccacgagauguacuggguuucuaacgcuacaggcaauauugugagcuccgucaacaugaucucuagaaugcugauuaaccgcuucaccaugaaacacaagaaagccacguaugagcccgauguggaccucgggagcggaacccggaauaucggcaucgaauccgagguuccuaaccuggauauuaucggcaagagaauugaaaagaucaaacaggagcaugaaacaagcuggcacuacgaccaagaccaucccuauaagaccugggcuuaccacgggucuuaugagacaaaacagaccggauccgccagcucuauggugaauggcgucgugcgccugcucacaaagccgugggauguggucccuaugguuacccagauggcuaugacggacacaacccccuuugggcagcaacggguguucaaagagaagguggauaccagaacacaggaaccuaaggagggaacgaagaaacuuaugaaaauuaccgccgaauggcuguggaaagagcugggcaaaaagaaaaucccccgcauguguacaagagaggaauuuacccggaagguccgcuccaacgcggcccucggggcuauuuucacagacgagaauaaguggaaaagcgccagagaagcuguggaggauggacgguuuugggaacugguugacagagagcggaaccuucaccuggagggcaagugcgaaaccuguguguacaauaugaugggcaaacgcgagaagaaacucggggaguucggaaaggccaagggcucuagagccaucugguauauguggcugggggcgcgguuucuggaguucgaagcucucggauuucugaacgaggaucauugguucucccgcggcaauagccuuuccggggucgagggcgaaggacugcacagacucggcuacauccugcgggacgugagcaaaaaggaagggggagccauguacgccgaugacacagcuggcugggauacccgcauuacgcuugaagaccugaaaaacgaggaaaugaucaccaaucauaugaagggggagcacaaaaagcucgccgaggcuauuuuuaagcugacauaucagaacaaaguugugagaguccagcggccuacaccccgcggaacagugauggacaucauuucuagacgggaucaacgcggcagcgggcagguuggcaccuacggacugaauacguucacaaacauggaagcccagcucaucagacaaauggagggcgaagggaucuucaaguccauucagcaucugaccgugacagaggagaucgcgguccagaauuggcuugcccgggugggacgcgaaagacugacccggauggcuauuucuggcgacgauugcgucgugaaaccgaucgacgauagauuugccaacgcucucacggcccugaacgacauggggaagguucgcaaagauauucagcaaugggagccuagccggggauggaaugacuggacccaggugcccuucugcucccaccacuuucaugaacuugucaugaaggauggcagagugcuggugguucccugucgcaaccaggacgagcucaucgggcgggcgagaaucucucagggcgccggauggagccugaaggaaacagcuugccugggcaaauccuaugcccaaauguggacccucauguacuuccaccgccgggaucugagacuugcugccaaugcuauuuguucugccgugccuagccauugggucccgacaucccgcaccacauggagcauccacgcgaagcacgaguggaugaccacggaggacaugcuggccguguggaaccggguuuggauucaggaaaaucccuggauggaggauaaaacaccuguggaaucuugggaggaaguccccuaucucgggaagagagaggaccaguggugcggaucccugaucggccuuaccagccgcgcuaccugggccaaaaacauucagacagccaucaaucaagugcggucucugauugggaacgagggauacaccgacuauaugccuuccaugaagagauuucggagagaagaggaagaggcuggcguccucugguga

SEQ ID NO: 19640 - RNA, 9876 nt, Artificial Sequence
  derived and/or modified CDS sequence (opt5) from DENV-2__FJ850088__SS-prME
accgccggagugaucgucaugcugauucccacaguuauggcuuuccaccucacgaccagaaauggggagccucauaugaucgugggacggcaggaaaagggcaagagccugcuuuuuaagacagaggacggggugaauaugugcacccugauggccauugaucucggagaacugugugaggacacaaucaccuacaagugcccccuucugcgccaaaacgaacccgaggauauugacuguuggugcaauuccacaucuaccugggucacguauggcaccuguacaaccacaggggagcacagacgggaaaagcgcagcguggcgcucguuccucaugugggaaugggccuggagaccagaacggaaacauggauguccucugagggcgcuuggaaacacguccagcggaucgagaccuggauccugcgccaucccggguucacaaugauggccgccauucucgcuuacaccaucggaaccacacacuuucagagagcccugauuuucauccuucugacggcuguggccccuagcaugaccaugcggugcauuggcaucuccaaccgcgauuuuguugaaggggugucuggaggcagcugggucgacauugugcucgagcacggguccugugugacaaccauggcgaagaauaagcccacacuggauuucgaacuuaucaaaaccgaggccaagcagccugcuacgcugagaaaauauugcgucgaagccaagcucacaaacaccaccacagagagccgguguccgacccaaggagagcccucucugaaugaggaacaggacaaacgcuuuaucugcaagcauuccaugguugauagaggcuggggcaacggguguggacuguucggcaaagggggaauugugacaugcgcuauguuuacgugcaaaaagaauauggaaggcaaagugguccagccugagaaccucgaauacaccaucgugauuacaccccacagcggggaggagcaugccguuggaaaugacaccggcaagcacggcaaagaagugaagaucacaccucagucuuccauuaccgaggcggaacugacgggguauggaaccgucacaauggaguguagcccccggaccggccuugauuucaacgaaauggugcugcuccaaauggaggacaaagccuggcugguucaccgccagugguuucuugaucugccgcucccuuggcugcccggggcugacacacagggaucuaauuggauccagaaggagacccuggugacguucaagaacccucaugccaaaaagcaagacgucgugguccucggcucccaggaaggggcuaugcacacagcccugaccggcgccacagagauccagaugagcuccggaaaucuucuguuuaccggccaucucaaaugcagacugcggauggauaaacuucaacugaaagggaugucuuacagcauguguaccggaaaguucaagauugugaaagaaaucgcugagacacagcacggcacgauuguuaucagagugcaguaugagggggacggaucccccugcaagauucccuucgaaaucauggaucucgagaaacgccauguccugggccggcugaucaccgugaacccuauuguuacagaaaaggacagcccggugaacaucgaggcggaacccccuuuuggggauucuuacauuaucgucggcguggagcccggacagcucaaacugaauugguucaagaagggcuccagcauugggcaaauguuugagaccacaaugagaggagccaaacgcauggcuauccuuggcgacaccgccugggauuucgggucucugggaggcguguuuacgagcauugggaaggcccuccaccagguuuucggcgcuaucuacggagccgcguuuaacggcgucuccuggacaaugaaaauccugauuggggugaucauuaccuggaucggaaugaacucucggagcaccucccugagcgugucucuuguccucgugggcguugugacacuguaucugggggcuaugguccaggccgacuccggaugugugguuagcuggaagaacaaagaacucaagugcggcucugggauuuucaucaccgauaaugugcacacauggacggagcaguacaaguuucaaccugaaucccccagcaaacuggccuccgcuauccagaaggcccaugaggaaggcauuuguggaaucagaucugucacccgccuugagaaccugauguggaaacagauuacaccggagcucaaucacauccugagcgaaaacgaggugaagcugaccauuaugacaggcgacaucaaagggaucaugcaggcuggaaagcggucccuuagaccucaacccaccgaacucaaauauucuuggaagacguggggcaaggccaaaaugcugccuaccgagagccauaaucagacauuccugauugaugggcccgaaaccgcggagugcccuaacgccaaucgcgcuuggaacucccucgagguugaagacuacggauuuggcguguucacaaccaauaucuggcugaaacuucgggagaaacaggacgucuuuugugauagcaagcugaugucugccgcuauuaaagacaacagagccgugcacgcggauaugggcuauuggaucgaauccgcccucaaugacacauggaagauggagaaggcuagcuucauugaggugaaaucuugccacuggcccaagucccauacccuguggagcaacgggguccuggaaucugagaugaucaucccgaaaaacuucgccggaccuguuagccagcacaauuaccgccccggcuaucauacgcaaacagcugggcccuggcaccuuggaaagcucgaaauggauuuugacuucugugagggcaccaccgugguggucacagaagauugcgggaaccggggaccuucccugagaaccacgacagccagcggcaaacugauuaccgaguggugcugucggucuugcacacucccgccccugcgcuacagaggcgaggacggguguugguacggaauggaaauccggccucuuaaggagaaggaagagaaucuggugaacucccucguuaccgccggccaugggcagauugauaauuuuagccugggagugcugggcauggcucuuuuccucgaagagaugcugagaacacgcgucgggaccaaacacgcgauccugcucguggccguuucccuggugacgcuuauuaccggaaacaugucuuuucgggaccugggcagagucauggugaugguuggcgcuacaaugaccgaugacaucgggaugggagugacauaucucgcccugcuggccgcuuucaagguccgccccaccuuugccgcgggccuucugcucagaaaacugacgagcaaggagcucaugauggcuacaauugggguggcccugcuuucccagucuaccaucccugaaacaauccuggagcucaccgaugcccuggcucugggaaugauggcccuuaaaguggucaagaauauggaaaaguaccaacuggcgguuaccauuauggcuaucagcugcgugcccaacgccgugauucuccagaaugccuggaaagucuccuguacaauccuggcugccgugucuguuagcccucuccugcuuacguccagccagcagaaggcugacuggauuccccuggcccucaccaucaaaggccugaacccgacagcgaucuuccugaccacacuuucucggaccuccaagaaacgcagcuggccucugaaugaggccgugauggcugucgggauggugucuauucucgccuccagccugcucaagaacgacauccccaugacgggaccucugguugcuggcggccuucugacagugugcuauguccugaccgggagaucugccgaucucgaacuggagcgggccgcugacgugaaaugggaggaucaagcggaaauuuccggaagcucccccauccuuagcauuaccaucucugaggacggcagcauguccaucaagaaugaagaggaggaacagacacugaccauucucauccgcacagggcugcucgucauuucuggaguguuuccgguuagcaucccuauuacggccgcugccugguaccugugggaggugaagaaacagagagccggcguccuuugggaugugcccuccccuccgcccguugaaaaggcugagcuggaagacggggccuaucggaucaaacagcgcggcauucugggauacucucaaaucggcgcggggguguauaaggagggaaccuuccacacaauguggcaugucaccagaggcgcugugcucaugcaccgggggaaacgcaucgagccuagcugggccgaugugaagaaggaccugguuuccuacggaggcggguggaaacuugaaggagaguggaaggaaggcgaggaaguccaggugcuggcccucgagccgggcaaaaaccccagagcugugcagacaaagccugggauuuuuaaaaccaauacgggaaccaucggcgccgucucucuggauuucagccccgggacauccggaagcccuauuguggaccggaagggcaagguuguggggcucuacggaaacggcgucgugaccagaucuggcgcguauguuuccgcuaucgcccagacagagaaaagcauugaagauaaccccgagaucgaagacgauaucuuucgcaagaaacggcugaccauuauggaccuucauccuggggccggaaagacaaaaagauaccugccggcuaucgugcgcgaggccauuaagcggggccugagaacgcucauccuggcucccacccgcgucguggccgcggaaauggaggaggcccuucgggggcugccuauuagauaucaaacacccgcuauccgcgccgaacacaccggacgggagaucguugaccucaugugucaugcuaccuucacaaugagacugcucucuccugugcggguccccaauuacaaccugauuaucauggaugaagcccacuucacggacccggccuccauugcugcgcgcggcuauaucagcaccagaguggagaugggggaggccgcuggcauuuuuaugacagccaccccucccggaucccgggaucccuucccucagucuaaugcccccaucauggacgaggaacgcgaaauuccugagagaagcuggaacuccggccacgaaugggugacagauuuuaaggggaaaaccgucugguucguuccgagcaucaaggcuggaaaugacaucgccgcgugccuucggaaaaacggcaagaaagugauucagcugucuagaaagacguuugauuccgaguacgugaagacacgcagcaaugacugggauuucgucgugaccaccgacaucucugagaugggggcuaacuuuaaagccgaacggguuauugaucccagacgcuguaugaagccugugauccugacagacggagaggaacgggucauucucgccggccccaugccugugacccauagcuccgcugcccaaagacgcgggcggaucggcagaaaucccaaaaacgagaaugaccaguauaucuacaugggagaaccgcuggagaacgaugaggacugcgcgcacuggaaggaagccaaaaugcuucuggauaauauuaacacaccugagggcaucauucccucuauguucgaaccugagcgcgaaaagguugacgcuaucgauggggaguacagacuccggggagaggcccgcaaaaccuuuguggaccugaugagacggggcgaucugcccgucuggcucgcuuauaagguggccgcugaagggauuaauuacgccgaccgcagaugguguuucgauggaaucaagaacaaccagauccuugaggaaaaugucgagguggagauuuggacgaaagaaggcgagcggaagaaacugaagccuagauggcuggacgcgcgcaucuauagcgauccccucgcccugaaagaauuuaaggaguucgcugccgggcggaagucccuuacacugaaccucauuaccgaaaugggcagacugccgacauucaugacccagaaagcucgcaaugcccuggacaaccucgccguucuucauacggcugaggcgggaggcaaggccuacaaucacgcucugucugagcugccugaaacccucgagacacugcuucugcucgcccugcuggccaccgugacagggggaaucuuucucuuccuuaugagcggcaaagggauuggaaagaugacccugggcaugugcugcaucauuacagcuuccauccugcucugguaugcccaaauccagccccacuggauugcggccagcaucauucuggaauuuuuccuuaucgugcugcucauucccgagccugaaaaacagcggaccccgcaggauaaccaacugacguacgucguuaucgcuauccugacagugguggccgcuaccauggccaaugagaugggcuuucucgagaagaccaagaaagaccuugggcugggaucuauuacaacccaggaauccgagagcaacauccuggacauugaucucagacccgcguccgccuggacacuguaugcugucgccacgaccuucgugacaccuaugcuucggcauucuaucgaaaauagcuccguuaacgugucucugaccgcuauugccaaucaggcuacaguccucaugggccuggggaagggauggccccugagcaaaauggacaucggcgugccucuccuugccaucggguguuacucccaggucaaccccauuacccugacggcggcccugcuccugcuuguggcucacuacgccaucauuggaccuggccugcaagcuaaggccacccgcgaggcccagaaaagagcggcugccggcaucaugaagaauccgacaguugaugggauuaccgugaucgaccucgaacccauuccuuaugaucccaaguuugagaaacagcugggacaggucaugcugcucauccuuugcgugacacaaguucugaugaugcggaccacgugggcucugugugaggcccucacacuggccaccggcccuaucagcacacuuugggaagggaaccccggacgcuucuggaauaccaccauugcugugucuauggccaacaucuuuagaggcuccuaccuggcgggggccggacuccuguucagcgucaugaagaauacaacgaacacccggcgcggcacaggcaacauuggggagacccugggagaaaaauggaagucuagacucaaugcucuuggcaaauccgaguuucagaucuauaagaaaagcgggauucaggagguggaccggacacuggccaaggaaggaaucaagcgcggcgagaccgaucaucacgcugugucuagagggagcgccaaacugcggugguucguugaaagaaacauggucacgccggagggaaaggugguggaccucggcugcggccgcgggggaugguccuacuauuguggcgggcugaaaaauguccgggaaguuaagggacuuacaagaggcgggccuggacaugaggagcccauccccaugucuaccuacggcuggaaccuggugcgccuccaaagcggcguggaugucuuuuucaccccucccgaaaaaugcgacacacugcugugugauauuggggaguccagcccuaauccgaccaucgaagcgggacggacacucagagugcuuaaccugguugagaauuggcugaacaauaacacgcaguucugcauuaaggugcucaaucccuauaugccuuccgucaucgaaaagauggagacccugcagcgcacauacggcggggcccuugugcggaacccccugucuagaaauagcacccacgagauguacuggguuuccaacgcuacaggaaauauugugucuagcgucaacaugaucucccgcaugcucaucaaccgguuuaccaugaaacacaagaaagccacguaugaaccugacguggaucugggcucugggaccagaaauauuggaaucgagagcgaaauucccaaccuggacaucauuggcaagcgcaucgagaaaaucaagcaggaacaugagacauccuggcacuacgaccaagaucauccguauaagaccugggcuuaccacggcagcuaugagacaaaacagaccgggucugccuccagcauggugaauggagucguucggcuccuuacaaagccuugggacguggugcccauggucacccagauggcuaugacggauacaaccccuuucggccagcaaagaguguuuaaagaaaagguugacacccgcacacaggagcccaaagaagggacgaagaagcugaugaaaauuaccgccgaguggcuguggaaggagcucggcaagaagaaaacaccuagaauguguacccgggaagaguucacacgcaaggugagaucuaacgcggcccugggcgcuaucuuuaccgaugaaaauaaauggaaguccgcccgggaggcugucgaagacgggagauucugggagcuuguggaucgggagcgcaaccugcaccucgaaggaaagugcgagacauguguuuacaauaugaugggcaaaagagaaaagaaacugggcgaguuugggaaggccaaaggaagccgggccauuugguauauguggcugggcgcgcgcuuccucgaauuugaggcucugggguuccuuaacgaggaccauugguuuucuagaggaaauucccugagcggcguggaaggggagggccuccaccggcugggauacauccuucgcgaugucuccagaaaggaaggcggggccauguacgccgacgauaccgcuggaugggacacgcggauuacccuggaggaccucaagaacgaagagauggugacaaaucauaugaaaggcgagcacaagaaacuggccgaagcuaucuucaagcugaccuaucagaacaaaguugugcgcguccagagacccacaccgcgggggaccgugauggauauuaucagccgcagagaccaacggggaucuggccaggucgggacguacggccucaauacauuuaccaacauggaggcccagcugauccgccaaauggaaggagagggcauuuucaagagcauccagcaucuuacagugaccgaggaaauugcgguucagaauuggcuggccagaguggggcgggagagacucacgcgcauggcuaucuccggagaugacugcgucgugaagccuauugaugaccgguucgccaacgcucugaccgcccuuaacgauaugggcaaagugagaaaggacauccagcaaugggaacccucucgcggguggaaugauuggacacagguucccuuuugcagccaccacuuccaugagcuggugaugaaagacggacggguccucgugguuccuuguagaaaccaggaugaacugaucggccgcgcgcggauuucccagggggccggcuggucucugaaggagaccgcuugccucggaaaaagcuaugcccaaauguggacacugauguacuuucacagacgcgaccuucggcuggcugccaaugcuaucuguuccgccgugccgucucauuggguccccaccagcagaacaaccugguccauucacgcgaagcacgaguggaugacgacagaagauaugcucgccguguggaaccgcgucuggauccaggagaauccuuggauggaagacaagacccccguggagagcugggaagagguuccuuaucugggcaaacgggaggaccaguggugcgggucucuuauuggacugaccuccagagcuacaugggccaagaacauccagaccgccaucaaucaagugcggagccucauuggcaacgaagaguacacagauuauaugcccucuaugaaaagauuccgccgggaagaggaagaggcugggguccugugguga

SEQ ID NO: 19641 - RNA, 9876 nt, Artificial Sequence
  derived and/or modified CDS sequence (opt5) from DENV-2__FJ850091__SS-prME
accgccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauggaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggauugagaccuggauccugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacauuguccucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaagagcaggacaaacgcuuuauuugcaagcauuccaugguggauagaggcuggggcaacggguguggacuguucggcaaggggggaaucgucacaugcgccauguuuacgugcaaaaagaauauggaaggcaaaauuguucagccugagaaccucgaauacaccaucgugauuacaccccacagcggggaggagcaugcggugggaaaugacaccggcaagcacggcaaagaaaucaagaucacaccucagucuuccaccacggaggccgaacugaccggguauggaacagucaccauggaguguagcccccggacaggccuugauuucaacgaaauggugcugcuccaaauggaggacaaagcuuggcugguucaccgccagugguuucuugaucugccgcucccuuggcugcccggggccgacacccagggaucuaauuggauucagaaggagacgcuggugacauucaagaacccucaugcuaaaaagcaagacgucgugguucucggcucccaggaaggggccaugcacaccgcccugacaggcgcuaccgagauccagaugagcuccggaaaucuucuguuuaccggccaucucaaaugcagacugcggauggauaagcuucaacugaaagggaugucuuacagcauguguacaggaaaguucaagauugugaaagaaaucgcggagacgcagcacggcaccauugucaucagagugcaguaugagggggacggaucccccugcaagauccccuucgaaauuacagaucucgagaaacgccauguccugggccggcugaucaccgugaacccuauuguuacagaaaaggacagcccggugaacaucgaggccgaacccccuuuuggggauucuuacauuaucgucggcguggagcccggacagcucaaacugaauugguucaagaagggcuccagcauugggcaaauguuugagaccacgaugagaggagcuaaacgcauggccauccuuggcgacacagccugggauuucgggucucugggaggcguuuuuaccagcaucgggaaggcucuccaccagguguucggcgccauuuacggagcggcuuuuuccggcgucucuuggaccaugaaaauccugauuggggugaucauuacauggaucggaaugaacagccgguccaccagccugucugugucccuuguucucgucggcguggugacacuguaucugggggccaugguccaggccgacagcggauguaucgugucuuggaagaauaaagaacucaagugcggcuccgggauuuucaucacggauaacguucacaccuggacagagcaguacaaguuucaaccugaaagccccuccaaacuggcuucugccauucagaaggcucaugaggaaggcaucuguggaauuagaagcgugacccgccuugagaaucugauguggaaacagaucacaccggagcucaaccacauccuguccgaaaaugaggucaagcugaccauuaugacgggcgacaucaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaauucucucgagguggaagacuacggauuuggcguuuucaccacgaacauuuggcugaagcuucgggagaaacaggacguguuuugugauuccaagcugaugagcgccgcuaucaaagacaauagagccguccacgcggauaugggcuauuggaucgaaucugcccucaacgacacauggaagauggagaaggcuuccuucauugaggugaaaagcugccacuggccuaagucucauacccuguggagcaaugggguucuggaauccgagaugaucauucccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugaucacagaguggugcugucggagcugcacccucccuccgcugcgcuacagaggcgaggacggguguugguacggaauggaaauucggccccuuaaggagaaggaagagaaccuggucaauucccucguuacggccggccaugggcagaucgauaacuuuucucugggagugcugggcauggcucuuuuccucgaagagaugcugagaacccgcguggggacaaaacacgcgauucugcucgucgcccugagcuuugugacccuuaucacaggaaauauguccuuccgggaccugggcagaguuauggugauggucggcgcuaccaugacggaugacaucgggaugggagugacauaucucgcccugcuggccgcuuuuaagguucgcccuaccuucgccgcgggccuucugcucagaaaacugacaucuaaggagcucaugauggcuaccauugggaucgcccugcuuagccaguccacccugcccgaaacaauucucgagcugacggaugcccuggcucuuggaaugauggcccugaaaaucgugcggaacauggaaaaguaccaacucgcggucaccauuauggcuaucucuugcgugccuaaugccguuauccugcagaacgccuggaaggugagcuguacaauucucgcugccgucuccgugagcccccugcuucugaccucuucccagcagaaagcugacuggaucccucucgcccugacaauuaagggccugaaucccaccgcgaucuuucuuacgacacugagccgcaccucuaaaaagagauccuggccgcucaacgaggccauuauggcuguggggauggucagcauccuggccucuucccuccugaaaaaugacaucccuaugaccggaccccuuguugcuggcggccugcugacagugugcuaugugcucaccgggcgggccgccgaucuggaacuugagcgcgcugcggacgucaagugggaggaucaagccgaaauuagcggauccagcccuauccugucuauuacaaucagcgaggacggcuccaugucuauuaaaaacgaagaggaggaacagacgcucaccauccugauuagaacagggcuccuggugaucagcggaguuuuccccguguccaucccgauuaccgcugccgccugguaccuuugggaggucaagaagcagcgggcuggcgugcugugggauguuccuucucccccucccguggggaaagccgaacuggaggacggagcguaucgcaucaagcagagaggcauucucggcuacagccaaaucggggcuggagucuauaaagaaggcacauuucacaccauguggcaugugacgcggggggccguccugaugcaccgcggaaagagaauugagcccuccugggccgaugugaaaaaggaccuuaucucuuacggcgggggauggaagcuggagggcgaauggaaagagggcgaagagguucaggugcucgcucuggaaccugggaagaauccgcgggccguccagaccaaacccggaaucuucaagacaaacaccggcacaauuggggcggugagccucgauuuuuccccuggaaccagcggcucucccaucguugacagaaaagggaagguggucggacuguacggcaauggcguggugacacgcuccggggcuuauguuagcgccauugcccagacggagaagucuaucgaggauaacccugaaauugaggacgauaucuuccggaaaaagagacuuaccaucauggaccugcaucccggagcuggcaaaacaaagcgcuaccugccugccauuguccgggaagcuaucaaaagagggcuccgcacccugauucuugccccgacccgggugguggcggccgagauggaagaggcucugagaggacuccccauccgcuaucaaacaccugccauucgggcugagcacacgggcagagaaaucgucgaccugaugugucaugccaccuucacaaugcggcuccugucccccgugcgcguuccuaacuacaaucuuauuaucauggaugaggcccacuuuaccgaccccgcuagcaucgcggccagaggguauauuuccacacggguggaaaugggcgaggcugccggaaucuucaugaccgccacgccgccuggcucucgcgaucccuuuccccagagcaacgcuccuauuauggacgaggaaagagagauccccgaacgguccuggaauagcgggcacgagugggucacagauuucaagggaaagaccgugugguuuguuccuucuauuaaagccggcaacgacaucgcggcuugccugagaaagaaugggaaaaaggugauccagcugucccgcaaaaccuucgauagcgaauacgccaagacacgggccaacgacugggauuuugucgugaccacagacauuucugagaugggagcuaauuucaaggccgagagaguuaucgauccgcgccgguguaugaaacccgugauucucaccgacggcgaagagagagucauccuggcggggccuaugcccgugacgcauagcuccgccgcucaacgccggggcagaauuggacgcaacccuaagaaugaaaacgaccaguauaucuacaugggcgagccccuugaaaaugaugaggacugcgcccacuggaaagaggcuaagaugcugcucgauaacaucaauacaccggaagggauuaucccuucuauguuugagcccgaaagagagaaaguggacgccauugauggagaauaccggcugcgcggcgaggcuagaaagaccuucgucgaccugaugcggcgcggggaucucccuguuuggcuugccuauaaaguggcggccgagggaaucaacuacgcugacagaaagugguguuuugauggcauuaagaauaaccagauccuggaagagaacguggaagucgagauuuggacaaaagagggggaacggaagaaacugaagcccagauggcucgacgcccgcaucuauagcgauccucuggcucuuaaagaguucaaggaauucgccgccggccggaagucccugacccucaaucugaucacggagaugggaagacugcccaccuuuaugacacagaaagcucgcaacgcgcucgacaaucuugccgugcugcauaccgcugaaguuggcgggaaggccuacacacacgcccugucugagcucccggagacccuggaaacacuucugcuccugacccugcucgcugccgugacgggaggcauuuuccuuuuucugaugagcgggaaaggaaucggcaagaugacacugggcaugugcugcauuaucaccgcguccauucuccugugguaugcccaaauccagccucacuggaucgcugccagcauuauccuugaguucuuucugauuguccuccugauccccgaacccgagaaacagcggaccccucaggauaaccaacugacauacgugguuauugcuauccucaccguggucgccgcgacaauggccaaugaaaugggguuccuugagaagacgaagaaagaccugggauuuggcucuaucaccacacaggaguccgaaagcaacauucuggacaucgaucucagaccggcuuccgccuggacccuguaugcuguggccacaaccuucgucacgcccaugcuucggcauucuauugagaauagcuccgugaacguuucucugaccgcuaucgccaaucaggcgacagugcucauggggcugggaaagggcuggccucugagcaaaauggacauuggggugccccuccuugccaucggauguuacucccaggucaacccuauuacccugacagcugcccugcuccugcuuguugcucacuacgccaucaucggccccggccugcaagccaaggcgacccgcgaagcucagaaaagagccgcugccgggauuaugaagaauccuacgguggauggaaucacagugauugaccucgagccgauccccuaugauccuaaguuugaaaaacagcugggccaggucaugcugcucauucuuugcgugacccaaguucugaugaugcggacaaccugggcccugugugaggcucucacccuggccacagggcccaucagcacgcuuugggagggaaacccuggccgcuucuggaauaccacaaucgcggugucuauggccaacauuuuuagaggguccuaccuggcuggagccggccuccuguucagcaucaugaagaauaccacaaacacccggcgcggcacggggaaugucggagaaacacugggcgagaaauggaagucuagacucaacgcucuugggaaauccgaauuucagauuuauaagaaaagcggaauccaggagguggaccggacccuggccaaggagggcauuaagcgcggggaaaccgaucaucacgcggucucuagaggaagcgccaaacugcggugguucguggagagaaacaugguuacacccgaaggcaagguggucgaccucggcugcgggcgcggaggcugguccuacuauugugggggacugaaaaaugugcgggagguuaagggccuuaccaaagggggaccgggccaugaagagccuauccccaugucuacauacggcuggaaccuggugagacuccaaagcggggucgauguguucuuuacgcccccugagaagugcgacacccugcugugugauaucggagaauccagccccaauccuacaauugaggcuggccgcacccuccgggugcuuaaccugguugaaaauuggcugaacaauaacacacaguucugcaucaagguccucaauccguauaugcccuccgugauugagaaaauggaaacccugcagagaaaguacgggggagcccuugugcgcaacccucugucucggaauagcacgcacgagauguacugggucuccaacgcuaccggcaauaucguuucuagcgugaacaugauuuccagaaugcucaucaaucgcuuuacaaugaaacacaagaaagccaccuaugagcccgacguggaucuggggucuggaacacggaacaucggcauugaaagcgagaucccuaaccuggacauuaucggcaagagaauugaaaagaucaaacaggagcaugaaaccuccuggcacuacgaccaagaucaucccuauaagacaugggcuuaccacgggagcuaugagaccaaacagacgggaucugccuccagcauggucaauggcgugguucgccuccuuacaaagccgugggacguggucccuauggugacccagauggcgaugaccgauacaacgcccuucgggcagcaacggguuuuuaaagagaagguggacaccagaacacaggaaccuaaggagggaaccaaaaagcugaugaaaauuacagccgaauggcuguggaaggagcucggcaaagagaagaccccccgcauguguacaagagaagaguucacccggaaaguccgcucuaacgcugcccugggggcuguguuuacggaugaaaauaaguggaaguccgccagagaggccguggaagacggacgguucugggagcuugucgauagagagcggaaccugcaccucgaaggcaaaugcgagaccuguguuuacaauaugaugggcaagcgcgaaaaaaagcugggggaguuuggaaaagcgaagggcagcagagcuaucugguauauguggcugggggcccgguuccucgaauuugaggcccugggauuccuuaacgaggaccauugguuuucucgcggcaauucccugagcgggguggaaggcgagggacuccacagacugggcuacauccuucgggaaguggggaagaaagagggaggcgcuauguacgccgaugacacagcugggugggauacccgcauuacacuggaagaccucaagaacgaggagauggucaccaaucauaugaaaggagaacacaagaaacuggccgaggcgaucuucaagcugacguaucagaacaaggugguuagagugcagcggccuacaccccgcggcaccgucauggacauuaucuccagaaaagaucaacgggggagcggccaggugggaacauacggccucaauaccuucacgaacauggaagcccagcugauucgccaaauggagggggagggaaucuuuaagucuauccagcaucuuaccgcuacagaagagauugccguucagaauuggcuggcuagagugggccgggaacgccucagcagaauggccaucuccggggacgauugcgucgugaaaccgauugacgaucgguucgcgucugcccugaccgcucuuaacgacaugggaaagguuagaaaagauauccagcaaugggagccuagccgcggcuggaaugacuggacacaggugcccuuuugcucccaccacuuccaugaacuggucaugaaggaugggcgggugcucgucgugcccuguagaaaccaggacgagcugauuggccgcgcccggaucucucagggagcuggcuggagccugaaggagaccgccugccucgggaaauccuaugcucaaauguggacacugauguacuuucacagacgcgaucuucggcuggccgcgaacgccaucuguucugcuguuccuagccauugggugccgaccuccagaacgacauggagcauucacgccaagcacgaauggaugaccaccgaggacaugcucgccgucuggaaucgcguguggauccaggaaaaccccuggauggaggauaaaacaccuguggaaucuugggaggagguucccuaucugggaaagcgggaagaccaguggugcggcucccuuauugggcugaccagcagagcuacaugggccaaaaauauccagacggcgauuaaccaagugcgcucucucaucggaaaugagggcuacaccgacuauaugccuuccaugaagcgguucagacgggaagaggaagaggcugggguccugugguga

SEQ ID NO: 19642 - RNA, 9876 nt, Artificial Sequence
  derived and/or modified CDS sequence (opt5) from DENV-2__GQ199890__SS-prME
accgccggcgugaucgucaugcugauucccaccgcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccaucggggagcacagacgggaaaagcgcagcgucgcucucgugccucauguuggaaugggccuggagacaagaaccgaaacguggauguccucugagggcgccuggaaacacgugcagcggaucgagacauggauucugcgccaucccggguucaccaucauggccgcuauucucgccuacacaaucggaaccacccacuuucagagagcucugauuuucauccuucugacagccgucgcgccuagcaugacgaugcggugcauuggcaucuccaaccgcgauuuuguggaagggguuucuggaggcagcuggguggacaucguccucgagcacggguccugugugaccacaauggccaagaauaagcccacccuggauuucgaacuuauuaaaacagaggcuaagcagccugccacccugagaaaauauugcaucgaagcuaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaagggggaaucgucacaugcgccauguuuacaugcaaaaagaauauggaaggcaaaauuguucagccugagaaccucgaauacacgaucgugaucacaccccacagcggggaggagcgggcggugggaaaugacacaggcaagcauggcaaagaaauuaagaucaccccucagucuuccacaaccgaggccgaacugacgggguauggaaccgucacaauggaguguagcccccgcaccggccuugauuucaacgaaauggugcugcuccaaauggaggacaaggcuuggcugguucacagacagugguuucuugaucugccgcucccuuggcugcccggggccgacacacagggaucuaauuggauucagaaggagacccuggugacguucaagaacccucacgcuaaaaagcaagacgucgugguucucggcucccaggaaggggccaugcauacagcccugaccggcgcuacagagauccagaugagcuccggaaaucuucuguuuaccggccaccucaaaugccggcugagaauggauaaacuucaacugaaagggaugucuuacagcauguguaccggaaaguucaagauugugaaagaaaucgcggagacacagcauggcacgaucgucauucgcgugcaguaugagggggacggaucccccugcaagauccccuucgaaauuaccgaucucgagaaacggcacguccugggcagacugaucacagugaacccuauuguuaccgaaaaggacagcccggugaacaucgaggccgaacccccuuuuggggauucuuacauuaucgucggcguggagcccggacagcucaaacugaauugguucaagaagggcuccagcaucgggcaaauguuugagacaaccaugcgcggagcuaaacggauggccauucuuggcgacacggccugggauuucgggucucugggaggcguuuuuacaagcaucgggaaggcucuccaucagguguucggcgccauuuacggagcggcuuuuuccggcgucucuuggaccaugaaaauccugauuggggugaucaucaccuggauuggaaugaacagcagauccacaagccugucugugucccuuguucucgucggcguggugacccuguaucugggggccaugguccaggccgacagcggauguaucgugucuuggaagaauaaagaacucaagugcggcuccgggauuuucaucacagauaacguucacacguggaccgagcaguacaaguuucaaccugaaagccccuccaaacuggcuucugccauucagaaggcucacgaggaaggcaucuguggaauccgcagcgugacacggcuugagaaucugauguggaaacagauuaccccggagcucaaccauauccuguccgaaaaugaggucaagcugacaauuaugaccggcgacaucaaagggauuaugcaggccggaaagagaucucuucgcccucaacccacggaacucaaauauagcuggaagaccuggggcaaggcgaaaaugcuguccacagagagccacaaccagaccuuccugaucgaugggccugaaacagccgagugccccaauaccaaccgggcuuggaacucucucgagguggaagacuacggauuuggcguuuucacaaccaacaucuggcugaaacuuagagagaaacaggacguguuuugugauuccaagcugaugagcgccgcuauuaaagacaaucgcgccguccaugcggauaugggcuauuggaucgaaucugcccucaacgacacguggaagauggagaaggcuuccuucauugaggugaaaagcugccacuggccuaagucucacacacuguggagcaaugggguucuggaauccgagaugaucauucccaaaaacuucgccggaccggugagccagcauaacuaccggccuggcuaucacacccaaaccgcugggcccuggcaucuuggaaagcucgaaauggauuuugacuucugugagggcacaaccgucguggugacggaagauugcgggaauagaggacccucucugcggacaaccacagccuccggcaaacugaucaccgaguggugcugucgcagcugcacacucccuccgcugagauaccggggcgaggacggguguugguacggaauggaaauuagaccccuuaaggagaaggaagagaaccuggucaauucccucguuaccgccggccacgggcagaucgauaacuuuucucugggagugcugggcauggcucuuuuccucgaagagaugcugcgcacgcggguggggaccaaacaugcgauccugcucgucgcccugagcuuugugacacuuauuaccggaaauauguccuucagagaccugggccgcguuauggugauggucggcgcuacaaugaccgaugacaucgggaugggagugacguaucucgcccugcuggccgcuuuuaagguuagaccuacauucgccgcgggccuucugcuccggaaacugaccucuaaggagcucaugauggcuacaauugggaucgcccugcuuagccaguccacccugcccgaaaccauucucgagcugacagaugcccuggcucuuggaaugauggcccugaaaaucgugcgcaacauggaaaaguaccaacucgcggucacgaucauggcuauuucuugcgugccuaaugccguuauccugcagaacgccuggaaggugagcuguaccauucucgcugccgucuccgugagcccccugcuucugacaucuucccagcagaaagcugacuggaucccucucgcccugaccauuaagggccugaaucccacagcgaucuuucuuaccacgcugagcagaacaucuaaaaagcgguccuggccgcucaacgaggccaucauggcuguggggauggucagcauucuggccucuucccuccugaaaaaugacaucccuaugaccggaccccuuguugcuggcggccugcugaccgugugcuaugugcucacagggcgcagcgccgaucuggaacuugagagagccgcugacgucaagugggaggaucaagcggaaauuuccggaagcucuccuauccugagcauuaccaucuccgaggacggcucuaugagcauuaaaaacgaagaggaggaacagacacucacgauccugauccggaccgggcuccuggugauuuccggaguuuuccccgugucuaucccgauuacagccgcugccugguaccuuugggaggucaagaagcagcgcgccggcgugcugugggauguuccuucucccccucccguggggaaagcugaacuggaggacggagccuauagaaucaagcagcggggcauucucggcuacucccaaaucggggcgggagucuauaaagaaggcaccuuucacacaauguggcacgugacccgcggggcuguccugaugcauagaggaaagcggaucgagcccuccugggccgaugugaaaaaggaccuuauuagcuacggcgggggauggaagcuggagggcgaauggaaagagggcgaagagguucaggugcucgcccuggaaccugggaagaauccgagagcuguccagacgaaacccggaaucuucaagaccaacacaggcaccauuggggccgugucccucgauuuuagcccuggaacaucuggcucccccaucguugaccgcaaagggaagguggucggacuguacggcaauggcguggugacccggagcggggcguauguuucugcuauugcccagacagagaaguccaucgaggauaacccugaaaucgaggacgauauuuuccgcaagaagcgccuuacgaucauggaccugcaccccggagccggcaaaaccaagcgguaccugccugcuauugucagagaagccaucaaacgcgggcuccggacacugauucuugcuccgaccagagugguggccgcggagauggaagaggcccugcgcggacuccccauccgguaucaaaccccugcuauuagagccgagcauacaggccgggaaaucgucgaccugaugugucacgcuacguucaccaugcgccuccugagccccgugagaguuccuaacuacaaucuuaucauuauggaugaggcccauuuuacagaccccgccuccaucgcugcgcggggguauauuucuacccgcguggaaaugggcgaggccgcuggaaucuucaugacagccaccccgccuggcagcagagaucccuuuccccaguccaacgccccuauuauggacgaggaacgggagauccccgaaagaagcuggaacucugggcacgagugggucacggauuucaagggaaagacagugugguuuguuccuuccaucaaagcuggcaacgacauugccgcgugccugcgcaagaaugggaaaaaggugauccagcugagccggaaaaccuucgauucugaauacgucaagaccagagcuaacgacugggauuuugugguuacaaccgacauuagcgagaugggagccaauuucaaggccgagcgcgugaucgauccgcggagauguaugaaacccgucauucucacagacggcgaagaaagagugauccuggcugggccuaugcccgugacccacuccucugccgcgcaacggagaggccgcaucggaagaaacccuaagaaugaaaacgaccaguauauuuacaugggcgagccccuugaaaaugaugaggacugcgcccauuggaaagaggcuaagaugcugcucgauaacaucaauacgccggaagggauuaucccuagcauguuugagcccgaacgggagaaagucgacgccauugauggagaauaccgccugagaggcgaggcucggaagacauucguugaccugaugcgcagaggggaucucccuguguggcuugccuauaaaguggcugccgagggaaucaacuacgcggaccggaagugguguuuugauggcauuaagaauaaccagauccuggaagagaacgucgaaguggagaucuggaccaaagagggggaaagaaagaaacugaagccccgcuggcucgacgcccggauuuauuccgauccucuggcucuuaaagaguucaaggaguucgccgcuggcagaaagucucugacacucaaucugaucaccgagaugggacgccugcccacguuuaugacccagaaagcccggaacgcccucgacaaucuugcuguucugcacacagcggaagugggcgggaaggccuacacccaugcucugagcgagcucccggagacacuggaaacccuucugcuccugacacugcucgccaccauuacgggaggcaucuuccuuuuucugauguccgggaaaggaauuggcaagaugacacugggcaugugcugcaucaucaccgccagcauucuccugugguaugcucaaauccagccucacuggauugccgcgucuaucauucuugaguucuuucugaucguccuccugauccccgaacccgagaaacagagaaccccucaggauaaccaacugacauacgugguuauugccauccucaccguggucgcugccacaauggcuaaugaaaugggguuccuugagaagacgaagaaagaccugggauuuggcaccauuacaacccaggaguccgaaagcaacauccuggacauugaucuccggccggccuccgcguggacacuguaugccguggcuaccacguucgucacccccaugcuucgccacucuaucgagaauagcuccgugaacguuucucugacagccauugcuaaucaggccaccgugcucauggggcugggaaagggcuggccucugagcaaaauggacaucggggugccccuccuugcuaucggauguuacucccaggucaacccuauuacacugaccgccgcgcugcuccugcuuguugcccauuacgcuaucauuggccccggccugcaagccaaggcuacgagagaagcccagaaacgggccgcggcugggaucaugaagaauccuacaguggauggaauuaccgugaucgaccucgagccgauccccuaugauccuaaguuugaaaaacagcugggccaggucaugcugcucauucuuugcgugacacaaguucugaugaugcgcaccaccugggcccugugugaggcucucacacuggccacggggcccaucagcacccuuugggagggaaacccuggcagauucuggaauacaaccauugccgugucuauggcuaacaucuuucggggguccuaccuggccggagcgggccuccuguucagcauuaugaagaauacaaccaacacgcgcagaggcacagggaaugucggagaaacccugggcgagaaauggaagucucggcucaacgcccuugggaaauccgaauuucagaucuauaagaaaagcggaauccaggagguggaccgcacccuggcuaaggagggcauuaagagaggggaaacagaucaccaugccgucucucggggaagcgcuaaacugagaugguucguggagcgcaacaugguuacccccgaaggcaagguggucgaccucggcugcgggcggggaggcugguccuacuauugugggggacugaaaaaugugagagagguuaagggccuuacaaaagggggaccgggccacgaggaaccuauccccaugucuacguacggcuggaaccuggugcgccuccaaagcggggucgauguguucuuuacacccccugagaagugcgacacccugcugugugauauuggagaauccagccccaauccuaccaucgaggccggccggacacucagagugcuuaaccugguugaaaauuggcugaacaauaacacccaguucugcauuaagguccucaauccguauaugcccuccgugaucgagaaaauggaaacgcugcagcgcaaguacgggggagcgcuugugcggaacccucugucuagaaauagcacccaugagauguacugggucuccaacgccacaggcaauaucguuucuagcgugaacaugauuucccgcaugcucaucaaucgguuuaccaugaaacacaagaaagcuacauaugagcccgacguggaucuggggucuggaaccagaaacauuggcaucgaaagcgagauuccuaaccuggacaucauuggcaagcgcaucgaaaagaucaaacaggagcacgaaacauccuggcauuacgaccaagaucaccccuauaagaccugggccuaccaugggagcuaugagacgaaacagacaggaucugcuuccagcauggucaauggcgugguucggcuccuuaccaagccgugggacguggucccuauggugacccagauggccaugacagauacgacccccuucgggcagcaaagaguuuuuaaagagaagguggacacacgcacccaggaaccuaaggagggaaccaagaagcugaugaaaauuaccgcugaauggcuguggaaggagcucggcaaagagaagacacccagaauguguacccgggaagaguucacgcgcaaagucagaucuaacgccgcgcugggggccaucuuuaccgaugaaaauaaguggaaguccgcucgggaggccguggaagacggaagauucugggagcuuguggaucgggagcgcaaccugcaccucgaaggcaaaugcgagacaugugucuacaauaugaugggcaagagagagaaaaagcugggggaguuuggaaaagcuaagggcagccgggccauuugguauauguggcugggggcccgcuuccucgaauuugaggcgcugggauuccuuaacgaggaccacugguuuucuagaggcaauucccugagcgggguugaaggcgagggacuccaucggcugggcuacauccuucgcgaaguggggaagaaagagggaggcgcuauguacgccgaugacaccgccgggugggauacaagaauuacccuggaagaccucaagaacgaggagauggugacgaaucacaugaaaggagaacauaagaaacuggcugaggccaucuucaagcugacauaucagaacaaggucgugcggguucagcgcccuacccccagaggcacagugauggacaucauuucccggaaagaucaacgcgggagcggccaggucggaaccuacggccucaauacguucaccaacauggaagcucagcugaucagacaaauggagggggagggaauuuuuaagucuauccagcaccuuacagccaccgaagagauugcggugcagaauuggcuggcccggguuggccgcgaaagacucagccggauggcuaucuccggggacgauugcguggucaaaccgaucgacgauagauucgccucugcucugacagcccuuaacgacaugggaaaggugcgcaaagauauucagcaaugggagccuagccggggcuggaaugacuggacccagguucccuuuugcucccaucacuuccacgaacuggugaugaaggaugggagaguccucgugguccccugucgcaaccaggacgagcugaucggccgggcgagaauuucucagggagccggcuggagccugaaggagacagcuugccucgggaaauccuaugcccaaauguggacccugauguacuuucaucgccgggaucuuagacuggcugccaacgcuaucuguucugccgugccuagccacuggguuccgacgucccgcacaaccuggagcauucaugcgaagcacgaauggaugaccacagaggacaugcucgccguguggaaucgggucuggauccaggaaaaccccuggauggaggauaaaaccccuguggaaucuugggaggaggugcccuaucugggaaagagagaagaccaguggugcggcucccuuauugggcugacaagccgcgcuacgugggccaaaaauauccagaccgccaucaaccaaguucggucucucauuggaaaugagggcuacacagacuauaugccuuccaugaagagauuccggaaggaagaggaagaggcuggggugcugugguga

SEQ ID NO: 19643 - RNA, 9876 nt, Artificial Sequence
  derived and/or modified CDS sequence (opt5) from DENV-2__GQ868549__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauggauuuugacuucugugagggcaccacggucguggugacagaagauugcgggaaucggggacccucucugagaaccacaaccgccuccggcaaacugauuacagaguggugcugucggagcugcacccucccuccgcugcgcuacagaggcgaggacggguguugguacggaauggaaauccggccccuuaaggagaaggaagagaaccuggucaauucccucguuacggccggccaugggcagauugauaacuuuucucugggagugcugggcauggcucuuuuccucgaagagaugcugagaacccgcguggggacaaaacacgcgauccugcucgucgcccugagcuuugugacccuuaucacaggaaauauguccuuccgggaccugggcagaguuauggugauggucggcgcuaccaugacggaugacauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggaugcccuggcucuuggaaugauggcccugaaaauugugcggaacauggaaaaguaccaacucgcggucaccaucauggcuaucucuugcgugccuaaugccguuauucugcagaacgccuggaaggugagcuguacaauccucgcugccgucuccgugagcccccugcuucugaccucuucccagcagaaagcugacuggauuccucucgcccugacaaucaagggccugaaucccaccgcgauuuuucuuacgacacugagccgcaccucuaaaaagagauccuggccgcucaacgaggccaucauggcuguggggauggucagcauccuggccucuucccuccugaaaaaugacauuccuaugaccggaccccuuguugcuggcggccugcugacagugugcuaugugcucaccgggcggagcgccgaucuggaacuugagcgcgccgcugacgucaagugggaggaucaagcggaaaucuccggaagcucuccuauucugagcaucacaauuuccgaggacggcucuaugagcaucaaaaacgaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggauguuccuucucccccucccguggggaaagcugaacuggaggacggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgaugugaaaaaggaccuuaucagcuacggcgggggauggaagcuggagggcgaauggaaagagggcgaagagguucaggugcucgcccuggaaccugggaagaauccgcgggcuguccagaccaaacccggaauuuucaagacaaacaccggcacaaucggggccgugucccucgauuuuagcccuggaaccucuggcucccccauuguugacagaaaagggaagguggucggacuguacggcaauggcguggugacacgcagcggggcguauguuucugcuaucgcccagacggagaaguccauugaggauaacccugaaaucgaggacgauaucuuccggaaaaagagacuuaccauuauggaccugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaacuacaaucuuaucaucauggaugaggcccacuuuaccgaccccgccuccauugcugcgagaggguauaucucuacacggguggaaaugggcgaggccgcuggaauuuucaugaccgccacgccgccuggcagccgcgaucccuuuccccaguccaacgccccuaucauggacgaggaaagagagauucccgaacggagcuggaacucugggcacgagugggucacagauuucaagggaaagaccgugugguuuguuccuuccaucaaagcuggcaacgacaucgccgcgugccugagaaagaaugggaaaaaggugauucagcugagccgcaaaaccuucgauucugaauacgucaagacacgggcuaacgacugggauuuugugguuaccacagacaucagcgagaugggagccaauuucaaggccgagagagugauugauccgcgccgguguaugaaacccgucauccucaccgacggcgaagagagagugauucuggcugggccuaugcccgugacgcauuccucugccgcgcaacgccggggcagaaucggacgcaacccuaagaaugaaaacgaccaguauaucuacaugggcgagccccuugaaaaugaugaggacugcgcccacuggaaagaggcuaagaugcugcucgauaacauuaauacaccggaagggaucauuccuagcauguuugagcccgaaagagagaaagucgacgccaucgauggagaauaccggcugcgcggcgaggcuagaaagaccuucguugaccugaugcggcgcggggaucucccuguguggcuugccuauaaaguggcugccgagggaauuaacuacgcggacagaaagugguguuuugauggcaucaagaauaaccagauucuggaagagaacgucgaaguggagaucuggacaaaagagggggaacggaagaaacugaagcccagauggcucgacgcccgcaucuauuccgauccucuggcucuuaaagaguucaaggaguucgccgcuggccggaagucucugacccucaaucugauuacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccaaauccagccucacuggauugcggccucuaucauucuugaguucuuucugaucgugcuccugauucccgaacccgagaaacagcggaccccucaggauaaccaacugacauacguugugaucgcuauccucaccgucguggccgcuacaauggccaaugaaaugggguuccuugagaagacgaagaaagaccugggauuuggcuccauuaccacacaggagagcgaauccaacauccuggacauugaucucagaccggcgucugccuggacccuguaugcugucgccacaaccuucgugacgcccaugcuucggcauagcaucgaaaauagcucuguuaacgugagccugaccgcuauugccaaucaggcuacagugcucauggggcugggaaagggcuggccucuguccaaaauggacaucggggucccccuccuugccauuggauguuacagccagguuaacccuaucacccugacagcggcccugcuccugcuuguggcucacuacgccaucauuggccccggccugcaagcuaaggccacccgcgaagcccagaaaagagcggcugccgggaucaugaagaauccuacgguggauggaauuacagucaucgaccucgagccgauucccuaugauccuaaguuugaaaaacagcugggccaggugaugcugcucauccuuugcguuacccaagugcugaugaugcggacaaccugggcucugugugaggcccucacccuggccacagggcccaucucuacgcuuugggagggaaacccuggccgcuucuggaauaccacaauugcugucuccauggccaacaucuuuagagggagcuaccuggcgggagccggccuccuguucucuauuaugaagaauaccacaaacacccggcgcggcacggggaaugugggagaaacacugggcgagaaauggaaguccagacucaacgcucuugggaaaagcgaauuucagaucuauaagaaaucuggcauucaggaggucgaccggacccuggccaaggagggcaucaagcgcggggaaaccgaucaucacgcugugagcagaggauccgccaaacugcggugguucguugagagaaacauggugacacccgaaggcaaggucguggaccucggcugcgggcgcggaggcuggucuuacuauugugggggacugaaaaauguucgggaggugaagggccuuaccaaagggggaccgggccaugaggaaccuauccccaugagcacauacggcuggaaccuggucagacuccaauccgggguggauguguucuuuacgcccccugagaagugcgacacccugcugugugauauuggagaaagcucccccaauccuacaaucgaggcgggccgcacccuccggguucuuaaccuggucgaaaauuggcugaacaauaacacacaguucugcauuaaggugcucaauccguauaugcccucugugaucgagaaaauggaaacccugcagagaaaguacgggggagcccuuguccgcaacccucugagcagaaauuccacgcacgagauguacuggguuucuaacgcuaccggcaauauugugagcuccgugaacaugaucucuagaaugcucaucaaucgcuuuacaaugaaacacaagaaagccaccuaugagcccgacgucgaucuggggagcggaacacggaacauuggcaucgaauccgagauuccuaaccuggacaucauuggcaagagaaucgaaaagauuaaacaggagcaugaaaccagcuggcacuacgaccaagaucaucccuauaagacaugggcuuaccacgggucuuaugagaccaaacagacgggauccgccagcucuauggugaauggcguugugcgccuccuuacaaagccgugggacgucgugccuaugguuacccagauggcuaugaccgauacaacgcccuucgggcagcaacggguguuuaaagagaaggucgacaccagaacacaggaaccuaaggagggaaccaaaaagcugaugaaaaucacagccgaauggcuguggaaggagcucggcaaagagaagacaccccgcauguguacaagagaagaguucacccggaaagugcgcuccaacgcggcccugggggcuguguuuacggaugaaaauaaguggaaaagcgccagagaggcugucgaagacggacgguucugggagcuuguugauagagagcggaaccugcaccucgaaggcaaaugcgagaccuguguguacaauaugaugggcaagcgcgagaagaagcugggggaguuuggaaaagccaagggcucuagagccaucugguauauguggcugggggcgcgguuccucgaauuugaggcucugggauuccuuaacgaggaccauugguuuucccgcggcaauagccuguccgggguggaaggcgagggacuccacagacugggcuacauucuucgggaagucgggaagaaagagggaggcgccauguacgccgaugacacagcugggugggauacccgcaucacacuggaagaccucaagaacgaggagauggugaccaaucauaugaaaggagaacacaagaaacuggccgaggcuauuuucaagcugacguaucagaacaagguugugagaguccagcggccuacaccccgcggcaccgugauggacaucauuagcagaaaagaucaacgggggucuggccagguuggaacauacggccucaauaccuucacgaacauggaagcccagcugauccgccaaauggagggggagggaaucuuuaagagcauucagcaucuuaccgcgacagaagagaucgccgugcagaauuggcuggcuagagucggccgggaacgccucuccagaauggccauuucuggggacgauugcgugguuaaaccgaucgacgaucgguucgcuagcgcccugaccgcgcuuaacgacaugggaaaggugagaaaagauauucagcaaugggagccuucccgcggcuggaaugacuggacacagguccccuuuugcucucaccacuuccaugaacuggugaugaaggaugggcggguccucgugguucccuguagaaaccaggacgagcugaucggccgcgcccggaucagccagggagcuggcuggucccugaaggagaccgccugccucgggaaaucuuaugcucaaauguggacacugauguacuuucacagacgcgaucuucggcuggccgcuaacgccauuuguagcgcggugccuucccauugggucccgaccagcagaacgacauggucuauccacgccaagcacgaauggaugaccaccgaggacaugcucgcuguguggaaucgcguguggauucaggaaaaccccuggauggaggauaaaacaccuguugaauccugggaggaggugcccuaucugggaaagcgggaagaccaguggugcggcagccuuaucgggcugaccucuagagccacaugggccaaaaauauucagacggcuaucaaccaaguccgcucccucaugggaaaugagggcuacaccgacuauaugccuagcaugaagcgguucagacgggaagaggaagaggccggggugcugugguga

SEQ ID NO: 19644 - RNA, 9876 nt, Artificial Sequence
  derived and/or modified CDS sequence (opt5) from DENV-2__GQ868551__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggugaaaaugcuguccaccgagagccauaaccagacauuccugauugaugggccugaaaccgcggagugccccaauacaaaccgcgccuggaacucucucgagguugaagacuacggauuuggcguguucaccacgaacaucuggcugaaacuucgggagaaacaggacgucuuuugugauuccaagcugaugagcgcugccaucaaagacaauagagcugugcacgccgauaugggcuauuggauugaaucugcgcucaacgacacauggaagauggagaaggccuccuucaucgagguuaaaagcugccacuggccuaagucucauacccuguggagcaauggggugcuggaauccgagaugauuauccccaaaaacuucgcuggaccggucagccagcacaacuaccgcccuggcuaucauacccaaacagccgggcccuggcaccuuggaaagcucgaaauggauuuugacuucugugagggcaccacggugguggucacagaagauugcgggaaucggggacccucucugagaaccacaaccgcuuccggcaaacugauuacagaguggugcugucggagcugcacccucccuccgcugcgcuacagaggcgaggacggguguugguacggaauggaaauccggccccuuaaggagaaggaagagaaccugguuaauucccucgugacggccggccaugggcagauugauaacuuuucucugggagugcugggcauggcccuuuuccucgaagagaugcugagaacccgcgucgggacaaaacacgcuauccugcucguggcgcugagcuuuguuacccuuaucacaggaaauauguccuuccgggaccugggcagagugauggucauggugggcgccaccaugacggaugacauugggaugggaguuacauaucucgcucugcuggccgccuuuaaggugcgcccuaccuucgcugccggccuucugcucagaaaacugacaucuaaggagcucaugauggcgaccaucgggauugcucugcuuagccaguccacccugcccgaaacaauccucgagcugacggaugcccuggcccuuggaaugauggcucugaaaauuguccggaacauggaaaaguaccaacucgccgugaccaucauggcgaucucuugcguuccuaaugcugugauucugcagaacgccuggaaggucagcuguacaauccucgccgcuguguccgugagcccccugcuucugaccucuucccagcagaaagccgacuggauuccucucgcucugacaaucaagggccugaaucccaccgccauuuuucuuacgacacugagccgcaccucuaaaaagagauccuggccgcucaacgaggcgaucauggccgucgggaugguuagcauccuggcuucuucccuccugaaaaaugacauuccuaugaccggaccccuuguggccggcggccugcugacagugugcuauguccucaccgggcggagcgcugaucuggaacuugagcgcgccgccgacgugaagugggaggaucaagcugaaaucuccggaagcucuccuauucugagcaucacaauuuccgaggacggcucuaugagcaucaaaaacgaagaggaggaacagacgcucaccauucugaucagaacagggcuccugguuaucuccggaguguuccccgucucuauuccgaucaccgcggccgcuugguaccuuugggaggugaagaagcagcgggccggcguucugugggaugugccuucucccccucccgucgggaaagccgaacuggaggacggagcuuaucgcauuaagcagagaggcauccucggcuacucccaaauuggggccggaguguauaaagaaggcacauuucacaccauguggcaugucacgagaggggcggugcugaugcaccgcggaaagagaaucgagcccuccugggcugauguuaaaaaggaccuuaucagcuacggcgggggauggaagcuggagggcgaauggaaagagggcgaagaggugcagguccucgcccuggaaccugggaagaauccgcgggccgugcagaccaaacccggaauuuucaagacaaacaccggcacaaucggggcuguuucccucgauuuuagcccuggaaccucuggcucccccauuguggacagaaaagggaaggucgugggacuguacggcaauggcgugguuacacgcagcggggccuaugucucugcgaucgcucagacggagaaguccauugaggauaacccugaaaucgaggacgauaucuuccggaaaaagagacuuaccauuauggaccugcaucccggagccggcaaaacaaagcgcuaccugccugccaucgugcgggaagcuauuaaaagagggcuccgcacccugauccuugccccgacccggguggucgcugccgagauggaagaggcgcugagaggacuccccauucgcuaucaaaccccugccauccgggcugagcacacgggcagagaaauuguggaccugaugugucaugccaccuucacaaugcggcuccugagccccguucgcgugccuaacuacaaucuuaucaucauggaugaggcucacuuuaccgaccccgccuccauugccgcuagaggguauaucucuacacgggucgaaaugggcgaggcggccggaauuuucaugaccgcuacgccgccuggcagccgcgaucccuuuccccaguccaacgccccuaucauggacgaggaaagagagauucccgaacggagcuggaacucugggcacgagugggugacagauuucaagggaaagaccguuugguuugugccuuccaucaaagccggcaacgacaucgcugccugccugagaaagaaugggaaaaaggucauucagcugagccgcaaaaccuucgauucugaauacgugaagacacgggcgaacgacugggauuuuguugugaccacagacaucagcgagaugggagcuaauuucaaggccgagagagucauugauccgcgccgguguaugaaacccgugauccucaccgacggcgaagagagagugauucuggccgggccuaugcccgucacgcauuccucugcugcccaacgccggggcagaaucggacgcaacccuaagaaugaaaacgaccaguauaucuacaugggcgagccccuugaaaaugaugaggacugcgcgcacuggaaagaggccaagaugcugcucgauaacauuaauacaccggaagggaucauuccuagcauguuugagcccgaaagagagaaaguugacgcuaucgauggagaauaccggcugcgcggcgaggccagaaagaccuucguggaccugaugcggcgcggggaucucccuguguggcuugcuuauaaagucgccgcugagggaauuaacuacgccgacagaaagugguguuuugauggcaucaagaauaaccagauucuggaagagaacguggaaguugagaucuggacaaaagagggggaacggaagaaacugaagcccagauggcucgacgcgcgcaucuauuccgauccucuggcccuuaaagaguucaaggaguucgcugccggccggaagucucugacccucaaucugauuacggagaugggaagacugcccaccuuuaugacacagaaagcucgcaacgcccucgacaaucuugccgugcugcauaccgcugaagucggcgggaaggcguacacacacgcccugagcgagcucccggagacccuggaaacacuucugcuccugacccugcucgcugccgugacgggaggcaucuuccuuuuucugauguccgggaaaggaauuggcaagaugacacugggcaugugcugcaucauuaccgccagcauccuccugugguaugcucaaauccagccucacuggauugccgcgucuaucauucuugaguucuuucugaucguucuccugauucccgaacccgagaaacagcggaccccucaggauaaccaacugacauacguggucaucgccauccucaccguggucgcugccacaauggcuaaugaaaugggguuccuugagaagacgaagaaagaccugggauuuggcuccauuaccacacaggagagcgaauccaacauccuggacauugaucucagaccggccucugcguggacccuguaugccguggcuacaaccuucguuacgcccaugcuucggcauagcaucgaaaauagcucugugaacgugagccugaccgccauugcuaaucaggccacaguccucauggggcugggaaagggcuggccucuguccaaaauggacaucgggguuccccuccuugcuauuggauguuacagccaggugaacccuaucacccugacagccgcgcugcuccugcuuguggcccacuacgcuaucauuggccccggccugcaagccaaggcuacccgcgaagcccagaaaagagccgcggcugggaucaugaagaauccuacggucgauggaauuacagugaucgaccucgagccgauucccuaugauccuaaguuugaaaaacagcugggccagguuaugcugcucauccuuugcgugacccaaguccugaugaugcggacaaccugggcccugugugaggcucucacccuggccacagggcccaucucuacgcuuugggagggaaacccuggccgcuucuggaauaccacaauugccguguccauggcuaacaucuuuagagggagcuaccuggccggagcgggccuccuguucucuauuaugaagaauaccacaaacacccggcgcggcacggggaaugucggagaaacacugggcgagaaauggaaguccagacucaacgcccuugggaaaagcgaauuucagaucuauaagaaaucuggcauucaggagguggaccggacccuggcuaaggagggcaucaagcgcggggaaaccgaucaucacgccguuagcagaggauccgcuaaacugcggugguucguggagagaaacauggucacacccgaaggcaaggugguugaccucggcugcgggcgcggaggcuggucuuacuauugugggggacugaaaaaugugcgggaggucaagggccuuaccaaagggggaccgggccaugaggaaccuauccccaugagcacauacggcuggaaccuggugagacuccaauccgggguggauguuuucuuuacgcccccugagaagugcgacacccugcugugugauauuggagaaagcucccccaauccuacaaucgaggccggccgcacccuccggguccuuaaccugguggaaaauuggcugaacaauaacacacaguucugcauuaaggugcucaauccguauaugcccucugucaucgagaaaauggaaacccugcagagaaaguacgggggagcgcuuguucgcaacccucugagcagaaauuccacgcacgagauguacugggugucuaacgccaccggcaauauugugagcuccgucaacaugaucucuagaaugcucaucaaucgcuuuacaaugaaacacaagaaagcuaccuaugagcccgacguggaucuggggagcggaacacggaacauuggcaucgaauccgagauuccuaaccuggacaucauuggcaagagaaucgaaaagauuaaacaggagcaugaaaccagcuggcacuacgaccaagaucaucccuauaagacaugggccuaccacgggucuuaugagaccaaacagacgggauccgcuagcucuaugguuaauggcgugguccgccuccuuacaaagccgugggacgugguuccuauggugacccagauggccaugaccgauacaacgcccuucgggcagcaacgggucuuuaaagagaagguggacaccagaacacaggaaccuaaggagggaaccaaaaagcugaugaaaaucacagcugaauggcuguggaaggagcucggcaaagagaagacaccccgcauguguacaagagaagaguucacccggaaagugcgcuccaacgccgcgcugggggccgucuuuacggaugaaaauaaguggaaaagcgcuagagaggccguugaagacggacgguucugggagcuuguggauagagagcggaaccugcaccucgaaggcaaaugcgagaccuguguguacaauaugaugggcaagcgcgagaagaagcugggggaguuuggaaaagcuaagggcucuagagccaucugguauauguggcugggggcccgguuccucgaauuugaggcgcugggauuccuuaacgaggaccauugguuuucccgcggcaauagccuguccggggucgaaggcgagggacuccacagacugggcuacauucuucgggaaguggggaagaaagagggaggcgcuauguacgccgaugacacagccgggugggauacccgcaucacacuggaagaccucaagaacgaggagaugguuaccaaucauaugaaaggagaacacaagaaacuggcugaggccauuuucaagcugacguaucagaacaagguggucagagugcagcggccuacaccccgcggcaccguuauggacaucauuagcagaaaagaucaacgggggucuggccaggugggaacauacggccucaauaccuucacgaacauggaagcucagcugauccgccaaauggagggggagggaaucuuuaagagcauucagcaucuuaccgccacagaagagaucgcgguccagaauuggcuggccagagugggccgggaacgccucuccagaauggcuauuucuggggacgauugcguugugaaaccgaucgacgaucgguucgccagcgcucugaccgcccuuaacgacaugggaaaggucagaaaagauauucagcaaugggagccuucccgcggcuggaaugacuggacacaggugcccuuuugcucucaccacuuccaugaacuggucaugaaggaugggcgggugcucguugugcccuguagaaaccaggacgagcugaucggccgcgcgcggaucagccagggagccggcuggucccugaaggagaccgcuugccucgggaaaucuuaugcccaaauguggacacugauguacuuucacagacgcgaucuucggcuggcugccaacgcuauuuguagcgccgucccuucccauugggugccgaccagcagaacgacauggucuauccacgcgaagcacgaauggaugaccaccgaggacaugcucgccguguggaaucgcguuuggauucaggaaaaccccuggauggaggauaaaacaccuguggaauccugggaggagguccccuaucugggaaagcgggaagaccaguggugcggcagccuuaucgggcugaccucuagagcuacaugggccaaaaauauucagacggccaucaaccaagugcgcucccucaugggaaaugagggcuacaccgacuauaugccuagcaugaagcgguucagacgggaagaggaagaggcugggguucugugguga

SEQ ID NO: 19645 - RNA, 9876 nt, Artificial Sequence
  derived and/or modified CDS sequence (opt5) from DENV-2__HM181971__SS-prME
accgccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaagacaauagagccguccacgcggauaugggcuauuggauugaaucugcccucaacgacacauggaagauggagaaggcuuccuucaucgaggugaaaagcugccacuggccuaagucucauacccuguggagcaaugggguucuggaauccgagaugauuauccccaaaaacuucgccggaccggugagccagcacaacuaccgcccuggcuaucauacccaaacagcugggcccuggcaccuuggaaagcucgaaauugauuuugacuucugugagggcaccacggucguggugacagaagauugcgggaaucggggacccucucugagaaccacaaccgccuccggcaaacugaucacagaguggugcugucggagcugcacccucccuccgcugcgcuacagaggcgaggacggguguugguacggaauggaaauucggccccuuaaggagaaggaagagaaccuggucaauucccucguuacggccggccaugggcagaucgauaacuuuucucugggagugcugggcauggcucuuuuccucgaagagaugcugagaacccgcguggggacaaaacacgcgauccugcucgucgcccugagcuuugugacccuuauuacaggaaauauguccuuccgggaccugggcagaguuauggugauggucggcgcuaccaugacggaugacaucgggaugggagugacauaucucgcccugcuggccgcuuuuaagguucgcccuaccuucgccgcgggccuucugcucagaaaacugacaucuaaggagcucaugauggcuaccauugggaucgcccugcuuagccaguccacccugcccgaaacaauucucgagcugacggaugcccuggcucuuggaaugauggcccugaaaaucgugcggaacauggaaaaguaccaacucgcggucaccaucauggcuauuucuugcgugccuaaugccguuauccugcagaacgccuggaaggugagcuguacaauucucgcugccgucuccgugagcccccugcuucugaccucuucccagcagaaagcugacuggaucccucucgcccugacaauuaagggccugaaucccaccgcgaucuuucuuacgacacugagccgcaccucuaaaaagagauccuggccgcucaacgaggccaucauggcuguggggauggucagcauucuggccucuucccuccugaaaaaugacaucccuaugaccggaccccuuguugcuggcggccugcugacagugugcuaugugcucaccgggcggagcgccgaucuggaacuugagcgcgccgcugacgucaagugggaggaucaagcggaaauuuccggaagcucuccuauccugagcauuacaaucuccgaggacggcucuaugagcauuaaaaacgaagaggaggaacagacgcucaccauccugaucagaacagggcuccuggugauuuccggaguuuuccccgugucuaucccgauuaccgccgcugccugguaccuuugggaggucaagaagcagcgggccggcgugcugugggauguuccuucucccccucccguggggaaagcugaacuggaggacggagccuaucgcaucaagcagagaggcauucucggcuacucccaaaucggggcgggagucuauaaagaaggcacauuucacaccauguggcaugugacgagaggggcuguccugaugcaccgcggaaagagaaucgagcccuccugggccgaugugaaaaaggaccuuauuagcuacggcgggggauggaagcuggagggcgaauggaaagagggcgaagagguucaggugcucgcccuggaaccugggaagaauccgcgggcuguccagaccaaacccggaaucuucaagacaaacaccggcacaauuggggccgugucccucgauuuuagcccuggaaccucuggcucccccaucguugacagaaaagggaagguggucggacuguacggcaauggcguggugacacgcagcggggcguauguuucugcuauugcccagacggagaaguccaucgaggauaacccugaaaucgaggacgauauuuuccggaaaaagagacuuaccaucauggaccugcaucccggagccggcaaaacaaagcgcuaccugccugcuauuguccgggaagccaucaaaagagggcuccgcacccugauucuugcuccgacccgggugguggccgcggagauggaagaggcccugagaggacuccccauccgcuaucaaaccccugcuauucgggccgagcacacgggcagagaaaucgucgaccugaugugucaugcuaccuucacaaugcggcuccugagccccgugcgcguuccuaacuacaaucuuaucauuauggaugaggcccacuuuaccgaccccgccuccaucgcugcgagaggguauauuucuacacggguggaaaugggcgaggccgcuggaaucuucaugaccgccacgccgccuggcagccgcgaucccuuuccccaguccaacgccccuauuauggacgaggaaagagagauccccgaacggagcuggaacucugggcacgagugggucacagauuucaagggaaagaccgugugguuuguuccuuccaucaaagcuggcaacgacauugccgcgugccugagaaagaaugggaaaaaggugauccagcugagccgcaaaaccuucgauucugaauacgucaagacacgggcuaacgacugggauuuugugguuaccacagacauuagcgagaugggagccaauuucaaggccgagagagugaucgauccgcgccgguguaugaaacccgucauucucaccgacggcgaagagagagugauccuggcugggccuaugcccgugacgcauuccucugccgcgcaacgccggggcagaaucggacgcaacccuaagaaugaaaacgaccaguauauuuacaugggcgagccccuugaaaaugaugaggacugcgcccacuggaaagaggcuaagaugcugcucgauaacaucaauacaccggaagggauuaucccuagcauguuugagcccgaaagagagaaagucgacgccauugauggagaauaccggcugcgcggcgaggcuagaaagaccuucguugaccugaugcggcgcggggaucucccuguguggcuugccuauaaaguggcugccgagggaaucaacuacgcggacagaaagugguguuuugauggcauuaagaauaaccagauccuggaagagaacgucgaaguggagaucuggacaaaagagggggaacggaagaaacugaagcccagauggcucgacgcccgcauuuauuccgauccucuggcucuuaaagaguucaaggaguucgccgcuggccggaagucucugacccucaaucugaucacggagaugggaagacugcccaccuuuaugacacagaaagcccgcaacgcccucgacaaucuugcuguucugcauaccgcggaagugggcgggaaggccuacacacacgcucugagcgagcucccggagacccuggaaacacuucugcuccugacccugcucgccgccgucacgggaggcauuuuccuuuuucugauguccgggaaaggaaucggcaagaugacacugggcaugugcugcauuaucaccgcuagcauccuccugugguaugcccaaauucagccucacuggaucgcggccucuauuauccuugaguucuuucugauugugcuccugauccccgaacccgagaaacagcggaccccucaggauaaccaacugacauacguugugaucgcuauucucaccgucguggccgcuacaauggccaaugaaaugggguuccuugagaagacgaagaaagaccugggauuuggcuccaucaccacacaggagagcgaauccaacauucuggacaucgaucucagaccggcgucugccuggacccuguaugcugucgccacaaccuucgugacgcccaugcuucggcauagcauugaaaauagcucuguuaacgugagccugaccgcuaucgccaaucaggcuacagugcucauggggcugggaaagggcuggccucuguccaaaauggacauuggggucccccuccuugccaucggauguuacagccagguuaacccuaucacccugacagcggcccugcuccugcuuguggcucacuacgccauuaucggccccggccugcaagcuaaggccacccgcgaagcccagaaaagagcggcugccgggauuaugaagaauccuacgguggauggaaucacagucauugaccucgagccgauccccuaugauccuaaguuugaaaaacagcugggccaggugaugcugcucauccuuugcguuacccaagugcugaugaugcggacaaccugggcucugugugaggcccucacccuggccacagggcccauuucuacgcuuugggagggaaacccuggccgcuucuggaauaccacaaucgcugucuccauggccaacauuuuuagagggagcuaccuggcgggagccggccuccuguucucuaucaugaagaauaccacaaacacccggcgcggcacggggaaugugggagaaacacugggcgagaaauggaaguccagacucaacgcucuugggaaaagcgaauuucagauuuauaagaaaucuggaauccaggaggucgaccggacccuggccaaggagggcaucaagcgcggggaaaccgaucaucacgcugugagcagaggauccgccaaacugcggugguucguugagagaaacauggugacacccgaaggcaaggucguggaccucggcugcgggcgcggaggcuggucuuacuauugugggggacugaaaaauguucgggaggugaagggccuuaccaaagggggaccgggccaugaggaaccuauucccaugagcacauacggcuggaaccuggucagacuccaauccgggguggauguguucuuuacgcccccugagaagugcgacacccugcugugugauaucggagaaagcucccccaauccuacaauugaggcgggccgcacccuccggguucuuaaccuggucgaaaauuggcugaacaauaacacacaguucugcaucaaggugcucaauccguauaugcccucugugauugagaaaauggaaacccugcagagaaaguacgggggagcccuuguccgcaacccucugagcagaaauuccacgcacgagauguacuggguuucuaacgcuaccggcaauaucgugagcuccgugaacaugaucucuagaaugcucauuaaucgcuuuacaaugaaacacaagaaagccaccuaugagcccgacgucgaucuggggagcggaacacggaacaucggcauugaauccgagaucccuaaccuggacauuaucggcaagagaauugaaaagaucaaacaggagcaugaaaccagcuggcacuacgaccaagaucaucccuauaagacaugggcuuaccacgggucuuaugagaccaaacagacgggauccgccagcucuauggugaauggcguugugcgccuccuuacaaagccgugggacgucgugccuaugguuacccagauggcuaugaccgauacaacgcccuucgggcagcaacggguguuuaaagagaaggucgacaccagaacacaggaaccuaaggagggaaccaaaaagcugaugaaaaucacagccgaauggcuguggaaggagcucggcaaagagaagacaccccgcauguguacaagagaagaguucacccggaaagugcgcuccaacgcggcccugggggcuguguuuacggaugaaaauaaguggaaaagcgccagagaggcugucgaagacggacgguucugggagcuuguugauagagagcggaaccugcaccucgaaggcaaaugcgagaccuguguguacaauaugaugggcaagcgcgagaagaagcugggggaguuuggaaaagccaagggcucuagagccauuugguauauguggcugggggcgcgguuccucgaauuugaggcucugggauuccuuaacgaggaccauugguuuucccgcggcaauagccuguccgggguggaaggcgagggacuccacagacugggcuacauccuucgggaagucgggaagaaagagggaggcgccauguacgccgaugacacagcugggugggauacccgcauuacacuggaagaccucaagaacgaggagauggugaccaaucauaugaaaggagaacacaagaaacuggccgaggcuaucuucaagcugacguaucagaacaagguugugagaguccagcggccuacaccccgcggcaccgugauggacauuaucagcagaaaagaucaacgggggucuggccagguuggaacauacggccucaauaccuucacgaacauggaagcccagcugauccgccaaauggagggggagggaauuuuuaagagcauccagcaucuuaccgcgacagaagagauugccgugcagaauuggcuggcuagagucggccgggaacgccucuccagaauggccaucucuggggacgauugcgugguuaaaccgauugacgaucgguucgcuagcgcccugaccgcgcuuaacgacaugggaaaggugagaaaagauauccagcaaugggagccuucccgcggcuggaaugacuggacacagguccccuuuugcucucaccacuuccaugaacuggugaugaaggaugggcggguccucgugguucccuguagaaaccaggacgagcugaucggccgcgcccggauuagccagggagcuggcuggucccugaaggagaccgccugccucgggaaaucuuaugcucaaauguggacacugauguacuuucacagacgcgaucuucggcuggccgcuaacgccaucuguagcgcggugccuucccauugggucccgaccagcagaacgacauggucuauucacgccaagcacgaauggaugaccaccgaggacaugcucgcuguguggaaucgcguguggauccaggaaaaccccuggauggaggauaaaacaccuguugaauccugggaggaggugcccuaucugggaaagcgggaagaccaguggugcggcagccuuauugggcugaccucuagagccacaugggccaaaaauauccagacggcuauuaaccaaguccgcucccucaugggaaaugagggcuacaccgacuauaugccuagcaugaagcgguucagacgggaagaggaagaggccggggugcugugguga

SEQ ID NO: 19646 - RNA, 9876 nt, Artificial Sequence
  derived and/or modified CDS sequence (opt5) from DENV-2__GU131881__SS-prME
accgccggagugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggauguauugugucuuggaagaauaaagaacucaagugcggcuccgggaucuucauuacggauaacguucacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugaggucaagcugaccaucaugacgggcgacauuaaagggaucaugcaggccggaaagcggucucuuagaccucaacccaccgaacucaaauauagcuggaagacauggggcaaggcgaaaaugcuguccaccgagagccauaaccagacauuccugauugaugggccugaaaccgccgagugccccaauacaaaccgcgcuuggaacucucucgagguggaagacuacggauuuggcguuuucaccacgaacaucuggcugaaacuucgggagaaacaggacguguuuugugauuccaagcugaugagcgccgcuaucaaaaauaacagagccguccacgcggacaugggcuauuggauugaaucugcccucaaugauacauggaagauggagaaggcuuccuucaucgaggugaaaagcugccacuggccuaagucucauacccuguggagcaacgggguucuggaauccgagaugauuauccccaaaaacuucgccggaccggugagccagcacaauuaccgcccuggcuaucauacccaaacagcugggcccuggcaccuuggaaagcucgaaauggacuuugauuucugugagggcaccacggucguggugacagaagacugcgggaaccggggacccucucugagaaccacaaccgccuccggcaaacugauuacagaguggugcugucggagcugcacccucccuccgcugcgcuacagaggcgaggauggguguugguacggaauggaaauccggccccuuaaggagaaggaagagaaucuggucaacucccucguuacggccggccaugggcagauugacaauuuuucucugggagugcugggcauggcucuuuuccucgaagagaugcugagaacccgcguggggacaaaacacgcgauccugcucgucgcccugagcuuugugacccuuaucacaggaaacauguccuuccgggaucugggcagaguuauggugauggucggcgcuaccaugacggacgauauugggaugggagugacauaucucgcccugcuggccgcuuuuaagguucgcccuaccuucgccgcgggccuucugcucagaaaacugacaucuaaggagcucaugauggcuaccaucgggauugcccugcuuagccaguccacccugcccgaaacaauccucgagcugacggacgcccuggcucuuggaaugauggcccugaaaauugugcggaauauggaaaaguaccaacucgcggucaccaucauggcuaucucuugcgugccuaacgccguuauucugcagaaugccuggaaggugagcuguacaauccucgcugccgucuccgugagcccccugcuucugaccucuucccagcagaaagcugauuggauuccucucgcccugacaaucaagggccugaaccccaccgcgauuuuucuuacgacacugagccgcaccucuaaaaagagauccuggccgcucaaugaggccaucauggcuguggggauggucagcauccuggccucuucccuccugaaaaacgacauuccuaugaccggaccccuuguugcuggcggccugcugacagugugcuaugugcucaccgggcggagcgccgaccuggaacuugagcgcgccgcugaugucaagugggaggaccaagcggaaaucuccggaagcucuccuauucugagcaucacaauuuccgaggauggcucuaugagcaucaaaaaugaagaggaggaacagacgcucaccauucugaucagaacagggcuccuggugaucuccggaguuuuccccgugucuauuccgaucaccgccgcugccugguaccuuugggaggucaagaagcagcgggccggcgugcugugggacguuccuucucccccucccguggggaaagcugaacuggaggauggagccuaucgcauuaagcagagaggcauccucggcuacucccaaauuggggcgggagucuauaaagaaggcacauuucacaccauguggcaugugacgagaggggcuguccugaugcaccgcggaaagagaaucgagcccuccugggccgacgugaaaaaggaucuuaucagcuacggcgggggauggaagcuggagggcgaauggaaagagggcgaagagguucaggugcucgcccuggaaccugggaagaacccgcgggcuguccagaccaaacccggaauuuucaagacaaauaccggcacaaucggggccgugucccucgacuuuagcccuggaaccucuggcucccccauuguugauagaaaagggaagguggucggacuguacggcaacggcguggugacacgcagcggggcguauguuucugcuaucgcccagacggagaaguccauugaggacaacccugaaaucgaggaugacaucuuccggaaaaagagacuuaccauuauggaucugcaucccggagccggcaaaacaaagcgcuaccugccugcuaucguccgggaagccauuaaaagagggcuccgcacccugauccuugcuccgacccgggugguggccgcggagauggaagaggcccugagaggacuccccauucgcuaucaaaccccugcuauccgggccgagcacacgggcagagaaauugucgaccugaugugucaugcuaccuucacaaugcggcuccugagccccgugcgcguuccuaauuacaaccuuaucaucauggacgaggcccacuuuaccgaucccgccuccauugcugcgagaggguauaucucuacacggguggaaaugggcgaggccgcuggaauuuucaugaccgccacgccgccuggcagccgcgaccccuuuccccaguccaaugccccuaucauggaugaggaaagagagauucccgaacggagcuggaacucugggcacgagugggucacagacuucaagggaaagaccgugugguuuguuccuuccaucaaagcuggcaaugauaucgccgcgugccugagaaagaacgggaaaaaggugauucagcugagccgcaaaaccuucgacucugaauacgucaagacacgggcuaaugauugggacuuugugguuaccacagauaucagcgagaugggagccaacuucaaggccgagagagugauugacccgcgccgguguaugaaacccgucauccucaccgauggcgaagagagagugauucuggcugggccuaugcccgugacgcauuccucugccgcgcaacgccggggcagaaucggacgcaauccuaagaacgaaaaugaccaguauaucuacaugggcgagccccuugaaaacgacgaggauugcgcccacuggaaagaggcuaagaugcugcucgacaauauuaacacaccggaagggaucauuccuagcauguuugagcccgaaagagagaaagucgaugccaucgacggagaauaccggcugcgcggcgaggcuagaaagaccuucguugaucugaugcggcgcggggaccucccuguguggcuugccuauaaaguggcugccgagggaauuaauuacgcggauagaaagugguguuuugacggcaucaagaacaaccagauucuggaagagaaugucgaaguggagaucuggacaaaagagggggaacggaagaaacugaagcccagauggcucgaugcccgcaucuauuccgacccucuggcucuuaaagaguucaaggaguucgccgcuggccggaagucucugacccucaaccugauuacggagaugggaagacugcccaccuuuaugacacagaaagcccgcaaugcccucgauaaccuugcuguucugcauaccgcggaagugggcgggaaggccuacacacacgcucugagcgagcucccggagacccuggaaacacuucugcuccugacccugcucgccgccgucacgggaggcaucuuccuuuuucugauguccgggaaaggaauuggcaagaugacacugggcaugugcugcaucauuaccgcuagcauccuccugugguaugcccaaauccagccucacuggauugcggccucuaucauucuugaguucuuucugaucgugcuccugauucccgaacccgagaaacagcggaccccucaggacaaucaacugacauacguugugaucgcuauccucaccgucguggccgcuacaauggccaacgaaaugggguuccuugagaagacgaagaaagaucugggauuuggcuccauuaccacacaggagagcgaauccaauauccuggacauugaccucagaccggcgucugccuggacccuguaugcugucgccacaaccuucgugacgcccaugcuucggcauagcaucgagaacuccucuguuaaugugagccugaccgcuauugccaaccaggcuacagugcucauggggcugggaaagggcuggccucuguccaaaauggauaucggggucccccuccuugccauuggauguuacagccagguuaauccuaucacccugacagcggcccugcuccugcuuguggcucacuacgccaucauuggccccggccugcaagcuaaggccacccgcgaagcccagaaaagagcggcugccgggaucaugaagaacccuacgguggacggaauuacagucaucgaucucgagccgauucccuaugacccuaaguuugaaaaacagcugggccaggugaugcugcucauccuuugcguuacccaagugcugaugaugcggacaaccugggcucugugugaggcccucacccuggccacagggcccaucucuacgcuuugggagggaaauccuggccgcuucuggaacaccacaauugcugucuccauggccaauaucuuuagagggagcuaccuggcgggagccggccuccuguucucuauuaugaagaacaccacaaauacccggcgcggcacggggaacgugggagaaacacugggcgagaaauggaaguccagacucaacgcucuugggaaaagcgaauuucagaucuauaagaaaucuggcauucaggaggucgaucggacccuggccaaggagggcaucaagcgcggggaaaccgaccaucacgcugugagcagaggauccgccaaacugcggugguucguugagagaaauauggugacacccgaaggcaaggucguggaucucggcugcgggcgcggaggcuggucuuacuauugugggggacugaaaaacguucgggaggugaagggccuuaccaaagggggaccgggccaugaagaaccuauccccaugagcacauacggcuggaaucuggucagacuccaauccgggguggacguguucuuuacgcccccugagaagugcgauacccugcugugugacauuggagaaagcucccccaacccuacaaucgaggcgggccgcacccuccggguucuuaaucuggucgaaaacuggcugaauaacaauacacaguucugcauuaaggugcucaacccguauaugcccucugugaucgagaaaauggaaacccugcagagaaaguacgggggagcccuuguccgcaauccucugagccggaacuccacgcacgagauguacuggguuucuaaugcuaccggcaacauugugagcuccgugaauaugaucucuagaaugcucaucaaccgcuuuacaaugaaacacaagaaagccaccuaugagcccgaugucgaccuggggagcggaacacggaacauuggcaucgaauccgagauuccuaaucuggauaucauuggcaagagaaucgaaaagauuaaacaggagcaugaaaccagcuggcacuacgaccaagaccaucccuauaagacaugggcuuaccacgggucuuaugagaccaaacagacgggauccgccagcucuauggugaacggcguugugcgccuccuuacaaagccgugggaugucgugccuaugguuacccagauggcuaugaccgacacaacgcccuucgggcagcaacggguguuuaaagagaaggucgauaccagaacacaggaaccuaaggagggaaccaaaaagcugaugaaaaucacagccgaauggcuguggaaggagcucggcaaagagaagacaccccgcauguguacaagagaagaguucacccggaaagugcgcuccaaugcggcccugggggcuguguuuacggacgaaaacaaguggaaaagcgccagagaggcugucgaagauggacgguucugggagcuuguugacagagagcggaaucugcaccucgaaggcaaaugcgagaccuguguguacaacaugaugggcaagcgcgagaagaagcugggggaguuuggaaaagccaagggcucuagagccaucugguauauguggcugggggcgcgguuccucgaauuugaggcucugggauuccuuaaugaggaucauugguuuucccgcggcaacagccuguccgggguggaaggcgagggacuccacagacugggcuacauucuucgggaagucgggaagaaagagggaggcgccauguacgccgacgauacagcugggugggacacccgcaucacacuggaagaucucaagaaugaggagauggugaccaaccauaugaaaggagaacacaagaaacuggccgaggcuauuuucaagcugacguaucagaauaagguugugagaguccagcggccuacaccccgcggcaccgugauggacaucauuagcagaaaagaccaacgggggucuggccagguuggaacauacggccucaacaccuucacgaauauggaagcccagcugauccgccaaauggagggggagggaaucuuuaagagcauucagcaucuuaccgcgacagaagagaucgccgugcagaacuggcuggcuagagucggccgggaacgccucuccagaauggccauuucuggggaugacugcgugguuaaaccgaucgaugaccgguucgcuagcgcccugaccgcgcuuaaugauaugggaaaggugagaaaagacauucagcaaugggagccuucccgcggcuggaacgauuggacacagguccccuuuugcucucaccacuuccaugaacuggugaugaaggacgggcggguccucgugguucccuguagaaaccaggaugagcugaucggccgcgcccggaucagccagggagcuggcuggucccugaaggagaccgccugccucgggaaaucuuaugcucaaauguggacacugauguacuuucacagacgcgaccuucggcuggccgcuaaugccauuuguagcgcggugccuucccauugggucccgaccagcagaacgacauggucuauccacgccaagcacgaauggaugaccaccgaggauaugcucgcuguguggaaccgcguguggauucaggaaaaucccuggauggaggacaaaacaccuguugaauccugggaggaggugcccuaucugggaaagcgggaagaucaguggugcggcagccuuaucgggcugaccucuagagccacaugggccaaaaacauucagacggcuaucaaucaaguccgcucccucauuggaaacgagggcuacaccgacuauaugccuagcaugaagcgguucagacgggaagaggaagaggccggggugcugugguga

SEQ ID NO: 19647 - RNA, 9876 nt, Artificial Sequence
  derived and/or modified CDS sequence (opt5) from DENV-2__FJ898461__SS-prME
accgccggagugaucgucaugcugauucccacggcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauuccacaucuaccugggugacguauggcaccuguacaaccacaggggagcacagacgggaaaagcgcagcguugcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuucagacaaccguuagaggagcuaaacgcauggccauucuuggcgacacggccugggauuucgggucucugggaggcguguuuacaagcaucgggaaggcucuccaccaggucuucggcgccauuuacggagcggcuuuuuccggcgugucuuggaccaugaaaauccugauuggggugaucaucaccuggauuggaaugaacagccgguccacaagccugucuguuucccuuguccucgugggcguggucacccuguaucugggggccauggugcaggccgacagcggauguguugugucuuggaagaauaaagagcucaagugcggcuccgggaucuucauuacagauaacguccacacguggaccgaacaauacaaguuucagccugagagccccuccaaacuggcuucugccauccagaaggcucaugaagagggcauuuguggaaucagaagcgugacacgccuugaaaaucugauguggaaacagaucaccccggagcucaaccacauucuguccgagaaugaaguuaagcugacaaucaugaccggcgacauuaaagggaucaugcaagccggaaagcggucucuuagaccucagcccacggagcucaaauauagcuggaagaccuggggcaaggcgaaaaugcuguccacagaaagccauaaccagaccuuccugauugaugggccugagacagccgaaugccccaauaccaaccgcgcuuggaacucucucgagguggaggacuacggauuuggcgucuucacaaccaacaucuggcugaaacuucgggaaaaacaggacguguuuugugauuccaagcugaugagcgccgcuaucaaagacaauagagccguucacgcggauaugggcuauuggauugagucugcccucaacgacacguggaagauggaaaaggcuuccuucaucgaggugaaaagcugccacuggccuaagucucauacacuguggagcaaugggguccuggaguccgaaaugauuauccccaaaaacuucgccggaccggugagccaacacaacuaccgcccuggcuaucauacccagaccgcugggcccuggcaccuuggaaagcucgagauggauuuugaccugugugaaggcacaaccguggucguuacggaggauugcgggaaucggggacccucucugagaacaaccacagccuccggcaaacucauuaccgaauggugcugucggagcugcacacugccuccgcuucgcuacagaggcgaggacggguguugguacggaauggagauccggccccugaaggaaaaggaggaaaaccucgugaauagccuggugaccgccggccaugggcagauugauaacuucucucugggaguccuuggcauggcucucuuucuggaggaaaugcugagaacgcgcaucgggaccaaacacgcgauccuccuggugguugugagcuucgucacacuuauuaccggaaauauguccuuucgggaccugggcagagugaugguuauggugggcgccacaaugaccgaugacaucgggaugggagucacguaucucgcucugcuggccgccuucaaggugcgcccuacauuugcugccggccuucugcucagaaaacugaccucuaaggagcucaugauggcgacaauugggaucgcucugcuuagccaauccaccauucccgagaccauccuggaacucacagaugcccuggcccugggaaugaugguucuuaaaaucgugcggaacauggagaaguaccagcuggcugucacgauuauggccaucucuugcgugccuaaugcggugauucuccagaacgcuuggaaggucagcuguaccauccuggccgccguuuccgugagcccccuccugcuuacaucuucccagcaaaaagcugacuggauuccucuggcccucaccaucaagggccugaaucccacagcuaucuuccugaccacgcuuagccgcacaucuaaaaagagauccuggccgcugaacgaagccauuauggcgguggggauggucagcauccucgccucuucccugcucaaaaaugacauuccuaugaccggaccccugguggcuggcggccuucugaccguuugcuaugugcugacagggcggagcgccgaucucgagcuggaacgcgcugccgacgucaagugggaggaucaggccgagaucuccggaagcucuccuauucuuagcaucaccauuuccgaagacggcucuaugagcaucaaaaacgaggaagaggagcagacacugacgauccucauuagaaccgggcugcucgugaucuccggaguuuuucccgugucuauuccgaucacagcugcggccugguaccugugggaagucaagaagcagcgggcuggcgugcuuugggaugucccuucucccccucccguggagaaagccgaacuggaggacggggccuaucgcauuaagcaaagaggaauccugggcuacucccagaucggcgcugggguuuauaaagaaggaaccuuccacacaauguggcaugugacccggggcgccguccucaugcaccgcgggaagagaauugagcccuccugggcggaugugaaaaaggaccugaucagcuacggaggcggguggaaacuugagggagaauggaaagagggcgaagagguucaggugcuggcucucgaaccuggcaagaauccgcgggccguccagacgaaacccgggauuuuuaagaccaacacaggaaccaucggcgccgugucccuggauuucagcccugggacaucuggaucccccauuguggacagaaaaggcaagguugucgggcucuacggaaauggcguggugacccgcagcggcgcuuaugucucugccaucgcgcaaacagagaaguccaucgaggauaacccugaaauugaggacgauaucuuucggaaaaagagacugacgauuauggaccuucaucccggggcuggaaaaaccaagcgcuaccugccugccaucgugcgggaagccauuaaaagaggccugcgcacacucauccuggcuccgacccggguuguggccgcugagauggaagaggcccuuagagggcugcccauucgcuaucagaccccugcgaucaagacagagcacacgggacgggaaaucgucgaccucaugugucaugccaccuucacaaugagacugcucagccccgugcggguuccuaacuacaaucugauuaucauggaugaggcucacuucaccgaccccgccuccauugcugcccgcggcuauaucucuacaagaguggaaaugggggaggccgcuggcauuuuuaugaccgcgacgccgccuggaagccgggaucccuucccccaguccaacgccccuaucauggacgaggaacgcgagauccccgaaagaagcuggaacucuggccacgagugggucacagauuuuaaggggaaaaccgugugguucguuccuuccauuaaggcuggaaacgacaucgccgccugccuucggaaaaauggcaagaaagugauucaacugagcagaaagaccuuugauucugaauacgucaagacacgcgcuaacgacugggauuucguggugaccacagacaucagcgagaugggggccaauuuuaaagcggagcgggucauugauccgagacgcuguaugaagcccguuauccugaccgacggagaagaacgggugauccucgcuggcccuaugcccgugacgcauuccucugccgcccagagacgcgggcggauuggcagaaacccuaaaaaugaaaacgaccaguauaucuacaugggagagccccuggaaaaugaugaggacugcgcucacuggaaggaggccaaaaugcuucuggauaacauuaauacaccggaaggcaucauuccuagcauguucgagcccgaacgcgagaaggucgacgcgaucgauggggaauacagacuccggggagaggcccgcaaaaccuuuguggaccugaugagacggggcgaucugccuguuuggcucgcuuauaagguggccgcugaggggauuaacuacgccgaccgcaagugguguuucgauggaaucaaaaauaaccagauccuugaagagaacauggaagucgagauuuggacaaaggagggcgaacgcaagaagcugaaaccccgguggcuggacgcuagaaucuauuccgauccucucgcccugaaggaguuuaaggaguucgcggccgggcgcaaaucucuuacccugaaucucauuacggagaugggccggcugcccaccuucaugacacaaaaggcuagaaacgcccuggacaaucucgcugugcuucauaccgccgaagccggaggccgcgcuuacaaccacgcgcugagcgagcugccggagacacucgaaacccugcuucugcucacacugcuggccaccguuacagggggaaucuuucucuuccuuauguccggcaaagggauuggaaagaugacacugggcaugugcugcaucaucaccgcuagcauucugcucugguaugcccagauccagccucacuggauugccgcuucuaucauucuggaguuuuuccuuaucgugcugcucauccccgaacccgagaaacagcggaccccucaagauaaucagcugacauacgucgugauugccauccugaccgucguggcggccacaauggcuaacgaaaugggcuuucucgagaagacgaagaaagaccuugggcugggauccauuaccacacaggagccggaaagcaauauccuggacauugaucucagacccgccuccgcuuggacccuguaugccguugcgacaaccuucgugacgccuaugcuucggcauucuaucgagaacagcuccgugaaugucucucugaccgccauugcuaaccaggccacaguucucaugggccuggggaagggauggccccugagcaaaauggacaucggcgugccucuccuugcuaucggguguuacucccaagugaaucccauuacccugacagccgcucugcuccugcuugucgcccacuacgcgaucauuggaccuggccugcaggccaaggcuacccgcgaagcccagaaaagagcugccgccggcaucaugaagaacccgacgguggaugggauuacaguuaucgaccucgagcccaucccuuaugaucccaaguuugaaaaacagcugggacaagugaugcugcucauucuuugcgucacccaggugcugaugaugcggacaaccugggcgcugugugaggcucucacccuggccacaggcccuaucagcacgcuuugggaggggaaucccggacgcuucuggaacaccacaauugcugucucuauggccaauaucuuuagaggcuccuaccuggccggggcuggacuccuguucagcauuaugaagaacaccacaaauacccggcgcggcacgggcaacaucggggaaacacugggagagaaauggaagucuagacucaacgcccuuggcaaauccgaauuucagaucuauaagaaaagcgggauucaagagguggaccggacccuggcgaaggagggaaucaagcgcggcgaaaccgaucaucacgccguuucuagagggagcgcuaaacugcggugguucguggagagaaauauggucacaccggaaggaaaggugguugaccucggcugcggccgcgggggaugguccuacuauuguggcgggcugaaaaacgugcgggaggucaagggacuuaccaaaggcgggccuggacaugaggaacccauucccaugucuacauacggcuggaaucuggugagacuccagagcggcguggaugucuuuuucacgccucccgagaagugcgacacccugcugugugauaucggggaauccagcccuaacccgacaauugaggccggacgcacccuccggguccuuaaucugguggaaaacuggcugaauaacaauacacaguucugcaucaaggugcucaaccccuauaugccuuccgucaucgagaaaauggaaacccugcagagaaaguacggcggggcucuuguucgcaauccccugucucggaacagcacgcacgagauguacuggguguccaaugccaccggaaacauugugucuagcgucaauaugaucuccagaaugcucauuaaccgcuuuacaaugaaacacaagaaagcgaccuaugagccugacguggaucugggcucugggacacggaacaucggaauugaaagcgagauccccaaucuggacauuaucggcaagagaaucgaaaagauuaaacaagagcaugaaaccuccuggcacuacgaccaggaucauccguauaagacaugggccuaccacggcagcuaugagaccaaacagacggggucugcuuccagcaugguuaacggagugguccgccuccuuacaaagccuugggacgugguucccauggugacccagauggccaugaccgauacaacgccuuucggccaacagcgggucuuuaaagagaagguggacaccagaacacaggaacccaaggaggggaccaaaaagcugaugaaaaucacagcugaauggcuguggaaggagcucggcaagaagaaaaccccucgcauguguacaagagaggaguucacccggaaggugcgcucuaaugccgcucugggcgccauuuuuacggaugagaacaaguggaaauccgcgagagaagccgucgaggacgggcgguucugggaacuuguugauagagagcggaaucugcaccucgagggaaagugcgaaaccuguguguacaacaugaugggcaaacgcgagaagaaacugggcgaauuugggaaggcuaagggaagcagagccaucugguauauguggcugggcgcucgguuccucgaguuugaagcccugggguuccuuaaugaggaccauugguuuucucgcggaaacucccugagcggcguggagggggaaggccuccacagacugggauacauucuucgggaugucggcaaaaaggaagggggagccauguacgcggacgauacagcuggcugggacacccgcaucacacuggaagaccucaaaaaugaggaaauggugaccaaccauaugaagggggagcacaaaaagcuggccgaggccaucuucaagcugacguaucagaauaaaguugugagaguccaacggcccacaccgcgcggaaccgugauggauauuaucuccagacgggaccagcgcggcagcgggcagguuggcacauacggacucaacaccuuuacgaauauggaagcucaacugauuagacagauggagggcgaagggaucuucaagucuauucagcaucuuaccgccacagaggagaucgcugugcagaacuggcuggcccggcucggacgcgaaagacugagccggauggcgaucuccggcgaugacugcgucgugaaaccuauugaugacagauucgccucugcucuuaccgcccugaaugauauggggaagguucgcaaagacauccaacagugggagcccagccggggauggaacgauuggacacaggugcccuuuugcucccaccacuuccaugaacucgucaugaaggacggcagagugcuggucgugccuugucgcaaccaggaugagcugauugggcgggcuagaaucucucaaggcgccggauggagccucaaggaaaccgcgugccugggcaaauccuaugcccagauguggacacuuauguacuuucaccgccgggaccugagacucgcugccaaugcuauuuguucugccguuccgagccauugggugcccaccucccgcacgacauggagcauccacgcuaagcacgaguggaugaccaccgaggauaugcuggccgucuggaaccggguguggauucaggaaaauccuuggauggaggacaaaacacccguggaaucuugggaggaaguuccuuaucuugggaagagagaggaccaguggugcggaucccugaucggccucaccagccgcgcgacaugggccaaaaacauccaaacggcuauuaaucaggugcggucucugaucgggaacgaggaauacaccgauuauaugcccuccaugaagagauuccggagagaggaagaggaagccggaguccugugguga

SEQ ID NO: 19648 - RNA, 9876 nt, Artificial Sequence
  derived and/or modified CDS sequence (opt5) from DENV-2__FJ024473__SS-prME
accgccggagugaucgucaugcugauucccaccgcuauggccuuccaccucacgaccagaaacggggaaccucauaugaucguuggacggcaggaaaagggcaagucccugcuuuuuaagaccgaggacggggugaauaugugcacccugauggcgauugaucucggagaacugugugaggacaccaucaccuacaaaugcccgcuucugagacaaaacgaacccgaggauauugacuguuggugcaauuccaccucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcacauccaaccgcgauuuuguggaagggguuucuggaggcagcuggguggacauuguccucgagcacggguccugugugaccacaauggccaagaauaagcccacccuggauuucgaacuuaucaaaacggaggcuaagcagccugccacacugagaaaauauugcaucgaagcuaagcucaccaacaccacaaccgagagccgguguccgacacaaggagagcccucucugaaugaagaacaggacaaacgcuuuauuugcaagcauuccaugguggauagaggcuggggcaacggguguggacuguucggcaaagggggaaucgucacgugcgccauguuuaccugcaaaaagaauauggaaggcaaaguugugcagccugagaaccucgaauacacaauugugaucacaccccacagcggggaggagcaugcggucggagacgauacaggcaagcacggcaaagaaauuaagaucaccccucagucuuccaucacggaggccgaacugaccggguauggaacagugaccauggaguguagcccccggacaggccuugacuucaaugaaaugguucugcuccaaauggaggauaaggcuuggcuggugcaccgccagugguuucuugaccugccgcucccuuggcugcccggggccgacacccagggaucuaacuggauucagaaggagacgcuggucacauucaagaauccucaugcuaaaaagcaagaugugguugugcucggcucccaggaaggggccaugcacaccgcccugacaggcgcuaccgagauccagaugagcuccggaaaccuucuguuuaccggccaucucaaaugcagacugcggauggacaaacuucaacugaaagggaugucuuacagcauguguacaggaaaguucaagauugucaaagaaaucgcggagacgcagcacggcaccauugugaucagaguccaguaugagggggauggaucccccugcaagauccccuucgaaauuacagaccucgagaaacgccaugugcugggccggcugaucaccguuaauccuauugugaucgaaaaggauagcccggucaacauugaggccgaacccccuuuuggggacucuuacaucauuaucggcguggagcccggacagcucaaacugaacugguucaagaagggcuccagcaucgggcaaauguuugagacaaccaugagaggagcuaaacgcauggccauucuuggcgauacggccugggacuucgggucucugggaggcguuuuuacaagcaucgggaaggcucuccaccagguguucggcgccauuuacggagcggcuuuuuccggcgucucuuggaccaugaaaauccugauugggguggugaucaccuggaucggaaugaauagccgguccacaagccugucuguuucccuuguccucgugggcguggucacccuguaucugggggccauggugcaggccgauagcggauguguugugucuuggaagaacaaagaacucaagugcggcuccgggauuuucaucacagacaauguccacacguggaccgagcaguacaaguuucaaccugaaagccccuccaaacuggcuucugccauucagaaggcucaugaggaaggcaucuguggaauuagaagcgugacacgccuugagaaccugauguggaaacagaucaccccggagcucaaucacauccuguccgaaaacgagguuaagcugacaauuaugaccggcgauacgaaagggaucaugcaggccggaaagcgguaucuuagaccucaacccaccgaacucaaauacucuuggaagacauggggcaaggcgaaaaugcugagcaccgagucccauaaucagacauuccugauugacgggccugaaaccgccgagugccccaacacaaaucgcgcuuggaacagccucgagguggaagacuauggauuuggcgucuucaccacgaauaucuggcugaaacuucgggagaaacaggauguguuuugugacucuaagcugauguccgccgcuauuaaagauaacagagccguucacgcggacaugggcuacuggaucgaaagcgcccucaaugauacauggaagauggagaaggcuucuuucaucgaggugaaauccugccacuggccuaagagccauacccuguggucuaacgggguccuggaaagcgagaugauuauccccaaaaauuucgccggaccggugucccagcacaacuaucgcccuggcuaccauacccaaacagcugggcccuggcaccuuggaaagcucgaaauggacuuugauuucugugagggcaccacgguggucguuacagaagacugcgggaaccggggacccagccugagaaccacaaccgccucuggcaaacugauuacagaguggugcugucgguccugcacccucccuccgcugcgcuacagaggcgaggauggguguugguauggaauggaaauccggccccuuaaggagaaggaagagaaucuggugaacagccucgugacggccggccaugggcagauugacaauuuuucccugggaguccugggcauggcucuuuuccucgaagagaugcugagaacccgcguggggacaaaacacgcgauccugcucguugccgugucuuuugucacccugauuacaggaaacaugagcuuccgggaucuuggcagagugaugguuauggugggcgcuaccaugacggacgauaucgggaugggagucacauaccuggcccuccuggccgcuuuuaaggugcgcccuaccuucgccgcgggccugcuucugagaaaacucacauccaaggagcugaugauggcuaccaucgggauuacccuccugucucagagcacaauccccgaaacgauucuugagcugaccgacgcccucgcccugggaaugaugguucugaaaaucgugcggaauauggaaaaguaucaacuugcugucacaauuauggccaucuccugcgugccuaacgcggugauccugcgcaaugcuuggaaggucucuuguaccauucucgccgccguuagcgugagcccccugcuccugacaagcucucagcagaaagcugacuggaucccucuugcccugaccauuaagggccucaaccccacggcuaucuuucugacaacccuguccagaaccagcaaaaagcggucuuggccgcuuaaugaggccauuauggcgguggggauggucuccauccuggccagcucucuccugaaaaacgauaucccuaugacaggaccccucguggcuggcggccugcuuaccguuugcuacgugcugacagggcgcuccgccgaccuggaacucgagagagcugccgaugucaagugggaggaccaggccgaaauuagcggauccagcccuauccugucuauuacgaucagcgaggauggcuccaugucuauuaaaaaugaagaggaggaaaccacacuuaccauccugauucggacagggcuccuggugaucagcggaguuuuccccguguccaucccgauuaccgcugcggccugguaucucugggaggucaagaagcaacgcgcuggcgugcugugggacgucccuucucccccucuuguggggaaagccgaacuggaggauggagccuacagaaucaagcagcggggcauucugggcuauagccagaucggggcuggaguuuacaaagaaggcacguuucacaccauguggcaugugacacgcggggccguccucaugcacagaggaaagcggauugagcccuccugggcggacgugaaaaaggaucugaucucuuacggcgggggauggaaacuugagggcgaauggaaagagggcgaagagguucaggugcuggcucucgaacccgggaagaacccuagagccguccaaaccaaaccgggaaucuucaagacaaauaccggcacaauuggggccgugagccuggacuuuucccccggaacgagcggcucuccuaucguggaucgcaaagggaagguugucggacucuauggcaacggcguggugacccgguccggggcuuacgucagcgccauugcgcagacagagaagucuaucgaggacaaucccgaaauugaggaugacaucuuccgcaagaagcgccugaccaucauggaccuucauccuggagcuggcaaaaccaagcgguaucugcccgccauugugagagaagccaucaaacgcgggcugcggacacucauucuggcuccuacgagaguuguggccgcugagauggaagaggcccuucgcggacugccgauccgguaccagacccccgcgauuaaggccgagcacacaggcagagaaaucgucgaucucaugugucaugcuaccuucacaaugcggcugcucuccccugugcgcguucccaacuauaaccugauuaucauggacgaggcccacuuuaccgauccugcuagcaucgccgccagaggguacauuuccacgcggguggaaaugggcgaggcugcgggaaucuucaugacagccacacccccgggcucucgcgacccuuuuccccagagcaaugcucccauuauggaugaggaaagagagaucccugaacgguccuggaacagcgggcacgagugggucaccgacuucaagggaaaaacagugugguuuguucccucuauuaaggccggcaaugauaucgccgcuugccuucgcaagaacgggaagaaagugauccaacugucccgcaagaccuucgacagcgaauaugucaagacacgggccaaugauugggacuuuguggugaccacggauauuucugagaugggagcgaacuucaaagcugagagagucaucgacccucgccgguguaugaagccgguuauucugacagacggcgaagagagagugauccucgccgggcccaugccugugacccauagcuccgccgcucagcgccggggcagaauuggacgcaaucccaaaaacgaaaaugaucaguacaucuacaugggcgagccucuggaaaacgacgaggauugcgcccacuggaaggaggcgaaaaugcuucuggacaauaucaacacacccgaagggauuaucccgucuauguuugagccugaaagagagaaggucgaugccguggacggagaauaucggcuccgcggcgaggcuagaaaaaccuucguugaucugaugcggcgcggggaccugcccguguggcucgccuacaaggucgcugccgagggaauuaauuaugcugauagaaagugguguuuugacggcaucaaaaacaaucaaauucuugaagagaacguggaaguugagaucuggacgaaggagggggaacggaaaaagcugaaaccuagauggcuggaugcccgcauuuacagcgacccccucgcgcugaaggaguucaaggaguucgccgcuggccggaaaucccuuacccugaaccucaucacagagaugggaagacugccuaccuuuaugacacagaaggcccgcaaugcucuggauaaccucgccgugcuucauaccgccgaagcuggcgggcgggcguauaaucacgcccugucugagcugcccgagacacucgaaacccugcuucugcucacgcugcuggcuacagucaccggaggcaucuuccucuuucuuaugagcgggaaaggaauuggcaagaugacccugggcaugugcugcaucauuacagccuccgugcugcucugguacgcccagauccagccgcacuggauugcugccagcaucauccuggaguucuuucuuauuguccugcucaucccugaacccgagaaacaaagaacaccccaggacaaccagcugacauaugugguuauugcgauccugacggugguggccgcuaccauggccaaugaaaugggguuccucgagaagacaaagaaagaccuuggacugggcucuauuaccacacaggaguccgaaagcaacauccuggauaucgaccuccggccugcuuccgccuggacccuguacgcggucgccacgaccuuuguuacaccgaugcuucgccauucuauugagaauagcuccgugaacgugucucugaccgcuaucgccaaucaagcuacaguccucauggggcugggaaagggcuggccccugagcaaaauggauauuggggugccucuccuugccaucggauguuacucccagguuaaccccauuacccugacggcugcccugcuccugcuuguggcgcacuaugccaucauuggcccuggccugcaggcuaaggccacaagagaagcucagaaacgggccgccgcggggaucaugaagaaucccaccgucgacggaaucacagugauugaucucgagccuaucccguacgaccccaaguucgaaaaacaacugggccaggucaugcugcucauucuuugcgugacccagguucugaugaugcgcaccacaugggcucugugugaggcccucacgcuggcuaccgggccuaucagcacacuuugggagggaaaccccggcagauuuuggaauaccacaauugccgugucuauggccaacaucuuccggggguccuaucuggcuggagccggccuccuguuuagcaucaugaagaauaccacgaacacacgcagaggcaccgggaauauuggagaaacccugggcgagaaauggaagucucggcucaacgcgcuugggaaauccgaguuccagaucuacaagaaaagcggcauucaagaggucgaucgcacacuggccaaggagggcaucaagagaggggaaaccgaccaucacgcugugucucggggaagcgccaaacugagaugguuuguugagcgcaacauggugacaccugaaggcaaggucguggaucucggcugcgggcggggaggcugguccuauuacugugggggacugaaaaaugugagagagguuaagggccuuacgaaagggggacccggccaugaagaaccgauuccuaugucuaccuauggcuggaaccugguccgccuccagagcgggguggacguguucuucacaccucccgagaagugcgauacccugcugugugacaucggagaauccagccccaaucccacaaucgaggcuggccggacccucagaguccuuaaccugguugaaaauuggcugaacaauaacacgcaguuuugcauuaaggugcucaauccuuacaugccguccgugaucgagaaaauggaaacccugcaacgcaaguacgggggagcccuuguccggaacccccugucuagaaauagcacacacgagauguauuggguguccaacgcgaccggcaauauuguuucuagcgugaacaugaucucccgcaugcucauuaaucgguucacaaugaaacacaagaaagccaccuacgaggcugaugucgaccuggggucuggaacaagaaacaucggcaucgaaagcgagauuccuaaccuggacaucauuggcaagcgcaucgaaaagauuaaacaggagcaugaaaccuccuggcacuaugaucaggaccaucccuacaagacgugggccuaucacgggagcuacgagacaaaacagaccggaucugcuuccagcauggugaauggcguugugcggcuccuuaccaagccuugggaugucgugcccauggugacacaaauggccaugacggacaccacaccguuugggcagcagagagucuucaaagagaagguugauacccgcacacaggaaccuaaggagggaaccaaaaagcugaugagaaucacagcugaauggcuguggaaagagcucggcaagaaaaagacaccccggauguguacgcgcgaggaauuuaccagaaaagugcggucuaacgccgcgcugggggccauuuucacagacgagaauaaguggaaguccgcuagagaagccguggaggauggacgguuuugggaacuugucgaccgcgagagaaaccugcaccucgagggcaaaugcgaaaccuguguguauaauaugaugggcaagcgggagaaaaagcugggggaguucggaaaagcuaagggcagccgcgccaucugguacauguggcugggggccagauuucucgaguucgaagcgcugggauuucuuaacgaggaucauugguucucucggggcaauucccugagcgggguugagggcgaaggacuccaccgccugggcuacauccuuagagacguggggaagaaagagggaggcgcuauguaugccgaugacacagccgggugggacacccggauuacgcuggaagaucucaagaacgaggaaauggucacaaaucauaugaaaggagagcacaagaaacuggcugaggccaucuuuaagcugaccuaccaaaacaaggugguucgcgugcagagaccuacaccccggggcaccgucauggacauuaucucccgcagagaucagcgggggagcggccaggugggaacguauggccucaauaccuucacaaacauggaagcucaacugauucgccagauggagggggaaggaaucuucaaaucuauccagcaucuuaccgccacagaggagauugcggcccaaaauuggcuggcuagaguuggccgggaaagacucagccgcauggccaucuccggggacgauugcguggucaagccuauugacgaucgguuugcuucugcccugaccgcgcuuaacgacaugggaaaagugagaaaggauauccagcagugggagcccagccgcggcuggaaugacuggacacaggucccguucugcucccaccacuuucaugaacuggugaugaaagaugggcggguucucguggucccuuguagaaaccaagacgagcugauuggccgcgcccggaucucucagggagcuggcuggagccugaaggaaaccgccugccucgggaaguccuacgcucagauguggacgcugauguauuuccacagacgcgaucuucggcuggccgcuaacgccaucuguucugcggugcccagccauugggugcccacauccagaaccaccuggagcauucacgccaaacacgaguggaugacaaccgaggacaugcucgcuguuuggaaucgcguguggauccaggaaaacccuuggauggaggacaagacaccggucgaaucuugggaggaagugcccuaccugggaaaacgggaggaucaauggugcggcucccuuauugggcugacgagcagagccaccugggccaagaauauccagacagcuauuaaccagguucggucucucaucggaaaugaggaauauaccgacuacaugccuuccaugaaaagauuucgccgggaggaagaggaagccggcgugcugugguga

SEQ ID NO: 19649 - RNA, 9876 nt, Artificial Sequence
  derived and/or modified CDS sequence (opt5) from DENV-2__FJ024474__SS-prME
accgccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugaagcaaaacgaacccgaggauauugacuguuggugcaauuccacaucuaccugggugacguauggcaccuguacaaccacaggggagcaccgcagagaaaaacggagcgucgcucucgugccucauguuggaaugggccuggagacccgcacggaaacauggauguccucugagggcgccuggaagcacgugcagagaaucgagaccuggauccugcggcaucccggguucacaauuauggccgcuauccucgccuacaccauuggaaccacacacuuucagcgcgcucugaucuucauucuucugacggccgucgcgccuagcaugaccaugagaugcaucggcauuuccaaccgggauuuuguggaagggguuucuggaggcagcuggguggacaucguccucgagcacggguccugugugacaaccauggccaagaauaaacccacacuggauuucgaacuuaucaagaccgaggcuaaacagccugccacgcugcgcaaguauugcauugaagcuaaacucacaaacaccaccacagagagcagauguccgacccaaggagagcccucucugaaugaagagcaggacaagcgguuuaucugcaagcauuccaugguggaucgcggcuggggcaacggguguggacuguucggcaaagggggaauugucacaugcgccauguuuacgugcaagaaaaauauggaaggcaagguugugcagccugagaaccucgaauacaccaucgugauuacaccccacagcggggaggagcaugcggucggaaaugacaucggcaaacacggcaaggaaaucaaaauuaccccucagucuuccaucacagaggccgaacugaccggguauggaacggugaccauggaguguagccccagaacaggccuugauuucaacgaaaugguucugcuccaaauggaggacaaggcuuggcuggugcaccggcagugguuucuugaucugccgcucccuuggcugcccggggccgacacccagggaucuaauuggauucagaaggagacacuggucaccuucaaaaacccucaugcuaagaaacaagacgugguugugcucggcucccaggaaggggccaugcacacggcccugacaggcgcuaccgagauccagaugagcuccggaaaucuucuguuuacaggccaucucaagugccgccugagaauggauaaacuucaacugaaggggaugucuuacagcauguguaccggaaaguucaaaauugucaaggaaaucgcggagacccagcacggcacaaucgugauucggguccaguaugagggggacggaucccccugcaaaauccccuucgaaauuacggaucucgagaagagacaugugcugggccgccugaucaccguuaacccuauugugaucgaaaaagacagcccggucaacauugaggccgaacccccuuuuggggauucuuacaucaucauuggcguggagcccggacagcucaagcugaauugguucaagaaaggcuccagcaucgggcaaauguuugagacaaccaugcggggagcuaagagaauggccauucuuggcgacacagccugggauuucgggucucugggaggcguuuuuaccagcaucgggaaagcucuccaccagguguucggcgccauuuacggagcggcuuuuuccggcgucucuuggacgaugaagauccugaucgggguggugauuacauggaucggaaugaacagccgcuccaccagccugucuguuucccuuguccucgugggcguggucacccuguaucugggggccauggugcaggccgacagcggauguguugugucuuggaaaaauaaggaacucaagugcggcuccgggauuuucaucacagauaacguccacaccuggacagagcaguacaaauuucaaccugaaagccccuccaagcuggcuucugccauucagaaagcucaugaggaaggcaucuguggaauccggagcgugacgagacuugagaaucugauguggaagcagauuaccccggagcucaaccacauccuguccgaaaaugagguuaaacugacaauuaugaccggcgacacaaaggggaucaugcaggccggaaaacgcuaucuucggccucaacccaccgaacucaaguacucuuggaagacguggggcaaagcgaagaugcugagcaccgagucccauaaccagacauuccugauugaugggccugaaaccgccgagugccccaauacaaacagagcuuggaauagccucgagguggaagacuauggauuuggcgucuucaccacaaacaucuggcugaaacuucgcgagaagcaggacguguuuugugauucuaaacugauguccgccgcuaucaaggacaaucgggccguucacgcggauaugggcuacuggauugaaagcgcccucaacgacaccuggaagauggagaaagcuucuuucaucgaggugaaguccugccacuggccuaaaagccauacgcuguggucuaaugggguccuggaaagcgagaugauuauccccaagaacuucgccggaccggugucccagcacaacuauagaccuggcuaccauacacaaaccgcugggcccuggcaccuuggaaaacucgaaauggauuuugacuucugugagggcaccacaguggucguuaccgaagauugcgggaaucgcggacccagccugcggacgacaaccgccucuggcaagcugauuacagaguggugcuguagauccugcacccucccuccgcugcgguaccgcggcgaggacggguguugguauggaauggaaaucagaccccuuaaggagaaagaagagaaccuggugaauagccucgugacagccggccaugggcagauugauaacuuuucccugggaguccugggcauggcucuuuuccucgaagagaugcugcggaccagaguggggacgaagcacgcgauccugcucguugccgugucuuuugucacccugaucacaggaaauaugagcuuccgcgaccuuggccgggugaugguuauggugggcgcuaccaugacagaugacauugggaugggagucaccuaccuggcccuccuggccgcuuuuaaagugagaccuacguucgccgcgggccugcuucugcgcaagcucacauccaaagagcugaugauggcuaccaucgggauuacacuccugucucagagcaccauccccgaaaccauucuugagcugacagaugcccucgcccugggaaugaugguucugaagaucgugagaaacauggaaaaguaucaacuugcugucacgaucauggccauuuccugcgugccuaaugcggugauccugcggaacgcuuggaaagucucuuguaccauucucgccgccgcuagcguuuccccccugcuccugacaagcucucagcagaaggccgacuggaucccucuugcucugaccauuaaaggccucaaucccacagccaucuuucugaccacgcugucccgcacaagcaagaaaagaucuuggccgcuuaacgaggcgaucauggccguggggaugguguccauucuggcuagcucucuccugaagaaugacaucccuaugaccggaccccucgucgccggcggccugcuuaccgugugcuacguucugacagggcgguccgcugaucuggaacucgagcgcgccgccgacgugaaaugggaggaucaggcugaaauuagcggauccagcccuauccugucuauuaccaucagcgaggacggcuccaugucuauuaagaacgaagaggaggaacaaauccuuacaauccugauuagaacggggcuccuggucaucagcggaguguuccccguuuccauuccgaucaccgcggccgcuugguaucucugggaggugaagaaacagcgggccggcguccugugggaugugccuucucccccucccgucgggaaggccgaacuugaggacggagcuuaccgcauuaaacagagaggcauccugggcuauagccagaucggggccggaguguacaaggaaggcacauuucacaccauguggcauguuacacggggggcggugcugaugcaccgcggaaaaagaauugagcccuccugggcugaugucaagaaggaccucaucucuuacggcgggggauggaaacuggagggcgaauggaaggagggcgaagaggugcaaguucuugcccuggaaccugggaaaaauccgcgggccgugcagaccaagcccggaauuuucaaaacgaacaccggcacaaucggggcugucagccucgauuuuuccccuggaaccagcggcucucccauuguggacagaaaggggaaggugguuggacuguauggcaauggcgucgugacacgcuccggggccuacgugagcgcgaucgcucagaccgagaaaucuaucgaggauaacccugaaauugaggacgauaucuuccggaagaaaagacucacaauuauggaccugcaucccggagccggcaagacgaaacgcuaucuuccugccaucguccgggaagcuauuaagagagggcugcgcacccugauccucgccccgacacgggugguugcugccgagauggaagaggcgcugagaggacuucccauucgcuaccagaccccugccaucaaggcugagcacaccggccgggaaaucguggaccugaugugucaugccacauucacgaugagacuccugucccccguccgggugccuaacuauaaucucauuaucauggaugaggcucacuuuaccgaccccgccagcauugccgcucgcggguacaucuccacaagaguugaaaugggcgaggcggccggaauuuucaugaccgcuacaccgccuggcucucgggaucccuuuccccaaagcaacgccccuaucauggacgaggaacgcgagauccccgaaagauccuggaauagcgggcacgagugggugaccgauuucaaaggaaagacggucugguuugugccuucuauuaaagccggcaacgacaucgcugccugccugcggaagaaugggaaaaagguuauucagcuuuccagaaagacauucgauagcgaauaugugaaaacccgcgcgaacgacugggauuuugucgugaccacagacaucucugagaugggagcuaauuucaaggccgagcgggugauugauccgagacgcuguaugaaacccgucauccugacccauggcgaagagcggguuauccuggccgggccuaugcccgugacacacagcuccgcugcccagagacgcggccggauuggaagaaacccuaagaaugaaaacgaccaauacaucuacaugggcgagccccucgaaaaugacgaggauugcgcgcauuggaaagaggccaagaugcugcuugacaacauuaauaccccggaagggaucauuccuucuauguuugagcccgaacgcgagaaaguggaugcugucgacggagaauauagacugcggggcgaggcccgcaagacguucguggaucucaugagacggggggaccugccuguuuggcuggcuuacaagguggccgcugagggaaucaacuaugccgaucgcaaaugguguuuugacggcauuaagaauaaccagauccucgaagagaacgucgaaguggagaucuggacaaaagagggggaaagaaagaaacuuaagccccgguggcuggaugcgagaauuuacagcgacccucuggcccucaaggaguucaaagaauucgcugccggccgcaagucccugacccuuaaucugaucacagagaugggacggcuccccaccuuuaugacgcagaaagcuagaaacgcccuggauaaucuggccguucuccacaccgcugaagcgggcgggcgcgccuauaaccacgcucuuucugagcugccggagacacuggaaacccuccugcuucugacacuccuggccaccgugacaggaggcauuuuccuguuucucaugagcgggaagggaaucggcaaaaugacccuuggcaugugcugcauuaucacggccuccguccugcugugguacgcucagauccaaccucauuggauugccgcgagcaucauucucgaguucuuucugaucgugcuucugauucccgaacccgagaagcagcggacaccucaggacaaucagcucaccuaugucgugaucgccauccugaccguuguggcugccacaauggcuaacgaaaugggguuccuggagaagaccaaaaaggaucucggacuuggcucuauuacaacgcaagaguccgaaagcaauauccuggacauugaccugagaccggccuccgcguggacccucuacgccguggcuacaaccuuugucacacccaugcugcggcacucuaucgagaacagcuccguuaaugugucucuuaccgccauugcuaaccaggccacggugcugauggggcucggaaaaggcuggccucugagcaagauggauaucggggucccccugcucgcuauuggauguuacucccaggugaauccuaucacccuuacagccgcgcugcugcuccugguugcccauuaugcuaucauuggccccggccuucaggccaaagcuacccgcgaagcccaaaagagagccgcggcugggaucaugaagaacccuacaguggacggaauuaccgucaucgaucuggagccgauucccuacgacccuaaauucgaaaagcagcucggccaggugaugcugcugauccucugcgucacgcaggugcuuaugaugcggacaaccugggcccugugugaggcucugacacucgccaccgggcccaucagcacccugugggagggaaauccuggccgcuuuuggaacacaacgauugccguuucuauggcuaauaucuucagaggguccuaucuugccggagcgggccugcucuuuagcauuaugaaaaacaccacaaauacccggcgcggcacagggaacaucggagaaacccugggcgagaaguggaaaucuagacugaacgcccucgggaaguccgaauuccaaauuuacaaaaagagcggaauccaggagguggaucggacgcuugcuaaggagggcaucaaacgcggggaaacagaccaccaugccgucucuagaggaagcgcuaagcugcggugguuuguggagagaaauaugguuacccccgaaggcaaaguggucgaucugggcugcgggcgcggaggcugguccuauuacugugggggacucaagaacgugcgggaggugaaaggccugaccaaggggggaccgggccacgaagagccuauucccaugucuacauauggcuggaaucuuguuagacugcagagcggggucgacguguucuucacccccccugagaagugcgauacacuccugugugacaucggagaauccagccccaacccuacgauugaggccggccgcacccugcgggugcucaaucuugucgaaaacuggcugaauaacaauacacaauuuugcaucaaaguucugaacccguacaugcccuccgugauugagaagauggaaacccuccagagaaaauacgggggagcgcuggugcgcaauccucuuucucggaacagcacacacgagauguauugggucuccaaugccaccggcaacaucgugucuagcguuaauaugaucuccagaaugcugauuaaccgcuucacgaugaagcauaaaaaggcuaccuacgagcccgauguggaccucgggucuggaacacggaacaucggcauugaaagcgagaucccuaaucuggauauuaucggcaagagaauugaaaaaaucaagcaggagcacgaaaccuccuggcauuaugaccaggaccaccccuacaaaacaugggccuaucacgggagcuacgagaccaagcaaacaggaucugcuuccagcauggucaacggcgugguucgccugcucaccaaaccgugggauguggucccuauggugacgcagauggccaugacagacaccacccccuuugggcagcagcggguguucaaggagaaggucgauacaagaacgcaagaaccuaaagagggaaccaagaaacuuaugcgcaucacagcugaauggcuguggaaggagcugggcaaaaagaaaacccccagaauguguacacgggaggaauuuacccgcaagguuagaucuaaugccgcgcucggggccauuuucacagacgagaacaaguggaaauccgcucgggaagccguggaggauggaagauuuugggaacugguggaccgggagcgcaaucuucaucuggagggcaagugcgaaaccugugucuauaacaugaugggcaaaagagagaagaaacucggggaauucggaaaggcuaagggcagccgggccaucugguacauguggcugggggcccgcuuucuggaguucgaagcgcucggauuucugaaugaggaucacugguucucuagaggcaacucccuuagcgggguggagggcgaaggacugcaucggcucggcuacauucugcgcgacguugggaaaaaggagggaggcgcuauguaugccgaugacacggccgggugggauaccagaaucacacuugaagaccugaaaaaugaggaaauggugaccaaccacaugaagggagagcauaaaaagcucgcugaggccauuuuuaagcugacauaccagaauaaagucgugcggguucagcgcccuacccccagaggcacggugauggacaucaucucccggcgcgaucagagagggagcggccaagucggaacauauggccugaacaccuucacaaauauggaagcucagcucauucggcagauggagggggaaggaaucuucaagucuauucaacaccugaccgccacggaggagaucgcggcccagaacuggcuugcucgcgugggcagagaacggcugagcagaauggccauuuccggggacgauugcguugugaaaccgaucgacgaucgcuuugcuucugcccucaccgcgcugaaugacaugggaaagguccggaaagauauccagcagugggagccuagcagaggcuggaacgacuggacacaagugcccuucugcucccaccauuuucacgaacuugucaugaaggaugggcgcgugcugguugugcccugucggaaccaggacgagcucauuggcagagcccgcaucucucagggagcuggcuggagccugaaggaaaccgccugccuggggaaauccuacgcucagauguggacacucauguauuuccaucggagagaucugcgccuugccgcuaaugccauuuguucugcggucccuagccacugggugccgaccucccggacaaccuggagcauccacgccaagcaugaguggaugacgacagaggacaugcuggcuguguggaacagaguuuggauucaagaaaaucccuggauggaggauaaaaccccuguggaaucuugggaggaaguccccuaccucggaaagcgcgaggaccaguggugcggcucccugaucgggcuuaccagccgggccacaugggccaaaaacauucagaccgcuaucaaucaggugagaucucugaucggaaacgaggaauauacagacuacaugccuuccaugaagcgguuuagacgcgaggaagaggaagccggcguucucugguga

SEQ ID NO: 19650 - RNA, 9876 nt, Artificial Sequence
  derived and/or modified CDS sequence (opt5) from DENV-2__FJ024475__SS-prME
accgccggagugaucgucaugcugauucccacagcuauggccuuccaccucacgaccagaaacggggaaccucauaugaucguuggacggcaggaaaagggcaagucccugcuuuuuaagacagaggacggggugaauaugugcacccugauggcgauugaucucggagaacugugugaggacacaaucaccuacaaaugcccgcuucugagacaaaacgaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggagacgauaccggcaagcacggcaaagaaaucaagaucacaccucagucuuccauuaccgaggccgaacugacgggguauggaaccgugacaauggaguguagcccccggaccggccuugacuucaaugaaaugguucugcuccaaauggaggauaaggcuuggcuggugcaccgccagugguuucuugaccugccgcucccuuggcugcccggggccgacacacagggaucuaacuggauccagaaggagacccuggucacguucaagaauccucaugcuaaaaagcaagaugugguugugcucggcucccaggaaggggccaugcacacagcccugaccggcgcuacagagauucagaugagcuccggaaaccuucuguuuaccggccaucucaaaugcagacugcggauggacaaacuucaacugaaagggaugucuuacagcauguguaccggaaaguucaagaucgucaaagaaauugcggagacacagcacggcacgaucgugaucagaguccaguaugagggggauggaucccccugcaagauucccuucgaaaucaccgaccucgagaaacgccaugugcugggccggcugauuacaguuaauccuaucgugauugaaaaggauagcccggucaacaucgaggccgaacccccuuuuggggacucuuacauuaucaucggcguggagcccggacagcucaaacugaacugguucaagaagggcuccagcauugggcaaauguuugagaccacaaugagaggagcuaaacgcauggccauccuuggcgauaccgccugggacuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaauagccgguccaccagccugucuguuucccuuguccucgugggcguggucacacuguaucugggggccauggugcaggccgauagcggauguguugugucuuggaagaacaaagaacucaagugcggcuccgggaucuucauuaccgacaauguccacacauggacggagcaguacaaguuucaaccugaaagccccuccaaacuggcuucugccauccagaaggcucaugaggaaggcauuuguggaaucagaagcgugacccgccuugagaaccugauguggaaacagaucacaccggagcucaaucacauucuguccgaaaacgagguuaagcugaccaucaugacaggcgauaccaaagggauuaugcaggccggaaagcgguaucuuagaccucaacccacggaacucaaauacucuuggaagaccuggggcaaggcgaaaaugcugagcacagagucccauaaucagaccuuccugaucgacgggccugaaacagccgagugccccaacaccaaucgcgcuuggaacagccucgagguggaagacuauggauuuggcgucuucacaaccaauauuuggcugaaacuucgggagaaacaggauguguuuugugacucuaagcugauguccgccgcuaucaaagauaacagagccguucacgcggacaugggcuacuggaucgaaagcgcccucaaugauacguggaagauggagaaggcuucuuucauugaggugaaauccugccacuggccuaagagccauacacuguggucuaacgggguccuggaaagcgagaugaucauucccaaaaauuucgccggaccggugucccagcacaacuaucgcccuggcuaccauacccaaaccgcugggcccuggcaccuuggaaagcucgaaauggacuuugauuucugugagggcacaaccguggucguuacggaagacugcgggaaccggggacccagccugagaacaaccacagccucuggcaaacugaucaccgaguggugcugucgguccugcacacucccuccgcugcgcuacagaggcgaggauggguguugguauggaauggaaauucggccccuuaaggagaaggaagagaaucuggugaacagccucgugaccgccggccaugggcagaucgacaauuuuucccugggaguccugggcauggcucuuuuccucgaagagaugcugagaacgcgcguggggaccaaacacgcgauucugcucguugccgugucuuuugucacacugaucaccggaaacaugagcuuccgggaucuuggcagagugaugguuauggugggcgcuacaaugaccgacgauaucgggaugggagucacguaccuggcccuccuggccgcuuuuaaggugcgcccuacauucgccgcgggccugcuucugagaaaacucaccuccaaggagcugaugauggcuacaauugggaucacccuccugucucagagcaccauucccgaaacaauccuugagcugacggacgcccucgcccugggaaugaugguucugaaaauugugcggaauauggaaaaguaucaacuugcugucaccaucauggccaucuccugcgugccuaacgcggugauucugcgcaaugcuuggaaggucucuuguacaauccucgccgccguuagcgugagcccccugcuccugaccagcucucagcagaaagcugacuggauuccucuugcccugacaaucaagggccucaaccccaccgcuauuuuucugacgacacuguccagaaccagcaaaaagcggucuuggccgcuuaaugaggccaucauggcgguggggauggucuccauccuggccagcucucuccugaaaaacgauauuccuaugaccggaccccucguggcuggcggccugcuuacaguuugcuacgugcugaccgggcgcuccgccgaccuggaacucgagagagcugccgaugucaagugggaggaccaggccgaaaucagcggauccagcccuauucugucuaucacaauuagcgaggauggcuccaugucuaucaaaaaugaagaggaggaaacgacccuuacaauucugauccggaccgggcuccuggugaucagcggaguuuuccccguguccauuccgaucacagcugcggccugguaucucugggaggucaagaagcaacgcgcuggcgugcugugggacgucccuucucccccucccguggggaaagccgaacuugaggauggagccuacagaauuaagcagcggggcauccugggcuauagccagauuggggcuggaguuuacaaagaaggcaccuuucacacgauguggcaugugacccgcggggccguccugaugcacagaggaaagcggaucgagcccuccugggcggacgugaaaaaggaucucaucucuuacggcgggggauggaagcuggagggcgaauggaaagagggcgaagagguucaggugcuugcucuggaaccugggaagaacccgagagccguccaaacaaaacccggaauuuucaagaccaauacaggcaccaucggggccgugagccucgacuuuuccccuggaacaagcggcucucccauuguggaucgcaaagggaagguugucggacuguauggcaacggcguggugacgcgguccggggcuuacgucagcgccaucgcgcagaccgagaagucuauugaggacaauccugaaaucgaggaugacaucuuccgcaagaagcgccucacaauuauggaccugcaucccggagcuggcaaaaccaagcgguaucuuccugccaucgugagagaagccauuaaacgcgggcugcggacccugauccucgcuccgacaagaguuguggccgcugagauggaagaggcccugcgcggacuucccauucgguaccagacgccugcgaucaaggccgagcacaccggcagagaaauugucgaucugaugugucaugcuacauucaccaugcggcuccugucccccgugcgcguuccuaacuauaaccucaucaucauggacgaggcccacuuuacagaucccgcuagcauugccgccagaggguacaucuccacccggguggaaaugggcgaggcugcgggaauuuucaugacggccacaccgccuggcucucgcgaccccuuuccccagagcaaugcuccuaucauggaugaggaaagagagauucccgaacgguccuggaacagcgggcacgagugggucaccgacuucaagggaaaaaccgugugguuuguuccuucuaucaaggccggcaaugauaucgccgcuugccugcgcaagaacgggaagaaagugauucaacuuucccgcaagacauucgacagcgaauaugucaagacccgggccaaugauugggacuuuguggugacaaccgauaucucugagaugggagcgaacuucaaagcugagagagucauugacccgcgccgguguaugaagcccguuauccugacggacggcgaagagagagugauucuggccgggccuaugcccgugacacauagcuccgccgcucagcgccggggcagaaucggacgcaauccuaaaaacgaaaaugaucaguacaucuacaugggcgagccccucgaaaacgacgaggauugcgcccacuggaaggaggcgaaaaugcugcuugacaauauuaacaccccggaagggaucauuccuucuauguuugagcccgaaagagagaaggucgaugccguggacggagaauaucggcugcgcggcgaggcuagaaaaacauucguugaucucaugcggcgcggggaccugccuguguggcuggccuacaaggucgcugccgagggaaucaauuaugcugauagaaagugguguuuugacggcauuaaaaacaaucaaauccucgaagagaacguggaaguugagauuuggaccaaggagggggaacggaagaaacuuaaacccagauggcuggaugcccgcaucuacagcgacccucuggcgcucaaagaguucaaggaguucgccgcuggccggaaaucccugacgcuuaaccugaucaccgagaugggaagacuccccacauuuaugacccagaaggcccgcaaugcucuggauaaccuggccgugcuccauacagccgaagcuggcgggcgggcguauaaucacgcccuuucugagcugccggagacccuggaaacacuccugcuucugacccuccuggcuacggucacaggaggcauuuuccuguuucucaugagcgggaaaggaaucggcaagaugacccuuggcaugugcugcauuaucaccgccuccgugcugcugugguacgcccagauucagccucacuggaucgcugccagcaucauucucgaguucuuucugaucguccuucugauucccgaacccgagaaacaaagaacaccucaggacaaccagcucaccuaugugguuaucgcgauucugacagugguggccgcuacgauggccaaugaaaugggguuccuggagaagaccaagaaagaccucggacuuggcucuaucacaacccaggaguccgaaagcaacauccuggauauugaccugcggccggcuuccgccuggacacucuacgcggucgccaccacguuuguuacccccaugcugcgccauucuaucgagaauagcuccgugaacgugucucuuacagcuauugccaaucaagcuaccguccugauggggcucggaaagggcuggccucugagcaaaauggauaucggggugccccugcucgccauuggauguuacucccagguuaacccuaugacacuuaccgcugcccugcugcuccugguggcgcacuaugccaucauuggccccggccuucaggcuaaggccacgagagaagcucagaaacgggccgccgcggggaucaugaagaauccuacagucgacggaaucaccgugauugaucuggagccgauccccuacgacccuaaguucgaaaaacaacucggccaggucaugcugcugauucucugcgugacacagguucuuaugaugcgcaccaccugggcucugugugaggcccugacacucgcuacggggcccaucagcacccugugggagggaaacccuggcagauuuuggaauacaaccauugccgugucuauggccaacaucuuccggggguccuaucuugcuggagccggccugcucuuuagcaucaugaagaauacaaccaacacgcgcagaggcacagggaauauuggagaaacccugggcgagaaauggaagucucggcugaacgcgcucgggaaauccgaguuccagaucuacaagaaaagcggcauucaagaggucgaucgcacccuugccaaggagggcaucaagagaggggaaacagaccaucacgcugugucucggggaagcgccaaacugagaugguuuguugagcgcaacauggugacccccgaaggcaaggucguggaucugggcugcgggcggggaggcugguccuauuacugugggggacucaaaaaugugagagagguuaagggccugacaaaagggggaccgggccaugaagaaccuauucccaugucuacguauggcuggaaccuuguccgccugcagagcgggguggacguguucuucacacccccugagaagugcgauacccuccugugugacaucggagaauccagccccaauccuaccaucgaggcuggccggacacugagaguccucaaccuuguugaaaauuggcugaacaauaacacccaguuuugcauuaaggugcugaauccguacaugcccuccgugaucgagaaaauggaaacgcuccaacgcaaguacgggggagcccugguccggaacccucuuucuagaaauagcacccacgagauguauuggguguccaacgcgacaggcaauauuguuucuagcgugaacaugaucucccgcaugcugauuaaucgguucaccaugaaacacaagaaagccacauacgagcccgaugucgaccucgggucuggaaccagaaacaucggcaucgaaagcgagauuccuaaccuggacaucauuggcaagcgcaucgaaaagauuaaacaggagcaugaaacauccuggcacuaugaucaggaccaucccuacaagaccugggcuuaucacgggagcuacgagacgaaacagacaggaucugccuccagcauggugaauggcguugugcggcugcucaccaagccgugggaugucgugccuauggugacccaaauggcuaugacagacacgacccccuuugggcagcagagagucuucaaagagaagguugauacacgcacccaggaaccuaaggagggaaccaagaaacuuaugagaaucaccgccgaauggcuguggaaagagcugggcaagaaaaagacaccccggauguguacccgcgaggaauuuacgagaaaagugcggucuaacgcugcccucggggcgauuuucaccgacgagaauaaguggaaguccgccagagaagcuguggaggauggacgguuuugggaacuggucgaccgcgagagaaaccuucaccuggagggcaaaugcgaaacauguguguauaauaugaugggcaagcgggagaaaaagcucggggaguucggaaaagccaagggcagccgcgcuaucugguacauguggcugggggccagauuucuggaguucgaagcccucggauuucugaacgaggaucauugguucucucggggcaauucccuuagcgggguugagggcgaaggacugcaccgccucggcuacauccugagagacguggggaagaaagagggaggcgcgauguaugcugaugacaccgccgggugggacacacggauuacccuugaagaucugaagaacgaggaaauggucacgaaucauaugaaaggagagcacaagaaacucgccgaggcuaucuuuaagcugacauaccaaaacaaggugguucgcgugcagagaccuacaccccggggcacagucauggacauuaucucccgcagagaucagcgggggagcggccaggugggaaccuauggccugaauacguucaccaacauggaagcccaacucauucgccagauggagggggaaggaaucuucaaaucuauccagcaucugacagcuaccgaggagauugccgcgcaaaauuggcuugccagaguuggccgggaaagacugagccgcauggcuaucuccggggacgauugcguggucaagccgauugacgaucgguuugccucugcucucacagcccugaacgacaugggaaaagugagaaaggauauccagcagugggagccuagccgcggcuggaaugacuggacccagguccccuucugcucccaccacuuucaugaacuugugaugaaagaugggcggguucuggugguccccuguagaaaccaagacgagcucauuggccgcgcgcggaucucucagggagccggcuggagccugaaggaaacagcuugccuggggaaguccuacgcccagauguggacccucauguauuuccacagacgcgaucugcggcuugcugccaacgcuaucuguucugccgugccuagccauugggugccgacguccagaacaaccuggagcauucacgcgaaacacgaguggaugaccacagaggacaugcuggccguuuggaaucgcguguggauccaggaaaaccccuggauggaggacaagaccccugucgaaucuugggaggaagugcccuaccucggaaaacgggaggaucaauggugcggcucccugauugggcuuacaagcagagcuacgugggccaagaauauccagaccgccauuaaccagguucggucucugaucggaaaugaggaauauacagacuacaugccuuccaugaaaagauuucgccgggaggaagaggaagcuggcgugcucugguga

SEQ ID NO: 19651 - RNA, 9867 nt, Artificial Sequence
  derived and/or modified CDS sequence (opt5) from DENV-2__FJ182012__SS-prME
accgccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagagcaggacaaacgcuuuaucugcaagcauuccaugguggauagaggcuggggcaacggguguggacuguucggcaaggggggaauugucacaugcgccauguuuacgugcaaaaagaauauggaaggcaaaguugugcagccugagaaccucgaauacaccaucgugauuacaccccacagcggggaggagcaugcggucggaaaugacaacggcaaggaaaucaaaaucaccccucagucuuccauuacagaggccgaacugaccggcuaugggacggugaccauggaguguagcccccggacaggacuugauuucaaugaaaugguucugcuccaaauggaggacaaggcuuggcuggugcaccgccagugguuucuugaucugccgcucccuuggcugcccggcgccgacacccaggggucuaacuggauccagaaagagacacuggucaccuucaagaauccucacgcuaagaaacaagacgugguugugcucggaucccaggaaggcgccaugcauacggcccugacaggggcuaccgagauucagaugagcuccggcaaccuucuguuuacaggacaccucaagugcagacugcggauggauaaacuucaacugaagggcaugucuuacagcauguguaccgggaaauucaagaucgucaaggaaauugcggagacccagcauggaacaaucgugaucagaguccaguaugagggcgacgggucccccugcaaaauucccuucgaaaucacggaucucgagaagcgccacgugcugggacggcugauuaccguuaacccuaucgugauugaaaaagacagcccggucaauaucgaggccgaacccccuuuuggcgauucuuacauuaucaucgggguggagcccggccagcucaagcugaacugguucaaaaagggauccagcauuggccaaauguuugagacaaccaugagaggggcuaagcgcauggccauccuuggagacacagccugggauuucggcucucuggggggaguuuuuaccagcauuggcaaagcucuccaucagguguucggggccaucuacggcgcggcuuuuuccggagucucuuggacgaugaagauucugaucggcguggugaucacauggauugggaugaauagccgguccaccagccugucuguuucccuuguccucgugggaguggucacccuguaucugggcgccauggugcaggccgacagcggguguguugugucuuggaaaaacaaggaacucaaaugcggauccggcaucuucauuacagauaauguccacaccuggacagagcaguacaaguuucaaccugaaagccccuccaagcuggcuucugccauccagaaagcucacgaggaagggauuuguggcaucagaagcgugacgcgccuugagaaccugauguggaagcagaucaccccggagcucaaucauauucuguccgaaaacgagguuaaacugacaaucaugaccggagacacaaagggcauuaugcaggccgggaaacgguaucuuagaccucaacccaccgaacucaaguacucuuggaaaacguggggaaaggcgaagaugcugagcaccgagucccacaaucagacauuccugaucgauggcccugaaaccgccgagugccccaacacaaaucgcgcuuggaacagccucgagguggaagacuauggguuuggagucuucaccacaaauauuuggcugaaacuucgggagaagcaggacguguuuugugauucuaaacugauguccgccgcuaucaaggacaacagagccguucaugcggauaugggcuacuggaucgaaagcgcccucaaugacaccuggaaaauggagaaggcuucuuucauugaggugaaguccugccacuggccuaaaagccacacgcuguggucuaacggcguccuggaaagcgagaugaucauucccaagaacuucgccgggccggugucccagcauaauuaucgcccuggauaccacacacaaaccgcuggccccuggcaucuugggaaacucgaaauggauuuugacuucugugagggaaccacaguggucguuaccgaagauugcggcaaccgggggcccagccugagaacgacaaccgccucuggaaagcugaucacagaguggugcugucgguccugcacccucccuccgcugcgcuacagaggcgaggacggcuguugguaugggauggaaauucggccccuuaaagagaaggaagagaaucuggugaacagccucgugacagccggacacggccagaucgauaauuuuucccuggggguccugggaauggcucuuuuccucgaagagaugcugagaacccgcgugggcacgaagcaugcgauucugcucguugccgugucuuuugucacccugaucacagggaacaugagcuuccgggaccuuggaagagugaugguuauggugggcgcuaccaugacagaugacaucggcaugggggucaccuaccuggcccuccuggccgcuuuuaaagugcgcccuacguucgccgcgggacugcuucugagaaagcucacauccaaagagcugaugauggcuaccauuggcaucacacuccugucucagagcaccauucccgaaaccauccuugagcugacagaugcccucgcccuggggaugaugguucugaagauugugcggaauauggaaaaauaucaacuugcugucacgaucauggccaucuccugcgugccuaacgcggugauucugcgcaaugcuuggaaggucucuuguaccauccucgccgccguuagcguguccccccugcuccugacaagcucucagcagaaggcugacuggauuccucuugcccugaccaucaaaggacucaaccccacagcuauuuuucugaccacgcuguccagaacaagcaagaaacggucuuggccgcuuaaugaggccaucauggcggugggcauggucuccauccuggccagcucucuccugaagaacgacauuccuaugaccgggccccucguggcuggaggccugcuuaccguuugcuacgugcugacaggccgcuccgccgaucuggaacucgagagagcugccgacgucaaaugggaggaucaggccgaaaucagcggguccagcccuauucugucuaucaccauuagcgaggacggauccaugucuaucaagaaugaagaggaggaacaaauucuuacaauccugauccggacgggccuccuggugauuagcgggguuuuccccguguccaucccgauuaccgcugcggccugguaucucugggaggucaaaaagcagcgcgcuggagugcugugggaugucccuucucccccucccgugggcaaggccgaacuugaggacggggccuacagaaucaaacagcggggaauucugggcuauagccagaucggcgcugggguuuacaaggaaggaacauuucacaccauguggcacgugacacgcggcgccguccugaugcauagagggaaacggaucgagcccuccugggcggaugugaagaaagaccucauuucuuacggaggcggguggaagcuggagggagaauggaaggagggcgaagagguucaagugcuugcucuggaaccuggcaaaaacccgagagccguccagaccaagcccgggaucuucaaaacgaauaccggaacaauuggcgccgugagccucgauuuuuccccugggaccagcggaucucccaucguggaccgcaagggcaaaguugucgggcuguauggaaacggcguggugacacgguccggcgcuuacgucagcgccauugcgcagaccgagaagucuaucgaggauaacccugaaaucgaggacgauauuuucagaaagaaacgccucacaaucauggaccugcaccccggggcuggaaagacgaaacgguaucuuccugccauugugagagaagccaucaagcgcggccugcggacccugauucucgcuccgacaagaguuguggccgcugagauggaagaggcccugcgcgggcuucccauccgguaccagaccccugcgauuaaagccgagcauaccggaagagaaaucgucgaccugaugugucacgcuacauucacgaugcggcuccugucccccgugcgcguuccuaauuauaaccucaucauuauggaugaggcccauuuuaccgaccccgcuagcaucgccgccagaggcuacauuuccacacggguggaaaugggggaggcugcgggcaucuucaugaccgccacaccgccuggaucucgcgaucccuuuccccaaagcaaugcuccuauuauggacgaggaaagagagauccccgaacgguccuggaacagcggccacgagugggucaccgauuucaaggggaagacggugugguuuguuccuucuaucaaagccggaaaugacauugccgcuugccugagaaagaacggcaaaaaggugauccagcuuucccgcaaaacauucgauagcgaauaugucaagacccgggccaaugacugggauuuuguggugaccacagacauuucugagaugggggcgaacuucaaggcugagagagucaucgauccgcgccgguguaugaaacccguuauucugacccacggagaagagagagugauccuggccggcccuaugcccgugacacauagcuccgccgcucagcgccgggggagaaucggccgcaauccuaagaacgaaaaugaccaauacauuuacaugggagagccccucgaaaacgacgaggauugcgcccacuggaaagaggcgaagaugcugcuugacaauaucaacaccccggaaggcauuaucccuucuauguuugagcccgaaagagagaaagucgaugccguggacggggaauaucggcugcgcggagaggcuagaaagacguucguugaucucaugcggcgcggcgaccugccuguguggcuggccuacaaagucgcugccgaggggauuaauuaugcugauagaaagugguguuuugacggaaucaagaacaaccagauucucgaagagaauguggaaguugagaucuggacaaaagagggcgaacggaagaaacuuaagcccagauggcuggaugcccgcaucuacagcgacccucuggcgcucaaagaguucaaggaauucgccgcugggcggaagucccugacccuuaaccugauuacagagaugggcagacuccccaccuuuaugacgcagaaagcccgcaaugcucuggauaaccuggccgugcuccauaccgccgaagcuggaggccgggcguauaaucacgcccuuucugagcugccggagacacuggaaacccuccugcuucugacacuccuggcuaccgucacagggggaaucuuccuguuucucaugagcggcaaggggauuggaaaaaugacccuuggcaugugcugcaucauuacggccuccgugcugcugugguacgcccagauccaaccucacuggaucgcugccagcauuauccucgaguucuuucugauuguccuucugauccccgaacccgagaagcagagaacaccucaggacaaccagcucaccuaugugguuauugcgauccugaccgugguggccgcuacaauggccaaugaaaugggcuuccuggagaaaaccaagaaggaucucgggcuuggaucuaucacaacgcaagaguccgaaagcaacauucuggacaucgaccugcggccggcuuccgccuggacccucuacgcggucgccacaaccuuuguuacacccaugcugcgccauucuauugagaauagcuccgugaacgugucucuuaccgcuaucgccaaucaggcuacgguccugaugggccucgggaaaggauggccucugagcaagauggauauuggcgugccccugcucgccaucggguguuacucccagguuaacccuauuacccuuacagcugcccugcugagccucguggcgcacuaugccaucaucggacccggccugcaggcuaaagccaccagagaagcucaaaagcgggccgccgcgggcauuaugaaaaauccuacagucgacgggaucaccgugauugaucuugagccgauccccuacgacccuaaguucgaaaagcagcugggacaggucaugcuccugauucugugcgugacgcagguucucaugaugcgcacaaccugggcucuuugugaggcccugacacuggcuaccggccccaucucuacccucugggaggggaacccuggaagauuuuggaauacaacgaucgccguguccauggccaacauuuuccggggcagcuaucuggcuggggccggacuucuguuuucuaucaugaaaaauaccacaaacacccgcagaggcacaggcaacauuggggaaacccucggagagaaguggaaaucccggcugaaugcgcugggcaagagcgaauuccaaaucuacaaaaagucugggauucaggaggucgaucgcacgcucgccaaagagggaaucaagagaggcgaaacagaccaucacgcugugagccggggguccgccaagcuuagaugguuuguugagcgcaacauggugacccccgaaggaaaagucguggaucugggcugcggccgggggggauggucuuauuacuguggcgggcugaagaaugugagagagguuaaaggacucaccaagggcgggccgggacaugaagagccuauccccaugagcacauauggcuggaaccugguccgccuucaguccggcguggacguguucuucacccccccugagaaaugcgauacacugcucugugacauuggggaaagcucccccaauccuacgaucgaggcuggacggacccugagaguccugaaccucguugaaaauuggcuuaacaauaacacacaauuuugcauuaaggugcugaauccguacaugcccucugugaucgagaagauggaaacccugcagcgcaaauacggcggggcccucguccggaacccucugagcagaaauuccacacacgagauguauugggugucuaacgcgaccggaaauauuguuagcuccgugaacaugaucucucgcaugcuuaucaaccgguucacgaugaagcacaaaaaggccaccuacgagcccgaugucgaccugggcagcgggacaagaaauauuggaaucgaauccgagauuccuaaccucgauaucauuggcaaacgcaucgaaaagauuaagcaggagcaugaaaccagcuggcacuaugaccaggaccaucccuacaaaacaugggcuuaucacggcucuuacgagaccaagcaaacaggguccgccagcucuauggugaauggaguugugcggcugcugaccaaaccgugggaugucgugccuauggugacgcagauggcuaugacagacaccacccccuuuggccagcagagagucuucaaggagaaaguugauacacgcacgcaagaaccuaaggaggggaccaagaaacucaugagaaucacagccgaauggcuuuggaaggagcugggaaaaaagaaaaccccccggauguguacacgcgaggaauuuaccagaaaggugcgguccaacgcugcccugggcgcgaucuucacagacgagaauaaauggaagagcgccagagaagcuguggaggaugggcgguuuugggaacucgucgaccgcgagagaaaccugcaccuugagggaaagugcgaaaccuguguguauaauaugaugggcaaacgggagaagaaacugggcgaauucgggaaggccaaaggaucucgcgcuauuugguacauguggcucggcgccagauuucuggaguucgaagcccugggguuucucaacgaggaucauugguucucccggggaaauagccuguccggcguugagggggaaggccuucaccgccugggauacauccucagagacgugggcaagaaggaggggggagcgauguaugcugaugacacggccggcugggauacccggauuacacuggaagaccuuaaaaacgaggaaauggucaccaaucauaugaagggggagcacaaaaagcuggccgaggcuaucuuuaaacucacauaccagaacaaggugguucgcgugcagagaccuaccccccggggaacggucauggacauuaucagccgcagagaucagcggggcucugggcaagugggcacauauggacugaauaccuucacaaacauggaagcccagcugauccgccagauggagggcgaagggauuuucaagagcauccaacaucucaccgcuacggaggagauugccgcgcagaauuggcuggccagaguuggacgggaaagacuuucccgcauggcuaucucuggcgacgauugcguggucaaaccgauugacgaucgguuugccagcgcucugaccgcccucaacgacauggggaaggugagaaaagauauccagcagugggagccuucccgcggauggaacgacuggacacaaguccccuucugcucucaccacuuucaugaacuggugaugaaggauggccggguucuugugguccccuguagaaaucaggacgagcugaucgggcgcgcgcggauuagccagggcgccggauggucccucaaagaaaccgcuugccugggcaagucuuacgcccagauguggacacugauguauuuccacagacgcgaucuccggcuggcugccaacgcuaucuguagcgccgugccuucccauugggugccgaccagcagaacaaccuggucuauucacgcgaagcacgaguggaugacgacagaggacaugcuugccguuuggaaucgcguguggauccaagaaaaccccuggauggaggauaaaaccccugucgaauccugggaggaagugcccuaccuggggaagcgggaggaccaguggugcggaagccucauuggccugaccucuagagcuacaugggccaaaaauauccagaccgccauuaaccagguucggucccuuaucgggaaugaggaauauacagacuacaugccuagcaugaagagauuucgccgggaggaagaggaagcuggagugcugugguga

SEQ ID NO: 19652 - RNA, 9876 nt, Artificial Sequence
  derived and/or modified CDS sequence (opt5) from DENV-2__EU854293__SS-prME
accgccggaaugaucauuaugcugauccccaccgugauggcuuuccaccucacgaccagaaacggggaaccucauaugauugugagccggcaggaaaagggaaaaucccugcuuuuuaagaccggcgacgggguuaauaugugcacccugauggccauggaucucggagagcugugugaagacaccaucaccuacaaaugcccgcuucugagacaaaacgagcccgaagauauugacuguuggugcaauucuacgagcaccugggugacguauggcaccuguacgaccacaggggagcaccggcgggagaagcgcuccguggcgcucgucccucaugugggaaugggccuggaaaccagaacggagacauggaugucuagcgaaggcgcuuggaaacacgcccagcggaucgagaccuggauccugcgccaucccggguucacaauuauggccgcuauccucgccuacaccauuggaaccacacacuuucagagagcucugaucuucauucuucugacggccguugcgccuuccaugaccaugcggugcaucggcauuucuaaccgcgauuuuguggagggggucagcggaggcuccuggguggacaucguucucgaacacgggagcugugugacaaccauggccaagaauaagcccacacuggauuucgagcuuaucaaaaccgaagcuaagcagucugccacgcugagaaaauauugcauugaggcuaagcucacaaacaccaccacagaaucccgguguccuacccaaggagagccgagccugaaugaggaacaggacaaacgcuuugucugcaagcauucuaugguggauagaggcuggggcaacggguguggacuguucggcaaaggagggaucgugacaugcgccauguuuacgugcaaaaagaauaugaaaggcaaggucguucagcccgagaaccucgaauacaccauugugaucacaccucacuccggggaggaacaugcggugggaaaugacaccggcaaacacggcaaggagauuaaaaucacaccccagagcucuaucaccgaggccgaacugacgggguauggaaccgucacaauggaguguuccccucggaccggccuugauuucaacgaaauggugcugcuccaaauggagaauaaggcuuggcugguucaccgccagugguuucuugaccugccccucccguggcugccuggggccgauacacagggaagcaacuggauucagaaggaaacccuggugacguucaaaaauccccaugcuaagaaacaagacgucgugguucucggcucccaggagggggccaugcacacagcccugaccggcgcuacagagauccagaugucuagcggaaaccuucuguuuaccggccaucucaagugcagacugcggauggacaaacuucaacugaaggggauguccuacagcauguguaccggaaaguucaaaguggucaaggaaauugcggagacacagcacggcacgaucgugauuagaguccaguaugaaggggauggaucuccuugcaaaauccccuucgagaucauggaccucgagaagcgccaugugcugggccggcugauuaccguuaaccccaucgugacagaaaaagauuccccugucaauauugaggccgaaccgcccuuuggggacagcuacaucauuaucggcguggagccuggacagcucaagcugaacugguucaagaaaggcucuagcauugggcaaauguuugaaaccacaaugagaggagcuaagcgcauggccauccuuggcgauaccgccugggacuucgggucccugggaggcguuuuuacgucuaucgggaaagcucuccaccagguguucggcgccauuuacggagcggcuuuuagcggcgucuccuggacaaugaagauccugauuggggugaucauuaccuggaucggaaugaauagccggucuaccucccugagcgugucucuuguucucgucggcguggugacacuguaucugggggucauggugcaggccgauuccggauguguugugagcuggaaaaacaaggagcucaagugcggcuccgggaucuucauuaccgacaauguccacacauggacggagcaguacaaauuucaacccgaaucuccuagcaagcuggccuccgcuauccagaaagcccaugaggaaggcauuuguggaaucagaucugugacccgccuugagaaccugauguggaagcagauuacacccgaacucaaucacauccugagcgagaacgagguuaaacugaccaucaugacaggcgauauuaaggggaucaugcaggcuggaaaacggucccuuagaccgcaaccuaccgaacucaaguauagcuggaagacguggggcaaagccaagaugcugucuaccgagucccauaaucagacauuccugauugacgggcccgaaaccgcggagugcccuaacacaaaucgcgccuggaacagccucgaaguggaggauuacggauuuggcgucuucaccacaaauaucuggcugaaacuucgggagaagcaggacguguuuugugacucuaaacugauguccgcugccauuaaggauaacagagcuguucacgccgacaugggcuauuggaucgaaagcgcgcucaaugauaccuggaagaucgagaaagccucuuucauugaagucaagagcugccacuggcccaaaucccauacgcuguggagcaacgagguccuggagucugaaaugaucauuccuaagaacuucgcugggcccgugucccagcacaauuaccgcccgggauaucauacacaaaccgccggcccuuggcaccuugggaaacucgagauggacuuugauuucugugaaggaaccacaguggucguuaccgaggacugcggcaaccgggggcccagccugagaacgacaaccgcuuccggaaagcugaucacagaauggugcugucggucuugcacccugcccccucugcgcuacagaggcgaggauggcuguugguacgggauggagauucggccgcuuaaggaaaaagaggaaaaucuggugaacagccucgugacagccggacauggccagaucgacaauuuuucccuggggguccugggaauggcccuuuuccucgaggaaaugcugagaacccgcgugggcacgaagcacgcuauucugcucguugcggugucuuuugucacccugaucacagggaacaugagcuuccgggaucuuggaagagugaugguuauggugggcgccaccaugacagacgauaucggcaugggggucaccuaucuggcucuccuggccgccuuuaaagugcgccccacguucgcugccggacugcuucugagaaagcucacauccaaagagcugaugaugaccacaauuggcaucguucuccugucucagagcaccauuccugagaccauccuugaacugacagacgcgcucgcucuggggaugauggugcugaagaugguccggaagauggagaaauaccaacuugccgugacgauuauggccauccugugcgugcccaaugcugucauccuccagaacgccuggaagguuuccuguaccauucuggcgguggugagcgucucuccucucuuucugacauccagccagcagaaagcugauuggaucccccuugcccugaccauuaagggacucaauccuacagccaucuuccugaccacgcugucucgcacaaacaaaaagagauccuggccccuuaaugaagcuauuauggccgugggcaugguuagcauccuggcuucuucccuccugaaaaacgacaucccgaugaccgggccucucguggccggaggccugcuuaccgucugcuaugugcugacaggccggagcgcggaccuggagcucgaacgcgccgcugauguuaagugggaggaccaagccgagauuuccgggagcucucccauccugagcauuaccaucuccgaagauggaucuaugagcauuaagaaugaggaagaggagcagauccuuacaauucugaucagaacgggccuccuggugaucuccgggcucuuuccugucucuaugcccauuaccgcugccgccugguaccugugggaagugaaaaagcagcgggcuggaguccuuugggacgugccgagcccucccccuguuggcaaagcggagcuggaagauggggccuaucgcaucaagcagaaagggauucucggcuacucccaaaucggcgcugggguguauaaggagggaacauuccacaccauguggcaugucacaagaggcgccgugcucaugcacaaggggaaacggauugaacccucuugggccgacguuaagaaagaucugaucagcuacggaggcggguggaaacuugagggagaguggaaagaaggcgaggaagugcagguccuggcucucgagcccggcaagaacccucgcgccgugcagaccaagccggggcuguuuaaaacgaaugcgggaaccaucggcgcugugucccucgacuucagccccgggacaucuggauccccuauuaucgauaagaaaggcaagguugucgggcuguacggaaacggcguggugaccagaagcggcgccuaugucucugccauugcucagacagaaaaauccaucgaggacaaccccgagauugaagaugacaucuuccggaagagaaaacuuaccaucauggaucugcauccuggggccggaaaaacaaagcgcuaccugcccgcgauugugcgggaggcuaucaaaagaggccuccgcacgcugauucuugccccuacccggguuguggccgcugaaauggaggaagcccugagagggcucccgauccgcuaucaaacacccgcuauucgggccgagcacaccggaagagagaucgucgaccugaugugucaugcgaccuuuacaaugcgccuccugagcccugugcggguucccaauuacaaccuuauuaucauggacgaagcccacuucacggauccugcuuccaucgccgcuagaggcuauauuucuacccggguggagaugggggaagccgccggcaucuuuaugacagcuacacccccgggaagccgcgacccuuucccccaguccaaugcgcccauuauggaugaggagagagaaaucccugagcggagcuggucuuccggccacgaaugggucacagacuuuaaggggaaaaccgugugguucguucccagcauuaaggccggaaacgauaucgcugccugccugcgcaagaauggcaaaaaggugauccagcugucuagaaaaacguuugacagcgaguacgucaagacacggaccaacgauugggacuucguggugaccacagauauuuccgaaaugggggccaauuuuaaagcugagagagucaucgacccucgccgguguaugaagccgguuauucucaccgauggagaggaaagagugauccuggccggccccaugccugugacacauucuagcgcggcucaacgccgggggagaauuggccgcaaccccaaaaaugagaacgaccaguauaucuacaugggagaaccucuugagaaugacgaagauugcgcccacuggaaggaggccaagaugcugcucgacaacaucaauacccccgagggcauuaucccguccauguucgaaccugagcgggaaaaagucgaugcuauugacggggaguacagacugcgcggagaagccagaaagacguuuguggaucugaugcggcgcggcgaccuccccguuuggcuugcguauagaguggccgcugaggggaucaacuacgccgaucggcgcugguguuucgacggaauuaaaaauaaccagauccuggaggaaaacgucgagguggaaauuuggacaaaggagggcgagcgcaagaagcugaagccucgguggcucgaugcuagaaucuauucugacccccuggcccuuaaagaguucaaggaguuugcugccgggcgcaaaagccugacccucaaucugaucacagaaaugggccggcugccuaccuucaugacgcagaaggcgagagaugcccucgacaaccuugcuguucugcauaccgccgaggcuggaggccgcgccuacaaucacgcccuguccgaacuccccgagacacuggagacccuucugcuccugacacugcucgcuaccgugacagggggaauuuuucuuuuccugaugagcggccgggggaucggaaaaaugacccugggcaugugcugcauuaucacggcgucuauucuccugugguaugcccaaauccagccgcacuggaucgcugccuccauuauccuugaauuuuuccugauuguccuccugaucccugagcccgaaaagcagagaacaccccaggauaaccaacugaccuacguggucauugccauccucaccgugguugcugccacaauggcgaaugagaugggcuuucuugaaaagaccaaaaaggaccuggggcugggaagcaucacaacgcagcagccugaguccaacauucucgacaucgaucugcggccggccucugcuuggacccuuuaugccguggcuacaaccuucgugacacccaugcugcgccauagcauugaaaauuccucugucaacguuagccucaccgccaucgcgaaucaggccacggugcugaugggccuggggaaaggauggccucucuccaagauggacauuggcgugccccuucuggcuaucggguguuacagccaagucaacccuauuacccugacagccgcucucuuucugcuuguggcccacuacgcuaucaucggacccggccugcaggccaaagcgaccagagaagcccagaagcgggcugccgcuggcauuaugaagaauccuacaguugaugggaucaccgugauugaccucgauccgauccccuaugacccuaaauucgagaagcagcugggacaagucaugcugcucgugcuuugcgucacacaggugcugaugaugcgcacaaccugggcccugugugaagcccucacacuggcgaccggccccauuucuacccuuugggaggggaacccuggaagauuuuggaauacaacgaucgcuguuuccauggccaacaucuuccggggcagcuaccuggcuggggccggacuccuguuuucuauuaugaaaaauaccacaaacacccgcagaggcacaggcaauaucggggaaacccugggagagaaguggaaaucccggcucaacgcccuuggcaagagcgaguuccagauuuauaaaaagucugggauccaagaaguggaucgcacgcuggcuaaggagggaauuaaaagaggcgaaacagaccaucacgccgucagccggggguccgcgaagcugagaugguucguggagcgcaacaugguuacccccgagggaaaaguggucgaucucggcugcggcagagggggauggucuuacuauuguggcgggcugaagaaugugagagaagugaaaggacuuaccaagggcgggccgggacaugaggaaccuauccccaugagcacauacggcuggaaccugguucgccuccaguccggcgucgacguguuuuucacacccccugagaagugcgauacacugcugugugacaucggggaaagcucccccaauccuacgguggaggccggacggacccucagaguccuuaaccugguugagaauuggcugaacaauaacacacaguuuugcauuaaagugcucaauccguauaugcccucugugaucgaaaagauggaggcucugcagcgcaaauacggcggggcccuuguccggaacccucugagcagaaauuccacccacgaaauguacugggugucuaacgcuagcggaaauauuguuuccucugugaacaugaucagccgcaugcucauuaaucgguucacaaugagacacaagaaagccaccuaugagcccgaugucgaccugggcuccgggacgcgcaacaucggaaucgaaagcgagauuccuaaccuggacaucauuggcaagcggaucgagaagauuaaacaagaacaugagaccucuuggcacuacgaucaggaccaucccuauaagacaugggcguaccacggcuccuaugaaaccaaacagacagggagcgccucuuccauggugaauggaguugugagacuccuuaccaagccgugggaugucgugccuauggugacacagauggcuaugaccgacacgacacccuuuggccaacagcgcgucuucaaagagaagguugauaccagaacccaggaaccuaaggaggggaccaagaagcugaugaaaaucacggccgaguggcuguggaaggaacucggcaagaagaaaacaccccggauguguacacgcgaggaauuuaccagaaaggugcggagcaacgcugcccugggcgcuauuuucacagacgagaauaaguggaaaucugccagagaggcgguggaagauucccgguuuugggagcuugucgacaaggaacgcaaccugcaccucgaggggaaaugcgaaaccuguguguacaauaugaugggaaagagagagaaaaagcugggcgaguucggcaaggccaaagggagccgggcuaucugguauauguggcugggagcccgcuuucucgaguucgaggcucugggcuuucuuaacgaagaucauugguucuccagagagaauagccugucugggguugaaggagagggccuccacaagcugggguacauccuucgggacgugagcaaaaaggagggcggagccauguacgccgaugacacagcgggcugggacacccgcauuacgcuggaagaucucaaaaacgaggaaauggucaccaaucauauggagggggaacacaagaagcuggcugaggccaucuucaaacugacauaucagaacaaggugguuagagugcaacggccuacaccccgcggaaccgucauggacauuaucuccagacgggaucagcgcggcucuggacaggugggaaccuacggccucaauacguuuacaaacauggaggcccaacugauuagacagauggaaggggagggcguuuucaaaagcauccagcaucuuaccgugacagaagagaucgcuguccagaauuggcuggcccgggugggacgcgagagacucucccggauggcuauuucuggcgacgauugcgucgugaagccgcuggacgauagauuugccagcgcgcuuaccgcccugaacgacauggggaaaguucgcaaggauauccaacagugggaaccuucccggggauggaaugacuggacacaggugcccuucugcucucaccacuuucaugagcucauuaugaaggauggcagaguccugguggugcccugucgcaaccaggacgaacugaucgggcgggcuagaauuagccaaggagccggcuggucccuccgcgagaccgcuugccuggggaaaagcuaugcccagauguggucucuuauguacuuccaccggagagaucugcgccucgcggccaacgcuaucuguuccgccguuccuagccauugggugccgacaucucggaccacaugguccauccacgcuaagcacgaauggaugaccacagaggacaugcugaccgucuggaauagaguguggauucaggagaaccccuggauggaagacaaaacgccuguugagagcugggaagagauccccuaucuuggcaagcgcgaagaucaguggugcggaucccugauuggccucacaucucgggccaccugggcuaaaaauauccaaaccgccauuaaccaggugagaagccugaucgggaaugaggaguacacagacuauaugccuuccaugaagcgguuuagacgcgaagaggaagaggcgggaguccugugguga

SEQ ID NO: 19653 - RNA, 9876 nt, Artificial Sequence
  derived and/or modified CDS sequence (opt5) from DENV-2__EU854294__SS-prME
accgccggcgugaucgucaugcugauucccacagcuauggccuuccaccucacgaccagaaacggggaaccucauaugaucguuggacggcaggaaaagggcaagucccugcuuuuuaagacagaggacggggugaauaugugcacccugauggcgauugaucucggagaacugugugaggacacaaucaccuacaagugcccgcuucugagacaaaacgaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugagguuaagcugaccaucaugacaggcgacaccaaagggauuaugcaggccggaaagcgguaucuuagaccucaacccacggaacucaaauacucuuggaagaccuggggcaaggcgaaaaugcugagcacagagucccauaaccagaccuuccugaucgaugggccugaaacagccgagugccccaauaccaaccgcgcuuggaauagccucgagguggaagacuauggauuuggcgucuucacaaccaacauuuggcugaaacuucgggagaaacaggacguguuuugugauucuaagcugauguccgccgcuaucaaagacaauagagccguucacgcggauaugggcuacuggaucgaaagcgcccucaacgacacguggaagauggagaaggcuucuuucauugaggugaaauccugccacuggccuaagagccauacacuguggucuaaugggguccuggaaagcgagaugaucauucccaaaaacuucgccggaccggugucccagcacaacuaucgcccuggcuaccauacccaaaccgcugggcccuggcaccuuggaaagcucgaaauggauuuugacuucugugagggcacaaccguggucguuacggaagauugcgggaaucggggacccagccugagaacaaccacagccucuggcaaacugaucaccgaguggugcugucgguccugcacacucccuccgcugcgcuacagaggcgaggacggguguugguauggaauggaaauucggccccuuaaggagaaggaagagaaccuggugaauagccucgugaccgccggccaugggcagaucgauaacuuuucccugggaguccugggcauggcucuuuuccucgaagagaugcugagaacgcgcguggggaccaaacacgcgauucugcucguugccgugucuuuugucacacugaucaccggaaauaugagcuuccgggaccuuggcagagugaugguuauggugggcgcuacaaugaccgaugacaucgggaugggagucacguaccuggcccuccuggccgcuuuuaaggugcgcccuacauucgccgcgggccugcuucugagaaaacucaccuccaaggagcugaugauggcuacaauugggaucacccuccugucucagagcaccauucccgaaacaauccuugagcugacggaugcccucgcccugggaaugaugguucugaaaauugugcggaacauggaaaaguaucaacuugcugucaccaucauggccaucuccugcgugccuaaugcggugauucugcgcaacgcuuggaaggucucuuguacaauccucgccgccguuagcgugagcccccugcuccugaccagcucucagcagaaagcugacuggauuccucuugcccugacaaucaagggccucaaucccaccgcuauuuuucugacgacacuguccagaaccagcaaaaagcggucuuggccgcuuaacgaggccaucauggcgguggggauggucuccauccuggccagcucucuccugaaaaaugacauuccuaugaccggaccccucguggcuggcggccugcuuacaguuugcuacgugcugaccgggcgcuccgccgaucuggaacucgagagagcugccgacgucaagugggaggaucaggccgaaaucagcggauccagcccuauucugucuaucacaauuagcgaggacggcuccaugucuaucaaaaacgaagaggaggaacaaacgcuuaccauucugauccggacagggcuccuggugaucagcggaguuuuccccguguccauuccgaucaccgcugcggccugguaucucugggaggucaagaagcagcgcgcuggcgugcugugggaugucccuucucccccucccguggggaaagccgaacuugaggacggagccuacagaauuaagcagcggggcauccugggcuauagccagauuggggcuggaguuuacaaagaaggcacauuucacaccauguggcaugugacgcgcggggccguccugaugcacagaggaaagcggaucgagcccuccugggcggaugugaaaaaggaccucaucucuuacggcgggggauggaagcuggagggcgaauggaaagagggcgaagagguucaagugcuugcucuggaaccugggaagaauccgagagccguccagaccaaacccggaauuuucaagacaaacaccggcacaaucggggccgugagccucgauuuuuccccuggaaccagcggcucucccauuguggaccgcaaagggaagguugucggacuguauggcaauggcguggugacacgguccggggcuuacgucagcgccaucgcgcagacggagaagucuauugaggauaacccugaaaucgaggacgauaucuuccgcaagaagcgccucaccauuauggaccugcaucccggagcuggcaaaacaaagcgguaucuuccugccaucgugagagaagccauuaaacgcgggcugcggacccugauccucgcuccgaccagaguuguggccgcugagauggaagaggcccugcgcggacuucccauucgguaccagaccccugcgaucaaggccgagcacacgggcagagaaauugucgaccugaugugucaugcuaccuucacaaugcggcuccugucccccgugcgcguuccuaacuauaaucucaucaucauggaugaggcccacuuuaccgaccccgcuagcauugccgccagaggguacaucuccacacggguggaaaugggcgaggcugcgggaauuuucaugaccgccacgccgccuggcucucgcgaucccuuuccccaaagcaacgcuccuaucauggacgaggaaagagagauucccgaacgguccuggaauagcgggcacgagugggucacagauuucaagggaaaaaccgugugguuuguuccuucuaucaaggccggcaacgacaucgccgcuugccugcgcaagaaugggaagaaagugauucagcuuucccgcaagaccuucgauagcgaauaugucaagacacgggccaacgacugggauuuuguggugaccacagacaucucugagaugggagcgaauuucaaagcugagagagucauugauccgcgccgguguaugaagcccguuauccugaccgacggcgaagagagagugauucuggccgggccuaugcccgugacgcauagcuccgccgcucagcgccggggcagaaucggacgcaacccuaaaaaugaaaacgaccaauacaucuacaugggcgagccccucgaaaaugaugaggacugcgcccacuggaaggaggcgaaaaugcugcuugauaacauuaauacaccggaagggaucauuccuucuauguuugagcccgaaagagagaaggucgacgccguggauggagaauaucggcugcgcggcgaggcuagaaaaaccuucguugaccucaugcggcgcggggaucugccuguguggcuggccuacaaggucgcugccgagggaaucaacuaugcugacagaaagugguguuuugauggcauuaaaaauaaccagauccucgaagagaacguggaaguugagauuuggacaaaggagggggaacggaagaaacuuaaacccagauggcuggacgcccgcaucuacagcgauccucuggcgcucaaagaguucaaggaguucgccgcuggccggaaaucccugacccuuaaucugaucacggagaugggaagacuccccaccuuuaugacacagaaggcccgcaacgcucuggacaaucuggccgugcuccauaccgccgaagcuggcgggcgggcguauaaccacgcccuuucugagcugccggagacacuggaaacccuccugcuucugacacuccuggcuaccgucacgggaggcauuuuccuguuucucaugagcgggaaaggaaucggcaagaugacacuuggcaugugcugcauuaucaccgccuccgugcugcugugguacgcccagauucaaccucacuggaucgcugccagcaucauucucgaguucuuucugaucguccuucugauucccgaacccgagaaacagagaaccccucaggauaaucagcucacauaugugguuaucgcgauucugaccgugguggccgcuacaauggccaacgaaaugggguuccuggagaagacgaagaaagaccucggacuuggcucuaucaccacacaagaguccgaaagcaauauccuggacauugaucugcggccggcuuccgccuggacccucuacgcggucgccacaaccuuuguuacgcccaugcugcgccauucuaucgagaacagcuccgugaaugugucucuuaccgcuauugccaaccaggcuacaguccugauggggcucggaaagggcuggccucugagcaaaauggacaucggggugccccugcucgccauuggauguuacucccagguuaauccuaucacccuuacagcugcccugcugcuccugguggcgcacuaugccauuaucggccccggccuucaggcuaaggccaccagagaagcucaaaaacgggccgccgcggggaucaugaagaacccuacggucgauggaauuacagugaucgaccuggagccgauucccuacgauccuaaguucgaaaaacagcucggccaggucaugcugcugauccucugcgugacccagguucuuaugaugcgcacaaccugggcucugugugaggcccugacccucgcuacagggcccauuagcacgcugugggagggaaauccuggcagauuuuggaacaccacaaucgccgugucuauggccaauaucuuccggggguccuaucuugcuggagccggccugcucuuuagcauuaugaagaacaccacaaauacccgcagaggcacggggaacaucggagaaacacugggcgagaaauggaagucucggcugaacgcgcucgggaaauccgaguuccaaauuuacaagaaaagcggaauccaggaggucgaccgcacccuugccaaggagggcauuaagagaggggaaaccgaucaucacgcugugucucggggaagcgccaaacugagaugguuuguugagcgcaauauggugacacccgaaggcaaggucguggaccugggcugcgggcggggaggcugguccuauuacugugggggacucaaaaacgugagagagguuaagggccugaccaaagggggaccgggccaugaagaaccuauccccaugucuacauauggcuggaaucuuguccgccugcagagcgggguggauguguucuucacgcccccugagaagugcgacacccuccugugugauaucggagaauccagccccaacccuacaauugaggcuggccggacccugagaguccucaaucuuguugaaaacuggcugaauaacaauacacaauuuugcaucaaggugcugaacccguacaugcccuccgugauugagaaaauggaaacccuccagcgcaaguacgggggagcccugguccggaauccucuuucuagaaacagcacgcacgagauguauuggguguccaaugcgaccggcaacaucguuucuagcgugaauaugauuucccgcaugcugaucaaccgguucacaaugaaacacaagaaagccaccuacgagcccgacgucgaucucgggucuggaacaagaaacaucggcauugaaagcgagaucccuaaucuggacauuaucggcaagcgcauugaaaagaucaaacaggagcaugaaaccuccuggcacuaugaccaggaucaucccuacaagacaugggcuuaucacgggagcuacgagaccaaacaaacgggaucugccuccagcauggugaacggcguugugcggcugcucacaaagccgugggacgucgugccuauggugacccagauggcuaugaccgauacaacgcccuuugggcagcagagagucuucaaagagaagguugacacccgcacacaagaaccuaaggagggaaccaagaaacuuaugagaauuacagccgaauggcuguggaaagagcugggcaaaaagaaaacaccccggauguguacacgcgaggaauuuaccagaaaagugcggucuaaugcugcccucggggcgaucuucacggaugagaacaaguggaaguccgccagagaagcuguggaggacggacgguuuugggaacuggucgaucgcgagagaaaucuucaccuggagggcaaaugcgaaaccuguguguauaacaugaugggcaagcgggagaaaaagcucggggaguucggaaaagccaagggcagccgcgcuaucugguacauguggcugggggccagauuucuggaguucgaagcccucggauuucugaaugaggaccauugguucucucggggcaacucccuuagcgggguugagggcgaaggacugcaccgccucggcuacauucugagagauguggggaagaaagagggaggcgcgauguaugcugacgauacagccgggugggacacccggaucacacuugaagaccugaagaaugaggaaauggucaccaaccauaugaaaggagagcacaagaaacucgccgaggcuauuuuuaagcugacguaccagaauaaggugguucgcgugcagagaccuacaccccggggcaccgucauggauaucauuucccgcagagaccagcgggggagcggccaagugggaacauauggccugaacaccuucacgaauauggaagcccagcucauccgccagauggagggggaaggaaucuucaaaucuauucaacaucugaccgcuacagaggagaucgccgcgcagaacuggcuugccagaguuggccgggaaagacugagccgcauggcuauuuccggggaugacugcguggucaagccgaucgaugaccgguuugccucugcucucaccgcccugaaugauaugggaaaagugagaaaggacauucagcagugggagccuagccgcggcuggaacgauuggacacaaguccccuucugcucccaccacuuucaugaacuugugaugaaagacgggcggguucuggugguccccuguagaaaccaggaugagcucaucggccgcgcgcggaucucucagggagccggcuggagccugaaggaaaccgcuugccuggggaaguccuacgcccagauguggacacucauguauuuccacagacgcgaccugcggcuugcugccaaugcuauuuguucugccgugccuagccauugggugccgaccuccagaacgacauggagcauccacgcgaaacacgaguggaugaccaccgaggauaugcuggccguuuggaaccgcguguggauucaagaaaaucccuggauggaggacaagacaccugucgaaucuugggaggaagugcccuaccucggaaaacgggaggaccaguggugcggcucccugaucgggcuuaccagcagagcuacaugggccaagaacauucagacggccaucaaucagguucggucucugauuggaaacgaggaauauaccgauuacaugccuuccaugaaaagauuucgccgggaggaagaggaagcuggcgugcucugguga

SEQ ID NO: 19654 - RNA, 9876 nt, Artificial Sequence
  derived and/or modified CDS sequence (opt5) from DENV-2__FJ024477__SS-prME
acagccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauagcacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgccacacgccuugagaaucugauguggaaacagaucaccccggagcucaaccacauucuguccgaaaaugaggucaagcugacaaucaugaccggcgacauuaaagggaucaugcaggcgggaaagcggucucuuagaccucaacccacggaacucaaauauagcuggaagaccuggggcaaggccaaaaugcuguccacagagagccauaaccagaccuuccugauugaugggccugaaacagcugagugccccaauaccaaccgcgccuggaacucucucgagguggaagacuacggauuuggcguuuucacaaccaacaucuggcugaaacuucgggagaaacaggacguguuuugugauuccaagcugaugagcgcugccaucaaagacaauagagcgguccacgccgauaugggcuauuggauugaaucugcucucaacgacacguggaagauggagaaggccuccuucaucgaggugaaaagcugccacuggccuaagucucauacacuguggagcaaugggguucuggaauccgagaugauuauccccaaaaacuucgcuggaccggugagccagcacaacuaccgcccuggcuaucauacccaaaccgccgggcccuggcaccuuggaaagcucgaaauggauuuugacuucugugagggcacaaccgucguggugacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggucaauucccucguuaccgcuggccaugggcagauugauaacuuuucucugggagugcugggcauggcgcuuuuccucgaagagaugcugagaacgcgcguggggaccaaacacgccauccugcucgcugccgucagcuuugugacacugaucaccggaaauauguccuuccgggaccuuggcagaguuauggugauggucggcgccacaaugaccgaugacauugggaugggagugacguaucuggcucuccuggccgcguuuaagguucgcccuacauucgcugccggccugcuucugagaaaacucaccucuaaggagcugaugauggccacaaucgggauugcucuccugagccaguccaccauccccgaaaccauucuugagcugacagaugcccucgcgcugggaaugauggugcugaaaaucguccggaacauggaaaaguaccaacuugcugugacgaucauggccauuucuugcguuccuaaugccgugauccugcagaacgcuuggaaggucagcuguaccauucucgccgugguguccgucagcccccugcuccugacaucuucccagcagaaagcugacuggaucccucuugcccugaccauuaagggccucaaucccacagcgaucuuucugaccacgcugagccgcacaucuaaaaagagauccuggccgcuuaacgaggccaucauggcuguugggauggugagcauucuggccucuucccuccugaaaaaugacaucccuaugaccggaccccucguggcuggcggccugcuuaccgucugcuaugugcugacagggcggagcgccgaucuggaacucgagcgcgccgcugacguuaagugggaggaucaagcggaaauuuccggaagcucuccuauccugagcauuaccaucuccgaggacggcucuaugagcauuaaaaacgaagaggaggaacagacacuuacgauccugaucagaaccgggcuccuggugauuuccggagucuuccccgugucuaucccgauuacagccgcugccugguaccucugggagguuaagaagcagcgggccggcgugcugugggaugucccuucucccccucccguggggaaagcugaacuugaggacggagccuaucgcaucaagcagagaggcauucugggcuacucccaaaucggggcgggagucuauaaagaaggcaccuuucacacaauguggcaugugaccagaggggcuguucugaugcaccgcggaaagagaaucgagcccuccugggccgaugugaaaaaggaccucauuagcuacggcgggggauggaagcuggagggcgaauggaaagagggcgaagagguccaggugcuugcccuggaaccugggaagaauccgcgggcuguucagacgaaacccggaaucuucaagaccaacacaggcaccauuggggccgugucccucgauuuuagcccuggaacaucuggcucccccaucgucgacagaaaagggaagguggugggacuguacggcaauggcguugucacccgcagcggggcguaugugucugcuauugcccagacagagaaguccaucgaggauaacccugaaaucgaggacgauauuuuccggaaaaagagacucacgaucauggaccugcaucccggagccggcaaaaccaagcgcuaccuuccugcuauugugcgggaagccaucaaaagagggcugcgcacacugauucucgcuccgacccgggucguggccgcggagauggaagaggcccugagaggacuucccauccgcuaucaaaccccugcuauuaaggccgagcacacaggccgggaaaucguugaccugaugugucaugcuacguucaccaugagacuccugagccccgugcgggucccuaacuacaaucucaucauuauggaugaggcccacuuuacagaccccgccuccaucgcugcgcgcggguauauuucuaccagaguggaaaugggcgaggccgcuggaaucuucaugacagccaccccgccuggcagccgggaucccuuuccccaguccaacgccccuauuauggacgaggaacgcgagauccccgaaagaagcuggaacucugggcacgaguggguuacggauuucaagggaaaaacagugugguuugucccuuccaucaaggcuggcaacgacauugccgcgugccugcggaaaaaugggaagaaagugauccagcuuagcagaaagaccuucgauucugaauacguuaagacccgcgcuaacgacugggauuuuguggucacaaccgacauuagcgagaugggagccaauuucaaagccgagcgggugaucgauccgagacgcuguaugaagcccgugauucugacagacggcgaagaacgggucauccuggcugggccuaugcccguuacccauuccucugccgcgcaaagacgcggccggaucggaagaaacccuaaaaaugaaaacgaccaguauauuuacaugggcgagccccucgaaaaugaugaggacugcgcccacuggaaggaggcuaaaaugcugcuugauaacaucaauacgccggaagggauuaucccuagcauguuugagcccgaacgcgagaagguggacgccauugauggagaauacagacugcggggcgaggcucgcaaaacauucguggaccucaugagaagaggggaucugccugucuggcuggccuauaagguggcugccgagggaaucaacuacgcggaccgcaagugguguuuugauggcauuaaaaauaaccagauccucgaagagaacguugaaguggagaucuggaccaaggagggggaacgcaagaaacuuaaaccccgguggcuggacgccagaauuuauuccgauccucuggcucucaaggaguucaaggaguucgccgcuggccgcaaaucucugacacuuaaucugaucaccgagaugggacggcuccccacguuuaugacccagaaggccagaaacgcccuggacaaucuggcuguccuccauacagcggaagccggcgggcgcgcuuacaaccacgcccuuagcgagcugccggagacccuggaaacacuccugcuucugacccuccuggccacagugaccggaggcauuuuccuguuucucauguccgggaaaggaaucggcaagaugacgcuuggcaugugcugcauuaucacagcuagcguucugcugugguaugcccaaauccagccucacuggauugcggccucuaucauucucgaguucuuucugaucgugcuucugauucccgaacccgagaaacagcggaccccucaggauaaucaacucaccuacgucgugaucgcuauccugacagucguggccgcuaccauggccaacgaaaugggguuccuggagaagacaaagaaagaccucggacuuggcuccauuacgacccaggagagcgaauccaauauccuggacauugaucugagaccggcgucugccuggacacucuaugcuguugccaccacauuugugacccccaugcugcggcauagcaucgagaacuccucugugaaugucagccuuacggcuauugccaaccaggcuaccguucugauggggcucggaaagggcuggccucuguccaaaauggacaucggggugccccugcucgccauuggauguuacagccaggugaauccuaucacacuuaccgcggcccugcugcuccuggucgcucacuacgccaucauuggccccggccuucaagcuaaggccacacgcgaagcccagaaaagagcggcugccgggaucaugaagaacccuaccguggauggaauuacgguuaucgaccuggagccgauucccuaugauccuaaguucgaaaaacagcucggccaggugaugcugcugauccucugcgucacacaagugcuuaugaugcggaccacaugggcucugugugaggcccugacccucgccaccgggcccaucucuacacugugggagggaaauccuggccgcuuuuggaacacgaccauugcugucuccauggccaauaucuucagagggagcuaccuugcgggagccggccugcucuuuucuauuaugaagaacacaaccaauacacggcgcggcaccgggaacaucggagaaacgcugggcgagaaauggaaguccagacugaacgcucucgggaaaagcgaguuccagauuuauaagaaaucuggaauccaggagguggaccggacacuugccaaggagggcaucaagcgcggggaaaccgaucaucacgcuguuagcagaggauccgccaaacugcggugguuuguggagagaaauauggucacccccgaaggcaaggugguugaccugggcugcgggcgcggaggcuggucuuacuauugugggggacucaaaaacgugcgggaggucaagggccugacaaaagggggaccgggccaugaagaaccuauucccaugagcaccuacggcuggaaucuugugagacugcaauccgggguggauguuuucuucacacccccugagaagugcgacacgcuccugugugauaucggagaaagcucccccaacccuaccauugaggcgggccgcacacugcggguccucaaucuuguggaaaacuggcugaauaacaauacccaguuuugcaucaaggugcugaacccguauaugcccucugucauugagaaaauggaaacacuccagagaaaguacgggggagcccugguucgcaauccucuuagccggaacuccacccacgagauguacugggugucuaaugcuacgggcaacaucgugagcuccgucaauaugaucucuagaaugcugauuaaccgcuucaccaugaaacacaagaaagccacauaugagcccgacguggaucucgggagcggaacccggaacaucggcauugaauccgagaucccuaaucuggacauuaucggcaagagaauugaaaagaucaaacaggagcaugaaacaagcuggcacuacgaccaagaucaucccuauaagaccugggcuuaccacgggucuuaugagacaaaacagaccggauccgccagcucuaugguuaacggcgugguccgccugcucacgaagccgugggacgugguuccuauggugacacagauggcuaugaccgauaccacacccuuugggcagcaacgggucuucaaagagaagguggacacgagaacccaggaaccuaaggagggaaccaagaaacuuaugaaaaucaccgccgaauggcuguggaaggagcugggcaaaaagaaaacaccccgcauguguaccagagaggaauuuacacggaaggugcgcuccaaugcggcccucggggcuauuuucaccgaugagaacaaguggaaaagcgccagagaagcugucgaggacggacgguuuugggaacugguugauagagagcggaaucuucaccuggagggcaagugcgaaacguguguguacaacaugaugggcaaacgcgagaagaaacucggggaguucggaaaggccaagggcucuagagccaucugguauauguggcugggggcgcgguuucuggaguucgaagcucucggauuucugaaugaggaccauugguucucccgcggcaacagccuuuccgggguggagggcgaaggacugcacagacucggcuacauucugcgggaugucagcaaaaaggaagggggagccauguacgccgacgauaccgcuggcugggacacacgcaucacccuugaagaccugaaaaaugaggaaauggugacaaaccauaugaagggggagcacaaaaagcucgccgaggcuauuuuuaagcugaccuaucagaauaaaguugugagaguccagcggccuacgccccgcggaacagugauggauaucaucucuagacgggaccaacgcggcagcgggcagguuggcaccuacggacugaacacauucaccaauauggaagcccagcucauuagacaaauggagggcgaagggaucuucaaguccauucagcaucugacggcgaccgaggagaucgccgugcagaacuggcuugcucgggucggacgcgaaagacugucucggauggccauuagcggcgaugacugcgugguuaaaccgaucgaugacagauuugcuuccgcccucacagcgcugaaugauauggggaaggugcgcaaagacauccagcaaugggagccuucucggggauggaacgauuggacccagguccccuucugcagccaccacuuucaugaacuugugaugaaggacggcagaguccuggugguucccugucgcaaccaggaugagcucauugggcgggccagaaucucccagggcgcuggauggucucugaaggaaacagccugccugggcaaaagcuaugcucaaauguggacccucauguacuuccaccgccgggaccugagacuugccgcuaaugccauuuguuccgcggugccuagccauugggucccgacaucucgcaccacgugguccauccacgccaagcacgaguggaugacaaccgaggauaugcuggcuguguggaaccggguguggauucaggaaaaucccuggauggaggacaaaaccccuguugaaagcugggaggaagugcccuaucucgggaagagagaggaccaguggugcggaucucugaucggccuuacaucccgcgccaccugggccaaaaacauucagacagcuaucaaucaaguccggagccugaucgggaacgaggaauacacggauuauaugccuuccaugaagagauuucggagagaggaagaggaagccggagugcucugguga

SEQ ID NO: 19655 - RNA, 9876 nt, Artificial Sequence
  derived and/or modified CDS sequence (opt5) from DENV-2__GQ868552__SS-prME
accgcgggcgugaucauuaugcugauccccacagcuauggccuuccaccucacgaccagaaauggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugagacaaaacgaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucgccaucauggcugccauucucgcuuacacaaucggaaccacccacuuucagagagcccugauuuucauccuucugacagcgguggccccuagcaugacgaugcggugcauuggcaucuccaaccgcgauuuugucgaaggggugucuggaggcagcuggguugacaucgugcucgagcacggguccugugucaccacaauggcuaagaauaagcccacccuggauuucgaacuuauuaaaacagaggccaagcagccugcuacccugagaaaauauugcaucgaagccaagcucacgaacacaaccaccgagagccgguguccgacacaaggagagcccucucugaaugaagaacaggacaaacgcuuuauuugcaagcauuccaugguggauagaggcuggggcaacggguguggacuguucggcaaaggcgggaucgugaccugcgcgauguuuacaugcaaaaagaauauggaagggaaagucguucucccugagaaccuggaauacacgauugugaucacaccccacagcggggaggagcaugccgugggaaaugacacaggcaagcacggcaaagaaaucaagauuaccccucagucuuccaucacagaggcugaacuuaccggguauggaacggucaccauggaguguagcccccggacaggccuggauuucaacgaaauggugcuccugcagauggaggagaaagccuggcuuguucaccgccaaugguuucuggaccucccgcugccuuggcugcccggggcugauacccagggaucuaauuggauucagaaggaaacacucgugaccuucaagaacccucaugccaaaaagcaggacgucgugguucugggcucccaagagggggccaugcacacggcucuuacaggcgcgaccgaaauccagaugagcuccggaaaucugcucuuuacaggccaucugaaaugcagacuucggauggacaagcugcagcucaaagggaugucuuacagcauguguaccggaaaguucaagauugugaaagagaucgccgagacccaacacggcacaaucgucauuagagugcaguaugaaggggauggaucccccugcaagauccccuucgagauuauggaccuggaaaaacgccauguccugggccggcucaucacggugaacccuauuguuaccgagaaggauagcccggugaacaucgaagcugagcccccuuuuggggacucuuacauuaucaucggcgucgagcccggacagcugaaacuuaauugguucaagaagggcuccagcauugggcagauguuugaaacaaccaugagaggagccaaacgcauggccauccugggcgauacagcuugggacuucgggucucucggaggcguguuuaccagcauugggaaggcccugcaccaaguuuucggcgcgaucuacggagcugccuuuuccggcgugucuuggacgaugaaaauucugaucggggucaucauuacauggaucggaaugaacagccgguccaccagccuuucugugucccucgugcugguuggcgucgugacccuguaucucggggccauggugcaggcugauagcggaugugucgugucuuggaagaauaaagagcugaagugcggcuccgggauuuucaucacagacaacguucacaccuggacagaacaguacaaguuucagccugagagccccuccaaacuugccucugcuauucaaaaggcccaugaagagggcaucuguggaaucagaagcgugacgcgccuggagaaucucauguggaaacagauuaccccggaacugaaccacauccuguccgagaaugaagucaaacuuacaauuaugaccggcgauaucaaagggauuaugcaggcgggaaagcggucucucagaccucagcccacagagcugaaauauagcuggaagaccuggggcaaggccaaaaugcuguccacggaaagccauaaccaaaccuuccucaucgacgggccugagacagcugagugccccaauaccaaccgcgccuggaacucucuggaaguggaggauuacggauuuggcguuuucacaaccaacaucuggcuuaagcugcgggaaaaacaggacguguuuugugacuccaagcucaugagcgcugccauuaaagauaauagagcgguccacgccgacaugggcuauuggaucgagucugcucugaacgauacauggaagauggagaaggccuccuucauugaagugaaaagcugccacuggccuaagucucauacccuguggagcaaugggguucuugaguccgaaaugaucauucccaaaaacuucgcuggaccggugagccagcacaacuaccgcccuggcuaucauacgcagacagccgggcccuggcaccucggaaagcuggagauggacuuugauuucugugaaggcaccaccgucguggugacagaggacugcgggaaucggggacccucucugagaaccacgacagccuccggcaaacucaucaccgaguggugcugucggagcugcacacugccuccgcuucgcuacagaggcgaagauggguguugguacggaauggagauucggccccugaaggaaaaggaggaaaaccucgucaauucccugguuaccgcuggccaugggcaaaucgacaacuuuucucugggagugcuuggcaucgcccucuuccuggaggagaugcugagaacacgcguggggaccaaacacgccauucuccuggucgcuaucagcuuugugacgcuuauuaccggaaauauguccuuccgggaucugggcagaguuauggugauggucggcgccacaaugaccgacgauaucgggaugggagugacauaucucgcccugcuggcugccuuuaagguucgcccuaccuucgcggcuggccuucugcucagacggcugacgucuaaagaacucaugauggccacaauugggaucgcccugcuuagccaguccaccauccccgagacaauucuggaacucaccgacgcucuggcccugggaaugauggugcuuaagaucguccgcaacauggagaaauaccagcuggcggugaccauuauggcuaucucuugcguuccuaaugccgugauucuccugaacgccuggaaggucagcuguacaauccucgcugccguguccgugagcccccugcuucugacgucuucccaacagaaggcugauuggaucccucucgcccugaccauuaaaggccugaaucccacagcgaucuuucuuaccacacugagcagaaccucuaagaaacgguccuggccgcucaacgaagccgucauggcuguugggauggugagcauucuggccucuucccuccugaagaaugacaucccuaugacgggaccccuuguggcuggcggccugcugacagucugcuaugugcucaccgggcgcagcgccgaccuggagcuugagagagccgcugauguuaaaugggaagaccacgcggagauuuccggaagcucuccuauccugagcauuaccaucuccgaagauggcucuaugagcaucaagaacgaggaggaagaacagacacucaccauucugauccggacagggcuccuggugauuuccggagucuuccccgugucuaucccgauuacggccgcugccugguaccuuugggaaguuaaaaagcagcgcgccggcgugcugugggacgucccuucucccccucccguggagaaggcugaacuggaggauggggccuauagaaucaaacaacggggaauccucggcuacucccagauuggcgcgggggucuauaaggagggaaccuuucauacaauguggcacgugacccgcggcgcuguucugaugcauagagggaaacggaucgaacccuccugggccgacgugaagaaagaucuuauuagcuacggaggcggguggaagcuggagggagaauggaaggagggcgaagagguccaggugcucgcccuggagccuggcaaaaauccgagagcuguucagacaaagcccggacucuucaaaaccaacacgggaaccaucggcgccgugucccuggacuuuagcccugggacaucuggaucccccauugucgaucgcaagggcaaagugguggggcuuuacggaaauggcguugucacccggagcggcgcguaugugucugcuaucgcccaaacagaaaaguccaucgagaacaacccugaaauugaggacgauaucuucagaaagaaacgccugaccauuauggaccugcaccccggggccggaaagacaaaacgguaccucccugcuaucgugagagaagccauuaagcgcggccugcggacgcuuauccuggcuccgaccagagucguggccgcggagauggaggaagcccuccgcgggcugcccauucgguaucagaccccugcuaucagagccgagcauaccggacgggaaaucguugaucucaugugucacgcuaccuucacaaugcgccugcuuagccccgugagagucccuaauuacaaccugauuaucauggacgaggcccacuuuacggaccccgccuccauugcugcgcggggcuauaucucuacccgcguggagaugggggaagccgcuggcauuuucaugacagccaccccgccuggaagcagagaucccuuuccccaguccaaugccccuaucauggacgaggaacgggagauccccgaaagaagcuggaacucuggccaugaguggguuacagauuucaaagggaagaccgugugguuugucccuuccauuaaggcuggaaaugacaucgccgcgugccugcgcaaaaacggcaagaaagugauucagcucagccggaagacguucgauucugaguacguuaaaacaagagcuaaugacugggauuuuguggucaccaccgacaucagcgaaaugggggccaacuuccgcgccgagcgggugauugauccgagacgcuguaugaagcccgugauccugacagacggagaagaacgggucauccuugcuggcccuaugcccguuacccacuccucugccgcgcaaagacgcgggagaauuggccggaauccuaagaacgaaaaugaucaguauaucuacaugggagagccccuggagaacgacgaagacugcgcccauuggaaagaggcuaagaugcuccuggauaauauuaacacaccggaaggcaucauuccuagcauguuugagcccgaacgcgagaaaguggacgccaucgauggggaguacagacugcggggagaagcucgcaagaccuucguggaccucaugagacggggcgaucuuccugucuggcuggccuauagaguggcugccgaggggauuaauuacgcggaccgccggugguguuuugauggaaucaaaaacaaccagauccuggaagagaauguugagguggaaauuuggacgaaggagggcgaacgcaagaagcucaagccccgcuggcuggacgcccggaucuauuccgauccucuugcucugaaagaguucaaggaguucgccgcugggagaaaaucucucacacugaaccugauuaccgagaugggccggcuccccacauuuaugacccaaaaggcccgcgacgcccuugauaaucugagcguccugcacacggcugaggcgggaggcagagccuacaaccacgcucucuccgaacugccggagacccuugaaacacugcuccugcugacccuccuugccacagugaccgggggaaucuuccuguuucugaugagcggcaaagggauuggaaagaugacacucggcaugugcugcaucaucaccgccucuauucugcuuugguaugcucagauccagccucauuggauugccgcguccaucauucuggaguucuuucucaucguucugcugauccccgaacccgagaagcagcggacgccucaagacaaucagcucacauacguggucauugccauccuuaccguggucgcugccaccauggcuaacgagaugggcuuccuggagaagacaaagaaagaucuggggcucggaagcauuaccacacaggagccggaauccaauauccuggacauugaccuucgccccgccucugcguggacgcuguaugccguggcuaccacauuuguuaccccuaugcucagacacagcaucgagaacuccucugugaaugugagccugacagccauugcuaaccaggccaccguccugaugggccucgggaagggauggccccuuuccaaaauggauaucggcguuccucugcuggcuaucggguguuacagccaagugaaucccauuacgcucaccgccgcgcugcuucugcucguggcccauuacgcuaucauuggaccuggccugcaggccaaggcuacacgggaagcccagaagcgcgccgcggcuggcaucaugaaaaacccgaccgucgacgggauuacagugaucgaucuggagcccaucccuuaugaccccaaguucgagaaacagcucggacaaguuaugcuucugauucugugcgugacccagguccucaugaugagaacgacaugggcccugugugaagcucuuacccuggccacaggcccuaucucuacccucugggaggggaaucccggacgguuuuggaacaccacaauugccguguccauggcuaauaucuuccgcggcagcuaccuggccggggcgggacugcucuuuucuauuaugaagaacacgaccaauacaagacggggcaccggcaacaucggggaaacacuuggagagaaauggaaguccagacugaacgcccugggcaagagcgaguuccagaucuauaaaaagucugggauucaggaagucgaucgcacccucgcuaaagagggaaucaagcggggcgaaacggaccaccaugccgugagcagaggguccgcuaaacugcgcugguuuguugagcggaauauggugacaccggaaggaaaggucguggaucuuggcugcggcagagggggauggucuuacuauuguggcgggcugaaaaacguucgcgaggugaagggacucaccaagggcgggccuggacacgaggaacccauucccaugagcaccuacggcuggaaucugguccggcugcaauccggcguggacguguucuucacaccucccgagaaaugcgauacccuccuuugugacaucggggaaagcuccccuaacccgacaauugaggccggaagaacgcugcgcguucugaaucucgucgaaaacuggcugaauaacaauacccaguuuugcaucaaggugcuuaaccccuauaugccuucugugaucgagaaaauggagacacugcagcggaaguacggcggggcgcucgucagaaauccccugagccgcaacuccacccacgaaauguacuggguuucuaaugccacaggaaacauugugagcuccgugaauaugaucucucggaugcugauuaacagauucaccaugaaacauaagaaggcuacguaugagccugaugucgaccucggcagcgggacccgcaacaucggaauugaauccgagauccccaaucuugauauuaucggcaaaagaaucgaaaagauuaaacaagagcacgagacaagcuggcauuacgaccaggaccacccguauaagaccugggccuaccacggcucuuaugaaacaaaacagaccggguccgcuagcucuauggugaacggaguugugcggcugcugacaaagccuugggaugucgugcccaugguuacccagauggccaugacggacacaaccccuuuuggccaacagcgcguguucaaggagaaagucgauaccagaacacaggaacccaaggaggggacgaaaaagcucaugaaaaucaccgcugaguggcuguggaaggaacuuggaaagaaaaagacaccucggauguguaccagagaggaauuuacacggaaagugcgcuccaaugccgcgcugggcgccauuuucaccgacgagaacaaguggaaaagcgcuagagaagccguggaggauucucgguuuugggagcucgucgaccgcgaaagaaaucugcaucuggaggggaagugcgaaacauguguuuacaacaugaugggaaaacgggagaagaagcucggcgaguucggcaaagcuaaggggucccgcgccaucugguauauguggcugggagccagauuucuugaguucgaggcgcugggcuuucucaaugaagaucacugguucagccgggggaacucccugagcggaguggagggcgaagggcuucaucgccugggcuacauucucagagacgugucuaaaaaggagggaggcgcuauguacgccgaugacaccgccgggugggauacgcggaucacccuggaagaccugaaaaaugaggagauggucacaaaccacaugaagggagaacauaagaaacucgcugaggccaucuuuaagcugaccuaucagaauaaagugguucgcgugcaaagacccacaccgcggggcaccgucauggacauuaucagccgcagagaucagcggggguccggacaggugggcacguacgggcuuaacacauucaccaauauggaagcucagcugauuagacaaauggagggcgagggaaucuucaagucuauucagcaccucacaguuaccgaagagaucgccgugcagaacuggcuggcgcgcgucggccgggaaagacuuagccgcauggccaucuccggggacgauugcgugguuaaaccucuggacgaucgguuugcuucugcccucacggcucugaaugacaugggaaaggugagaaaggauauucaacagugggagcccagccgcggcuggaacgacuggacccagguccccuucugcucccaccauuuucacgaacuggugaugaaagaugggcggguccucgugguuccuuguagaaaccaggacgagcugaucggacgcgcccggauuucucaaggcgcgggguggagccuuaaggagacagccugccugggcaaauccuaugcucagauguggacccucauguacuuccauagacgcgaucugcggcuugccgcuaaugccaucuguagcgcugugccgucucacuggguccccacauccagaaccacauggagcauucacgccaagcaugaauggaugaccacggaggacaugcuggcgguguggaaccggguguggauccaggaaaauccuuggauggaggauaaaacacccguugaaucuugggaggaggugccuuaucucggaaagagagaagaccaguggugcggcucccugauugggcugaccagccgcgccaccugggcuaagaacauccaaacagccaucaaucagguccggucccucauuggaaacgaggaauacaccgacuauaugcccucuaugaaaagauuucgcagagaggaagaggaggccggcgugcugugguga

SEQ ID NO: 19656 - RNA, 9876 nt, Artificial Sequence
  derived and/or modified CDS sequence (opt5) from DENV-2__GQ868553__SS-prME
accgccggcgugaucgucaugcugauucccacagcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacaggugaccccggagcucaaccacauccuguccgaaaaugagguuaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuaucaaagacaauagagccguucacgcggauaugggcuauuggaucgaaucugcccucaacgacacguggaagauggagaaggcuuccuucauugaggugaaaagcugccacuggccuaagucucauacacuguggagcaaugggguccuggaauccgagaugaucauucccaaaaacuucgccggaccggugagccagcacaacuaccgcccuggcuaucauacccaaaccguggggcccuggcaccuuggaaagcucgaaauggauuuugacuucugugagggcacaaccgucguugugacggaagauugcgggaaucggggacccucucugagaacaaccacagcuuccggcaaacugaucaccgaguggugcugucggagcugcacacucccuccgcugcgcuacagaggcgaggacggguguugguacggaauggaaauucggccccuuaaggagaaggaagagaaccuggugaauagccucgucaccgccggccaugggcagaucgauaacuuuucucugggagugcugggcauggcccuuuuccucgaagagaugcugagaacgcgcguugggaccaaacacgcuauucugcucguggcggucagcuuugugacacugaucaccggaaauauguccuuccgggaccuuggcagaguuauggugauggucggcgccacaaugaccgaugacaucgggaugggagugacguaucuggcucuccuggccgccuuuaagguucgcccuacauucgcugccggccugcuucugagaaaacucaccucuaaggagcugaugauggcgacaauugggaucgcucuccugagccaguccaccauucccgaaaccaucuuugagcuuacagaugcccuggcccucggaaugauggugcugaaaauuguccggaacauggaaaaguaccaacuggcugugacgaucauggccaucucuugcgugccuaaugcggucauucuucagaacgcuuggaagguuagcuguaccauccuggccgccguguccgugagcccccuccugcucacaucuucccagcagaaagcugacuggauuccucuggcccuuaccaucaagggccugaaucccacagcuauuuuccucaccacgcugagccgcacaucuaaaaagagauccuggccgcugaacgaggccaucauggcggucgggauggugagcauccuugccucuucccugcucaaaaaugacauuccuaugaccggaccccugguugcuggcggccuccugaccgugugcuauguccuuacagggcggagcgccgaucuggaacuggagcgcgcugccgacgugaagugggaggaucaagccgaaaucuccggaagcucuccuauucucagcaucaccauuuccgaggacggcucuaugagcaucaaaaacgaagaggaggaacagauucugacaauccuuaucagaacggggcugcucguuauuuccggaguguuucccgucucuaucccgauuaccgcugcggccugguaccugugggaggugaagaagcagcgggcuggcguccucugggaugugccuucucccccucccguugaaaaagccgagcuggaagacggggccuaucgcaucaagcagagagggauucuuggcuacucccaaaucggcgcugggguguauaaagagggaacauuccacaccauguggcaugucacacggggcgccgugcugaugcaccgcgggaagagaaucgagcccuccugggcggauguuaaaaaggaccugauuagcuacggaggcggguggaagcucgaaggagaguggaaagaaggcgaggaagugcagguccuggcucuugagccuggcaagaauccgcgggccgugcagaccaaacccgggaucuuuagaacgaacaccggaacaauuggcgccgugucccuggauuucagcccugggaccucuggaucccccaucguugaccgcaagggcaaagucguggggcucuacggaaauggcguggucacacggagcggcgcuuaugugucugccauugcgcagaccgagaaguccaucgaagauaacccugagaucgaagacgauauuuucagaaagaaacgccugacaaucauggaccuccaucccggggcuggaaagacgaaacgguaccugccugccauuguuagagaggccaucaagcgcggccuucggacccugauucuggcuccgacaagaguggucgccgcugaaauggaggaggcccuccgcgggcugcccauccgguaucaaaccccugcgauuaaagccgaacacaccggaagagagaucguggaccuuaugugucaugcuacauuuacgaugcggcugcucagccccguucgcgugccuaacuacaaucugaucauuauggaugaagcccacuucaccgaccccgcuuccaucgccgccagaggcuauauuucuacacgggucgagaugggggaggcugcgggcaucuuuaugaccgccacaccgccuggaagccgcgaucccuucccccaguccaacgcuccuauuauggacgaagagagagaaauccccgagcggagcuggaacucuggccacgaaugggugaccgauuuuaaggggaagacgguuugguucgugccuuccaucaaagccggaaacgacauugccgcuugccucagaaagaauggcaaaaaggucauccagcugagccgcaaaacauuugauucugaguacgugaagacccgggccaacgacugggauuucguggucaccacagacauuagcgagaugggggcgaauuuuaaggcugaaagaguuaucgauccgcgccgguguaugaaacccgugauucuuaccgacggagaggaaagagugauccuggccggcccuaugcccgucacacauuccucugccgcucaacgccgggggagaaucggccgcaacccuaagaaugagaacgaccaguauauuuacaugggagaaccccuggagaaugaugaggacugcgcccacuggaaagaagcgaagaugcuccuggauaacaucaauaccccggagggcauuaucccuagcauguucgaacccgagagagaaaaaguggacgccauugauggggaguaccggcuucgcggagaggcuagaaagacguuuguugaccugaugcggcgcggcgaucucccuguguggcuggccuauaaagucgcugccgaagggaucaacuacgcugacagaaagugguguuucgauggaauuaagaauaaccagauccuggaggaaaacguggagguugagaucuggacaaaagaaggcgagcggaagaaacucaagcccagauggcuugacgcccgcauuuauuccgauccucuggcgcugaaagaguucaaggaguuugccgcugggcggaagucucucacccugaaucuuaucacagaaaugggcagacugcccaccuucaugacgcagaaagcccgcaacgcucucgacaaucuggccgugcugcauaccgccgaggcuggaggccgggcguacaaccacgcccucagcgagcuuccggaaacacuggagacccugcuccugcuuacacugcucgcuaccgucacagggggaauuuuucuguuccugauguccggcaaggggaucggaaaaaugacccucggcaugugcugcauuaucacggccagcauccuucugugguaugcccaaauucagccucacuggaucgcugccucuauuauccuggaauuuuuccucauugugcugcuuauccccgagcccgaaaagcagagaacaccucaggauaaucaacugaccuacgucgugaucgcgauucucaccguuguggccgcuacaauggccaacgagaugggcuuucuggagaaaaccaagaaggaccuggggcucggauccaucacaacgcaggaaagcgaguccaauauucuugacaucgaucugcggccggcuucugccuggacccuguaugcgguggccacaaccuucgucacacccaugcuccgccauagcauugaaaacuccucuguuaaugugagccugaccgcuaucgccaaccaggcuacggugcuuaugggccuggggaaaggauggccucucuccaagauggacauuggcgucccccugcuggccaucggguguuacagccaggugaauccuaucacccucacagcugcccuucugcugcucguugcgcacuacgccauuaucggacccggccugcaagcuaaagccaccagagaggcucagaagcgggccgccgcgggcauuaugaaaaacccuacaguggaugggaucaccgucauugaccuugaaccgauccccuaugauccuaaguuugagaagcagcugggacaggugaugcuccugauccugugcgucacgcaagugcucaugaugcgcacaaccugggcucuuugugaggcccugacacuggcuaccggccccauuucuacccucugggaagggaauccuggaagauucuggaacacaacgaucgccguuuccauggccaauauuuuucggggcagcuaccuggcuggggccggacuucuguucucuaucaugaaaaacaccacaaauacccgcagaggcacaggcaacauuggggagacccucggagaaaaguggaaaucccggcugaacgcgcugggcaagagcgaguuucagaucuauaaaaagucugggauccaggagguggaccgcacgcucgccaaagaaggaauuaagagaggcgagacagaucaucacgcugucagccggggguccgccaaacuuagaugguucguggaacgcaauaugguuacccccgagggaaaaguggucgaccugggcugcggccggggaggauggucuuacuauuguggcgggcugaagaacgugagagaagugaaaggacucaccaagggcgggccgggacaugaggagccuauccccaugagcacauacggcuggaaucugguucgccuucaauccggcgucgauguguucuuuacacccccugaaaaaugcgacacccugcucugugauauuggggagagcucccccaacccuacgaucgaagcuggacggacccugagagugcugaaucucgucgagaacuggcuuaauaacaauacacaguucugcauuaagguucugaacccguauaugcccucugugaucgaaaagauggagacccugcagcgcaaauacggcggggcccucgugcggaauccucugagcagaaacuccacacacgagauguacugggucucuaaugcgaccggaaacaucgugagcuccguuaauaugauuucucgcaugcuuaucaaccgguuuacgaugaagcacaaaaaggccaccuaugaacccgacguggaucugggcagcgggacaagaaacauuggaaucgaguccgaaauuccuaaucucgacaucauuggcaaacgcaucgagaagaucaagcaggaacaugagaccagcuggcacuacgaccaagaucaucccuauaaaacaugggcuuaccacggcucuuaugagaccaagcagacaggguccgccagcucuauggucaacggagugguucggcugcugaccaaaccgugggacguggucccuauggugacgcagauggcuaugacagauaccacccccuucggccagcaaagaguguuuaaggaaaaagucgacacacgcacgcaggagccuaaggaagggaccaagaaacucaugaagauuacagccgaguggcuuuggaaagagcugggaaagaaaaagacccccagaauguguacacgggaagaguucacccgcaaaguuagauccaaugcugcccugggcgcgaucuuuacagaugaaaacaaguggaaaagcgcccgggaggcuguggaagacgggagauucugggagcucguggaucgggagcgcaaucugcaccuugaaggaaaaugcgagaccugugucuacaacaugaugggcaagagagagaagaagcugggcgaguuugggaaagccaagggaucucgggcuauuugguauauguggcucggcgcccgcuuccuggaauuugaggcccugggguuccucaaugaggaccauugguuuuccagaggaaacagccuguccggcguggaaggggagggccuucaccggcugggauacauccuccgcgauguuggcaagaaagaagggggagcgauguacgcugacgauacggccggcugggacaccagaauuacacuggaggaccuuaagaaugaagagauggugaccaaccauaugaaaggggagcacaagaaacuggccgaagcuaucuucaagcucacauaucagaauaaggucgugcggguucagcgcccuacccccagaggaacggugauggauaucauuagccggcgcgaccaaagaggcucugggcaggucggcacauacggacugaacaccuucacaaauauggaggcccagcugauccggcaaauggaaggcgaggggauuuuuaaaagcauccagcaucucaccgcuacggaggaaauugccgcgcagaacuggcuggcccgcgugggaagagagcggcuuuccagaauggcuaucucuggcgaugacugcguugugaagccgaucgaugaccgcuucgccagcgcucugaccgcccucaaugauauggggaaaguccggaaggacauucagcaaugggaaccuuccagaggauggaacgauuggacacaggugcccuuuugcucucaccacuuccaugagcuggucaugaaagacggccgcgugcuuguugugcccugucggaaccaggaugaacugaucgggagagcgcgcauuagccagggcgccggauggucccucaaggagaccgcuugccugggcaagucuuaugcccaaauguggacacugauguacuuucaccggagagaccuccgccuggcugccaaugcuaucuguagcgccgucccuucccauugggugccgaccagccggacaaccuggucuauucacgcgaaacacgaguggaugacgacagaagauaugcuugccguguggaacagaguuuggauccaggagaaucccuggauggaagacaagaccccuguggaguccugggaagagguccccuaucuggggaaacgcgaggaccaguggugcggaagccucauuggccugaccucucgggcuacaugggccaagaacauccagaccgccaucaaucaagugagaucccuuauugggaacgaagaguacacagauuauaugccuagcaugaaacgguucagacgcgaagaggaagaggcuggaguucugugguga

SEQ ID NO: 19657 - RNA, 9876 nt, Artificial Sequence
  derived and/or modified CDS sequence (opt5) from DENV-2__GQ868554__SS-prME
accgccggagugaucguuaugcugauucccacagcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugagguuaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacaguggagugccccaauaccaaccgcgccuggaacucucucgaggucgaagacuacggauuuggcguguucacaaccaacauuuggcugaaacuucgggagaaacaggacgucuuuugugauuccaagcugaugagcgcugccaucaaagacaauagagcugugcacgccgauaugggcuauuggaucgaaucugcgcucaacgacacguggaagauggagaaggccuccuucauugaggucaaaagcugccacuggccuaagucucauacacuguggagcaauggggugcuggaauccgagaugaucauucccaaaaacuucgcuggaccggugagccagcacaacuaccgcccuggcuaucauacccaaaccgccgggcccuggcaccuuggaaagcucgaaauggauuuugacuucugugagggcacaaccgucguugugacggaagauugcgggaaucggggacccucucugagaacaaccacagcuuccggcaaacugaucaccgaguggugcugucggagcugcacacucccuccgcugcgcuacagaggcgaggacggguguugguacggaauggaaauucggccccuuaaggagaaggaagagaaccuggugaauagccucgucaccgccggccaugggcagaucgauaacuuuucucugggagugcugggcauggcccuuuuccucgaagagaugcugagaacgcgcguugggaccaaacacgcuauucugcucguggcggucagcuuugugacacugaucaccggaaauauguccuuccgggaccuuggcagaguuauggugauggucggcgccacaaugaccgaugacaucgggaugggagugacguaucuggcucuccuggccgccuuuaagguucgcccuacauucgcugccggccugcuucugagaaaacucaccucuaaggagcugaugauggcgacaauugggaucacccuccugagccaguccaccauucccgaaacaauccuugagcugacggaugcucucgcccugggaaugauggugcugaaaauuguccggaacauggaaaaguaccaacuugccgugaccaucauggcuaucucuugcgugccuaaugccgucauucugcgcaacgcguggaagguuagcuguacaauccucgcugccguguccgugagcccccugcuccugaccucuucccagcagaaagccgacuggauuccucuugcucugacaaucaagggccucaaucccaccgccauuuuucugacgacacugagcagaaccucuaaaaagcgguccuggccgcuuaacgaggcuaucauggccgucgggauggugagcauccuggcgucuucccuccugaaaaaugacauuccuaugaccggaccccucguugccggcggccugcuuacagugugcuauguccugaccgggcgcagcgcugaucuggaacucgagagagccgcugacgugaagugggaggaucaggccgaaaucuccggaagcucuccuauucugagcaucacaauuuccgaggacggcucuaugagcaucaaaaacgaagaggaggaacaaacgcuuaccauucugauccggacagggcuccugguuaucuccggaguguuccccgucucuauuccgaucaccgccgcugcgugguaccucugggaggugaagaagcagcgcgccggcguccugugggaugugccuucucccccucccguugggaaagcugaacuugaggacggagccuauagaauuaagcagcggggcauccugggcuacucccagauuggggccggaguguauaaagaaggcacauuucacaccauguggcaugucacgcgcggggcugugcugaugcacagaggaaagcggaucgagcccuccugggccgauguuaaaaaggaccucaucagcuacggcgggggauggaagcuggagggcgaauggaaagagggcgaagaggugcaaguccuugcgcuggaaccugggaagaauccgagagcugugcagaccaaacccggaauuuucaagacaaacaccggcacaaucggggccgugucccucgauuuuagcccuggaaccucuggcucccccauuguugaccgcaaagggaaggucgugggacuguacggcaauggcguggucacacggagcggggccuaugugucugcuaucgcccagacggagaaguccauugaggauaacccugaaaucgaggacgauaucuuccgcaagaagcgccucaccauuauggaccugcaucccggagcgggcaaaacaaagcgguaccuuccugcuaucguuagagaagccauuaaacgcgggcugcggacccugauccucgccccgaccagaguggucgcugccgagauggaagaggcucugcgcggacuucccauucgguaucagaccccugccaucaaggcggagcacacgggcagagaaauuguggaccugaugugucaugccaccuucacaaugcggcuccugagccccguucgcgugccuaacuacaaucucaucaucauggaugaggcucacuuuaccgaccccgccuccauugcugccagaggguauaucucuacacgggucgaaaugggcgaggccgcuggaauuuucaugaccgcgacgccgccuggcagccgcgaucccuuuccccaauccaacgccccuaucauggacgaggaaagagagauucccgaacggagcuggaacucugggcacgagugggugacagauuucaagggaaaaaccguuugguuugugccuuccaucaaggcuggcaacgacaucgccgccugccugcgcaagaaugggaagaaagucauucagcuuagccgcaagaccuucgauucugaauacgugaagacacgggcuaacgacugggauuuuguggucaccacagacaucagcgagaugggagccaauuucaaagcggagagaguuauugauccgcgccgguguaugaagcccgugauccugaccgacggcgaagagagagugauucuggcugggccuaugcccgucacgcauuccucugccgcccagcgccggggcagaaucggacgcaacccuaaaaaugaaaacgaccaauauaucuacaugggcgagccccucgaaaaugaugaggacugcgcucacuggaaggaggccaaaaugcugcuugauaacauuaauacaccggaagggaucauuccuagcauguuugagcccgaaagagagaagguggacgcgaucgauggagaauaccggcugcgcggcgaggccagaaaaaccuucguugaccucaugcggcgcggggaucugccuguguggcuggcuuauaaggucgccgcugagggaauuaacuacgccgacagaaagugguguuuugauggcaucaaaaauaaccagauucucgaagagaacguggaaguugagaucuggacaaaggagggggaacggaagaaacuuaaacccagauggcuggacgcucgcaucuauuccgauccucuggcccucaaagaguucaaggaguucgcggccggccggaaaucucugacccuuaaucugauuacggagaugggaagacuccccaccuuuaugacacagaaggcucgcaacgcccuggacaaucuggcugugcuccauaccgccgaagccggcgggcgggcuuacaaccacgcgcuuagcgagcugccggagacacuggaaacccuccugcuucugacacuccuggccaccgucacgggaggcaucuuccuguuucucauguccgggaaaggaauuggcaagaugacacuuggcaugugcugcaucauuaccgcuagcgugcugcugugguaugcccagauccaaccucacuggaucgccgcuucuauuauccucgaguucuuucugauuguccuucugauccccgaacccgagaaacagagaaccccucaggauaaucagcucacauacgugguuauugccauccugaccgugguggcggccacaauggcuaacgaaaugggguuccuggagaagacgaagaaagaccucggacuuggcuccaucaccacacaagagagcgaauccaauauucuggacaucgaucugcggccggccucugcuuggacccucuaugccgucgcgacaaccuuuguuacgcccaugcugcgccauagcauugagaacuccucugugaaugugagccuuaccgccaucgcuaaccaggccacaguccugauggggcucggaaagggcuggccucuguccaaaauggacauuggggugccccugcucgcuaucggauguuacagccagguuaauccuauuacccuuacagccgcucugcugcuccugguggcccacuacgcgaucaucggccccggccuucaggccaaggcuaccagagaagcccaaaaacgggcugccgccgggauuaugaagaacccuacggucgauggaaucacagugauugaccuggagccgauccccuaugauccuaaguucgaaaaacagcucggccaggucaugcugcugauucucugcgugacccagguucuuaugaugcgcacaaccugggcgcugugugaggcucugacccucgccacagggcccaucucuacgcugugggagggaaauccuggcagauuuuggaacaccacaaucgcuguguccauggccaauauuuuccgggggagcuaccuugccggagcuggccugcucuuuucuaucaugaagaacaccacaaauacccgcagaggcacggggaacauuggagaaacacugggcgagaaauggaagucccggcugaacgcccucgggaaaagcgaguuccaaaucuauaagaaaucuggcauucaggaggucgaccgcacccuugcgaaggagggcaucaagagaggggaaaccgaucaucacgccgugagccggggauccgcuaaacugagaugguuuguugagcgcaauauggugacacccgaaggcaaggucguggaccugggcugcgggcggggaggcuggucuuacuauugugggggacucaaaaacgugagagagguuaagggccugaccaaagggggaccgggccaugaagaaccuauccccaugagcacauacggcuggaaucuuguccgccugcaguccgggguggauguguucuucacgcccccugagaagugcgacacccuccugugugauauuggagaaagcucccccaacccuacaaucgaggccggccggacccugagaguccucaaucuuguugaaaacuggcugaauaacaauacacaauuuugcauuaaggugcugaacccguauaugcccucugugaucgagaaaauggaaacccuccagcgcaaguacgggggagcucugguccggaauccucuuagcagaaacuccacgcacgagauguacugggugucuaaugccaccggcaacauuguuagcuccgugaauaugaucucucgcaugcugaucaaccgguucacaaugaaacacaagaaagcgaccuaugagcccgacgucgaucucgggagcggaacaagaaacauuggcaucgaauccgagauuccuaaucuggacaucauuggcaagcgcaucgaaaagauuaaacaggagcaugaaaccagcuggcacuacgaccaggaucaucccuauaagacaugggccuaccacgggucuuaugagaccaaacaaacgggauccgcuagcucuauggugaacggcguugugcggcugcucacaaagccgugggacgucgugccuauggugacccagauggccaugaccgauacaacgcccuuugggcagcagagagucuucaaagagaagguugacacccgcacacaagaaccuaaggagggaaccaagaaacuuaugagaaucacagcugaauggcuguggaaagagcugggcaaaaagaaaacaccccggauguguacacgcgaggaauuuaccagaaaagugcgguccaaugccgcucucggggccaucuucacggaugagaacaaguggaaaagcgcgagagaagccguggaggacggacgguuuugggaacuggucgaucgcgagagaaaucuucaccuggagggcaaaugcgaaaccuguguguacaacaugaugggcaagcgggagaaaaagcucggggaguucggaaaagcuaagggcucucgcgccauuugguauauguggcugggggcuagauuucuggaguucgaagcccucggauuucugaaugaggaccauugguucucccggggcaacagccuuuccgggguugagggcgaaggacugcaccgccucggcuacauccugagagauguggggaagaaagagggaggcgccauguacgcggacgauacagcugggugggacacccggauuacacuugaagaccugaagaaugaggaaauggucaccaaccauaugaaaggagagcacaagaaacucgccgaggccaucuuuaagcugacguaucagaauaaggugguucgcgugcagagaccuacaccccggggcaccgucauggauauuaucagccgcagagaccagcgggggucuggccaagugggaacauacggccugaacaccuucacgaauauggaagcucagcucauccgccagauggagggggaaggaauuuucaaaagcauccaacaucugaccgccacagaggagauugcuguucagaacuggcuugccagagugggccgggaaagacugucccgcauggcgaucucuggggaugacugcgucgugaagccgauugaugaccgguuugccagcgcucucaccgcccugaaugauaugggaaaagucagaaaggacauccagcagugggagccuucccgcggcuggaacgauuggacacaagugcccuucugcucucaccacuuucaugaacuuguuaugaaagacgggcgggugcuggucgugcccuguagaaaccaggaugagcucaucggccgcgcucggauuagccagggagccggcuggucccugaaggaaaccgcgugccuggggaagucuuaugcccagauguggacacucauguacuuccacagacgcgaccugcggcuugcugccaaugcuaucuguagcgccgugccuucccauuggguuccgaccagcagaacgacauggucuauucacgcuaaacacgaguggaugaccaccgaggauaugcuggccguguggaaccgcgucuggauccaagaaaaucccuggauggaggacaagacaccuguggaauccugggaggaaguucccuaucucggaaaacgggaggaccaguggugcggcagccugauugggcuuaccucuagagcgacaugggccaagaacauccagacggcuauuaaucaggugcggucccugaucggaaacgaggaauacaccgauuauaugccuagcaugaaaagauuucgccgggaggaagaggaagccggcguccucugguga

SEQ ID NO: 19658 - RNA, 9876 nt, Artificial Sequence
  derived and/or modified CDS sequence (opt5) from DENV-2__GQ868555__SS-prME
acagccggagugaucgucaugcugauucccacagcuaucgccuuccaccucacgaccagaaauggggagccucauaugauuguuggacggcaggaaaagggcaagagccugcuuuuuaagacagaggacggggugaauaugugcacccugauggcgaucgaucucggagaacugugugaggacacaauuaccuacaaaugcccgcuucugagacaaaaugaacccgaggauaucgacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauucugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacaucguccucgagcacggguccugugugacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaaucaagauuacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgaucgugauuagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucaucggcguggagcccggacagcucaaacugaauugguucaagaagggcuccagcauugggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucgggguggugaucaccuggauuggaaugaacagccgguccacaagccugucuguuucccuuguccucgugggcguggucacccuguaucugggggccauggugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacacgaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacgaacauuuggcugaaacuucgggagaaacaggacguguuuugugauuccaagcugaugagcgccgcuaucaaagacaauagagccguucacgcggauaugggcuauuggaucgaaucugcccucaacgacacauggaagauggagaaggcuuccuucauugaggugaaaagcugccacuggccuaagucucauacccuguggagcaaugggguccuggaauccgagaugaucauucccaaaaacuucgccggaccggugagccagcacaacuaccgcccuggcuaucauacccaaacagcugggcccuggcaccuuggaaagcucgaaauggauuuugaccugugugagggcaccacgguggucguuacagaagauugcgggaaucggggacccucucugagaaccacaaccgccuccggcaaacucaucacagaguggugcugucggagcugcacccugccuccgcuucgcuacagaggcgaggacggguguugguacggaauggaaauucggccccugaaggagaaggaagagaaccucgugaauagccuggugacggccggccaugggcagaucgauaacuucucucugggaguccuuggcauggcucucuuucuggaagagaugcugagaacccgcguggggacaaaacacgcgauucuccugguugccgugagcuucgucacccuuaucacaggaaauauguccuuucgggaccugggcagagugaugguuauggugggcgcuaccaugacggaugacaucgggaugggagucacauaucucgcccugcuggccgcuuucaaggugcgcccuaccuuugccgcgggccuucugcucagaaaacugacaucuaaggagcucaugauggcuaccauugggaucgcccugcuuagccaguccaccauucccgaaacaauccuggagcucacggaugcccuggcucugggaaugaugguucuuaaaauugugcggaacauggaaaaguaccaacuggccgucaccaucauggcgaucucuugcgugccuaaugcugugauucuccgcaacgccuggaaggucagcuguacaauccuggccgcuguuuccgugagcccccuccugcuuaccucuucccagcagaaagccgacuggauuccucuggcucucacaaucaagggccugaaucccaccgccauuuuccugacgacacuuagcagaaccucuaaaaagcgguccuggccgcugaacgaggcgaucauggccguggggauggucagcauccucgcuucuucccugcucaaaaaugacauuccuaugaccggaccccugguggccggcggccuucugacaguuugcuaugugcugaccgggcgcagcgcugaucucgaacuggagagagccgccgaggucaagugggaagaccaggcugagaucuccggaagcucuccuauucuuagcaucacaauuuccgaagauggcucuaugagcaucaaaaacgaggaggaagaacaaacgcugaccauucucauccggacagggcugcucgugaucuccggaguuuuucccgugucuauuccgaucaccgcggccgcuugguaccugugggaagucaagaagcagcgcgccggcgugcuuugggacgucccuucucccccucccguggggaaagccgagcuggaagagggagcuuauagaauuaagcagcggggcauccugggcuacucccagauuggggccggaguuuauaaagagggcacauuccacaccauguggcaugugacgcgcggggcgguccucaugcacagaggaaagcggaucgaacccuccugggcugaugugaaaaaggaccugaucagcuacggcgggggauggaaacuugagggcgaauggaaagagggcgaagagguucaagugcuggcccucgagccugggaagaauccgagagccguccagaccaaacccggaauuuuuaagacaaacaccggcacaaucggggcugugucccuggauuucagcccuggaaccucuggcucccccauuguggaccgcaaagggaagguugucggacucuacggcaauggcguggugacacggagcggggccuaugucucugcgaucgcucagacggaaaaguccauugaggauaacccugaaaucgaggacgauaucuuucgcaagaagcgccugaccauuauggaccuucaucccggagccggcaaaacaaagcgguaccugccugccaucgugagagaagcuauuaaacgcgggcugcggacccucauccuggccccgaccagaguuguggcugccgagauggaggaagcgcuucgcggacugcccauucgguaucagaccccugccaucaaggcugagcacacgggcagagaaauugucgaucucaugugucaugccaccuucacaaugcggcugcucagccccgugcgcguuccuaacuacaaucugaucaucauggacgaggcucacuucaccgaccccgccuccauugccgcuagaggguauaucucuacacggguggagaugggcgaagcggccggaauuuuuaugaccgcuacgccgccuggcagccgcgaucccuucccccaauccaacgccccuaucauggacgaggaaagagagauucccgaacggagcuggaacucugggcacgagugggucacagauuuuaagggaaaaaccgugugguucguuccuuccaucaaggccggcaacgacaucgcugccugccuucgcaagaaugggaagaaagugauucagcugagccgcaagaccuuugauucugaguacgucaagacacgggcgaacgacugggauuucguggugaccacagacaucagcgaaaugggagcuaauuuuaaagccgagagagucauugauccgcgccgguguaugaagcccguuauccugaccgacggcgaagagagagugauucucgccgggccuaugcccgugacgcauuccucugcugcccagcgccggggcagaaucggacgcaacccuaaaaaugaaaacgaucaauauaucuacaugggcgagccccuggagaaugacgaagacugcgcgcacuggaaggaggccaaaaugcuucuggauaacauuaauacaccggaagggaucauuccuagcauguucgagcccgaaagagagaaggucgacgcuaucgauggagaguaccggcuccgcggcgaagccagaaaaaccuuuguggaccugaugcggcgcggggaucugccuguuuggcucgcuuauaagguggccgcugagggaauuaacuacgccgacagaaagugguguuucgauggcaucaaaaauaaccagauucuugaagagaacgucgagguggaaaucuggacaaaggagggggaacggaaaaagcugaaacccagauggcuggacgcgcgcaucuauuccgauccucucgcccugaaggaguuuaaggaguucgcugccggccggaaaucucuuacccugaaucucauuacggagaugggaagacugcccaccuucaugacacagaaggcucgcaacgcccuggacaaucucgccguucuucauaccgcugaggcgggcgggcgggccuacaaccacgcucugagcgaacugccggagacacucgaaacccugcuucugcucacacugcuggccaccgugacgggaggcaucuuucucuuccuuauguccgggaaaggaauuggcaagaugacacugggcaugugcugcaucauuaccgccagcguccugcucugguaugcucagauccaaccucacuggaucgccgcgucuauuauccuggaguuuuuccuuauugugcugcucauccccgaacccgagaaacagagaaccccucaggauaaucagcugacauacgucgugauugccauccugaccguuguggcugccacaauggcuaacgagaugggguuucucgaaaagacgaagaaagaccuuggacugggcuccaucaccacacaagagagcgaauccaauauucuggauaucgaccuccggccggccucugcguggacccuguaugccguggcuacaaccuucgucacgcccaugcuucgccauagcauugagaacuccucuguuaaugugagccugaccgccaucgcuaaccaggccacagugcucauggggcugggaaagggcuggccucuguccaaaauggacauuggggucccccuccuugcuaucggauguuacagccaggugaauccuauuacccugacagccgcgcugcuccugcuuguugcccacuacgcuaucaucggccccggccugcaggccaaggcuaccagagaagcccaaaaacgggccgcggcugggauuaugaagaacccuacgguggauggaaucacagucauugaccucgagccgauccccuaugauccuaaguuugagaaacagcugggccaggugaugcugcucauucuuugcgucacccaggugcugaugaugcgcacaaccugggcccugugugaagcucucacccuggccacagggcccaucucuacgcuuugggagggaaauccuggcagauucuggaacaccacaaucgccguuuccauggcuaauauuuuucgggggagcuaccuggccggagcgggccuccuguucucuaucaugaagaacaccacaaauacccgcagaggcacggggaacauuggagaaacacugggcgagaaauggaagucccggcucaacgcccuugggaaaagcgaguuucaaaucuauaagaaaucuggcauucaggaaguggaccgcacccuggcuaaggagggcaucaagagaggggaaaccgaucaucacgccgucagccggggauccgcuaaacugagaugguucguggagcgcaauaugguuacacccgaaggcaagguggucgaccucggcugcgggcggggaggcuggucuuacuauugugggggacugaaaaacgugagagaggugaagggccuuaccaaagggggaccgggccaugaggaaccuauccccaugagcacauacggcuggaaucugguucgccuccaguccggggucgauguguuuuucacgcccccugagaagugcgacacccugcugugugauauuggagaaagcucccccaacccuacaaucgaggccggccggacccucagagugcuuaaucuggucgaaaacuggcugaauaacaauacacaauucugcauuaagguucucaacccguauaugcccucugugaucgagaaaauggagacccugcagcgcaaguacgggggagcgcuugugcggaauccucugagcagaaacuccacgcacgaaauguacugggucucuaaugccaccggcaacauugugagcuccguuaauaugaucucucgcaugcucaucaaccgguuuacaaugaaacacaagaaagcuaccuaugagcccgacguggaucuggggagcggaacaagaaacauuggcaucgaauccgagauuccuaaucuggacaucauuggcaagcgcaucgaaaagauuaaacaggagcaugagaccagcuggcacuacgaucaggaccaucccuauaagacaugggccuaccacgggucuuaugaaaccaaacaaacgggauccgcuagcucuauggucaacggcgugguucggcuccuuacaaagccgugggacguggucccuauggugacccagauggccaugaccgauacaacgcccuucgggcagcagagaguguuuaaagagaaggucgacacccgcacacaagaaccuaaggagggaaccaaaaagcugaugaaaaucacagcugaguggcuguggaaggaacucggcaaaaagaaaacccccagaauguguacacgggaggaguucacccgcaagguuagauccaaugccgcgcugggggccaucuuuacggaugagaacaaguggaaaagcgcucgggaagccguggaggacggaagauucugggagcuuguggaucgggaacgcaaucugcaccucgagggcaagugcgaaaccugugucuacaacaugaugggcaaaagagagaagaaacugggggaauuuggaaaggcuaagggcucucgggccauuugguauauguggcugggggcccgcuuccucgaguuugaggcgcugggauuccuuaaugaagaccauugguuuuccagaggcaacagccuguccgggguggagggcgaaggacuccaccggcugggcuacauccuucgcgauguuagcaaaaaggaagggggagcuauguacgccgacgauacagccggcugggacaccagaauuacacuggaagaucucaaaaaugaggagauggugaccaaccauaugaagggggaacacaaaaagcuggcugaggccaucuucaagcugacguaucagaauaaagucgugcggguucagcgcccuacacccagaggaaccgugauggacauuaucucucggcgcgaccagagaggcagcgggcaagucggcacauacggacucaacaccuuuacgaauaucgaagcucagcugauucggcagauggagggcgaggggaucuucaaguccauucaacaucuuaccgccacagaagagaucgcggugcagaacuggcuggcccgcguuggaagagaacggcucucuagaauggcuauuagcggcgaugacugcguggucaaaccgaucgaugaccgcuucgccuccgcucugaccgcccuuaaugauauggggaaggugcggaaagacauccagcagugggagccuucuagaggauggaacgauuggacacaaguccccuuuugcagccaccacuuccaugaacuggugaugaaggacggccgcguucucgugguccccugucggaaccaggaugagcugauugggagagcgcgcaucucccagggcgccggauggucucugaaggagaccgcuugccucggcaaaagcuaugcccagauguggacacugauguacuuucaccggagagaccuucgccuggcugccaaugcuauuuguuccgccgugccuagccauugggugccgaccucucggacgacaugguccauccacgcgaagcacgaauggaugaccaccgaggauaugcucgccguuuggaacagaguguggauucaagaaaaucccuggauggaggacaaaacaccugucgaaagcugggaggaggugcccuaucuggggaagcgcgaagaucaguggugcggaucucuuaucggccugaccucccgggcuacaugggccaaaaacauucagacggccaucaaucagguuagaagccucaucgggaacgaggaauacaccgacuauaugccuuccaugaagcgguucagacgcgaggaagaggaggcuggagugcugugguga

SEQ ID NO: 19659 - RNA, 9876 nt, Artificial Sequence
  derived and/or modified CDS sequence (opt5) from DENV-2__GQ868556__SS-prME
accgccggagugaucgucaugcugauucccacagcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugauugaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucgggguggugaucaccuggauuggaaugaacagccgguccaccagccugucuguuucccuuguccucgugggcguggucacacuguaucugggggccauggugcaggccgacagcggauguguugugucuuggaagaauaaagaacucaagugcggcuccgggaucuucauuaccgauaacguccacacauggacggagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauucuguccgaaaaugagguuaagcugaccaucaugacaggcgacaccaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuaucaaagacaauagagccguucacgcggauaugggcuauuggaucgaaucugcccucaacgacacguggaagauggagaaggcuuccuucauugaggugaaaagcugccacuggccuaagucucauacacuguggagcaaugggguccuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgugaccgccggccaugggcagaucgauaacuuuucucugggaguccugggcauggcucuuuuccucgaagagaugcugagaacgcgcguggggaccaaacacgcgauucugcucguugccgugagcuuugucacacugaucaccggaaauauguccuuccgggaccuuggcagagugaugguuauggugggcgcuacaaugaccgaugacaucgggaugggagucacguaucuggcccuccuggccgcuuuuaaggugcgcccuacauucgccgcgggccugcuucugagaaaacucaccucuaaggagcugaugauggcuacaauugggaucacccuccugagccaguccaccauucccgaaacaauccuugagcugacggaugcccucgcccugggaaugaugguucugaaaauugugcggaacauggaaaaguaccaacuugcugucaccaucauggccaucucuugcgugccuaaugcggugauucugcgcaacgcuuggaaggucagcuguacaauccucgccgccguuuccgugagcccccugcuccugaccucuucccagcagaaagcugacuggauuccucuugcccugacaaucaagggccucaaucccaccgcuauuuuucugacgacacugagcagaaccucuaaaaagcgguccuggccgcuuaacgaggccaucauggcgguggggauggucagcauccuggccucuucccuccugaaaaaugacauuccuaugaccggaccccucguggcuggcggccugcuuacaguuugcuaugugcugaccgggcgcagcgccgaucuggaacucgagagagcugccgacgucaagugggaggaucaggccgaaaucuccggaagcucuccuauucugagcaucacaauuuccgaggacggcucuaugagcaucaaaaacgaagaggaggaacaaacgcuuaccauucugauccggacagggcuccuggugaucuccggaguuuuccccgugucuauuccgaucaccgcugcggccugguaccucugggaggucaagaagcagcgcgcuggcgugcugugggaugucccuucucccccucccguggggaaagccgaacuugaggacggagccuauagaauuaagcagcggggcauccugggcuacucccagauuggggcuggaguuuauaaagaaggcacauuucacaccauguggcaugugacgcgcggggccguccugaugcacagaggaaagcggaucgagcccuccugggcggaugugaaaaaggaccucaucagcuacggcgggggauggaagcuggagggcgaauggaaagagggcgaagagguucaagugcuugcucuggaaccugggaagaauccgagagccguccagaccaaacccggaauuuucaagacaaacaccggcacaaucggggccgugucccucgauuuuagcccuggaaccucuggcucccccauuguggaccgcaaagggaagguugucggacuguacggcaauggcguggugacacggagcggggcuuaugucucugccaucgcgcagacggagaaguccauugaggauaacccugaaaucgaggacgauaucuuccgcaagaagcgccucaccauuauggaccugcaucccggagcuggcaaaacaaagcgguaccuuccugccaucgugagagaagccauuaaacgcgggcugcggacccugauccucgcuccgaccagaguuguggccgcugagauggaagaggcccugcgcggacuucccauucgguaucagaccccugcgaucaaggccgagcacacgggcagagaaauugucgaccugaugugucaugcuaccuucacaaugcggcuccugagccccgugcgcguuccuaacuacaaucucaucaucauggaugaggcccacuuuaccgaccccgcuuccauugccgccagaggguauaucucuacacggguggaaaugggcgaggcugcgggaauuuucaugaccgccacgccgccuggcagccgcgaucccuuuccccaauccaacgcuccuaucauggacgaggaaagagagauucccgaacggagcuggaacucugggcacgagugggucacagauuucaagggaaaaaccgugugguuuguuccuuccaucaaggccggcaacgacaucgccgcuugccugcgcaagaaugggaagaaagugauucagcuuagccgcaagaccuucgauucugaauacgucaagacacgggccaacgacugggauuuuguggugaccacagacaucagcgagaugggagcgaauuucaaagcugagagagucauugauccgcgccgguguaugaagcccguuauccugaccgacggcgaagagagagugauucuggccgggccuaugcccgugacgcauuccucugccgcucagcgccggggcagaaucggacgcaacccuaaaaaugaaaacgaccaauauaucuacaugggcgagccccucgaaaaugaugaggacugcgcccacuggaaggaggcgaaaaugcugcuugauaacauuaauacaccggaagggaucauuccuagcauguuugagcccgaaagagagaaggucgacgccaucgauggagaauaccggcugcgcggcgaggcuagaaaaaccuucguggaccucaugcggcgcggggaucugccuguuuggcuggccuauaagguggcugccgagggaauuaacuacgcugacagaaagugguguuuugauggcaucaaaaauaaccagauucucgaagagaacgucgaaguggagaucuggacaaaggagggggaacggaagaaacuuaaacccagauggcuggacgcccgcaucuauuccgauccucuggcgcucaaagaguucaaggaguucgccgcuggccggaaaucucugacccuuaaucugauuacggagaugggaagacuccccaccuuuaugacacagaaggcccgcaacgcucuggacaaucuggccguucuccauaccgccgaagcuggcgggcgggcguacaaccacgcccuuagcgagcugccggagacacuggaaacccuccugcuucugacacuccuggcuaccgugacgggaggcaucuuccuguuucucauguccgggaaaggaauuggcaagaugacacuuggcaugugcugcaucauuaccgccagcguccugcugugguaugcccagauccaaccucacuggaucgcugccucuauuauccucgaguucuuucugauugugcuucugauccccgaacccgagaaacagagaaccccucaggauaaucagcucacauacgucgugauugcgauccugaccguuguggccgcuacaauggccaacgaaaugggguuccuggagaagacgaagaaagaccucggacuuggcuccaucaccacacaagagagcgaauccaauauucuggacaucgaucugcggccggcuucugccuggacccucuaugcgguggccacaaccuuugucacgcccaugcugcgccauagcauugagaacuccucuguuaaugugagccuuaccgcuaucgccaaccaggcuacagugcugauggggcucggaaagggcuggccucuguccaaaauggacauuggggucccccugcucgccaucggauguuacagccaggugaauccuauuacccuuacagcugcccugcugcuccugguugcgcacuacgccaucaucggccccggccuucaggcuaaggccaccagagaagcucaaaaacgggccgccgcggggauuaugaagaacccuacgguggauggaaucacagucauugaccuggagccgauccccuaugauccuaaguucgaaaaacagcucggccaggugaugcugcugauucucugcgucacccaggugcuuaugaugcgcacaaccugggcucugugugaggcccugacccucgcuacagggcccaucucuacgcugugggagggaaauccuggcagauuuuggaacaccacaaucgccguuuccauggccaauauuuuccgggggagcuaccuugcuggagccggccugcucuuuucuaucaugaagaacaccacaaauacccgcagaggcacggggaacauuggagaaacacugggcgagaaauggaagucccggcugaacgcgcucgggaaaagcgaguuccaaaucuauaagaaaucuggcauucaggagguggaccgcacccuugccaaggagggcaucaagagaggggaaaccgaucaucacgcugucagccggggauccgccaaacugagaugguuuguggagcgcaauaugguuacacccgaaggcaagguggucgaccugggcugcgggcggggaggcuggucuuacuauugugggggacucaaaaacgugagagaggugaagggccugaccaaagggggaccgggccaugaagaaccuauccccaugagcacauacggcuggaaucuuguucgccugcaguccggggucgauguguucuucacgcccccugagaagugcgacacccuccugugugauauuggagaaagcucccccaacccuacaaucgaggcuggccggacccugagagugcucaaucuugucgaaaacuggcugaauaacaauacacaauuuugcauuaagguucugaacccguauaugcccucugugaucgagaaaauggaaacccuccagcgcaaguacgggggagcccuggugcggaauccucuuagcagaaacuccacgcacgagauguacugggucucuaaugcgaccggcaacauugugagcuccguuaauaugaucucucgcaugcugaucaaccgguucacaaugaaacacaagaaagccaccuaugagcccgacguggaucucgggagcggaacaagaaacauuggcaucgaauccgagauuccuaaucuggacaucauuggcaagcgcaucgaaaagauuaaacaggagcaugaaaccagcuggcacuacgaccaggaucaucccuauaagacaugggcuuaccacgggucuuaugagaccaaacaaacgggauccgccagcucuauggucaacggcgugguucggcugcucacaaagccgugggacguggucccuauggugacccagauggcuaugaccgauacaacgcccuuugggcagcagagaguguucaaagagaaggucgacacccgcacacaagaaccuaaggagggaaccaagaaacuuaugagaaucacagccgaauggcuguggaaagagcugggcaaaaagaaaacaccccggauguguacacgcgaggaauuuaccagaaaaguucgguccaaugcugcccucggggcgaucuucacggaugagaacaaguggaaaagcgccagagaagcuguggaggacggacgguuuugggaacugguggaucgcgagagaaaucuucaccuggagggcaaaugcgaaaccugugucuacaacaugaugggcaagcgggagaaaaagcucggggaguucggaaaagccaagggcucucgcgcuauuugguauauguggcugggggccagauuucuggaguucgaagcccucggauuucugaaugaggaccauugguucucccggggcaacagccuuuccgggguggagggcgaaggacugcaccgccucggcuacauccugagagauguugggaagaaagagggaggcgcgauguacgcugacgauacagccgggugggacacccggauuacacuugaagaccugaagaaugaggaaauggugaccaaccauaugaaaggagagcacaagaaacucgccgaggcuaucuuuaagcugacguaucagaauaaggucgugcgcguucagagaccuacaccccggggcaccgugauggauauuaucagccgcagagaccagcgggggucuggccaagucggaacauacggccugaacaccuucacgaauauggaagcccagcucauccgccagauggagggggaaggaauuuucaaaagcauccaacaucugaccgcuacagaggagauugccgugcagaacuggcuugcgagaguuggccgggaaagacugucccgcauggccaucucuggggaugacugcguggucaagccgauugaugaccgguuugcuagcgcccucaccgcucugaaugauaugggaaaagugagaaaggacauccagcagugggagccuucccgcggcuggaacgauuggacacaaguccccuucugcucucaccacuuucaugaacuugugaugaaagacgggcggguucuggugguccccuguagaaaccaggaugagcucaucggccgcgcccggauuagccagggagcgggcuggucccugaaggaaaccgccugccuggggaagucuuaugcucagauguggacacucauguacuuccacagacgcgaccugcggcuugccgcuaaugccaucuguagcgcugugccuucccauugggugccgaccagcagaacgacauggucuauucacgccaaacacgaguggaugaccaccgaggauaugcuggcgguuuggaaccgcguguggauccaagaaaaucccuggauggaggacaagacaccugucgaauccugggaggaagugcccuaucucggaaaacgggaggaccaguggugcggcagccugauugggcuuaccucuagagccacaugggcuaagaacauccagacggccauuaaucagguucggucccugaucggaaacgaggaauacaccgauuauaugccuagcaugaaaagauuucgccgggaggaagaggaagccggcgugcucugguga

SEQ ID NO: 19660 - RNA, 9876 nt, Artificial Sequence
  derived and/or modified CDS sequence (opt5) from DENV-2__GQ868557__SS-prME
acagccggagugaucgucaugcugauucccacagcuaucgccuuccaccucacgaccagaaauggggagccucauaugauuguuggacggcaggaaaagggcaaaagccugcuuuuuaagacagaggacggggugaauaugugcacccugauggcgaucgaucucggagaacugugugaggacacaauuaccuacaaaugcccgcuucugagacaaaaugaacccgaggauaucgacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauucugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacaucguccucgagcacggguccugugugacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaaucaagauuacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgaucgugauuagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucaucggcguggagcccggacagcucaaacugaauugguucaagaagggcuccagcauugggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucgggguggugaucaccuggauuggaaugaacagccgguccacaagccugucuguuucccuuguccucgugggcguggucacccuguaucugggggccauggugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacacgaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacgaacauuuggcugaaacuucgggagaaacaggacguguuuugugauuccaagcugaugagcgccgcuaucaaagacaauagagccguucacgcggauaugggcuauuggaucgaaucugcccucaacgacacauggaagauggagaaggcuuccuucauugaggugaaaagcugccacuggccuaagucucauacccuguggagcaaugggguccuggaauccgagaugaucauucccaaaaacuucgccggaccggugagccagcacaacuaccgcccuggcuaucauacccaaacagcugggcccuggcaccuuggaaagcucgaaauggauuuugaccugugugagggcaccacgguggucguuacagaagauugcgggaaucggggacccucucugagaaccacaaccgccuccggcaaacucaucacagaguggugcugucggagcugcacccugccuccgcuucgcuacagaggcgaggacggguguugguacggaauggaaauucggccccugaaggagaaggaagagaaccucgugaauagccuggugacggccggccaugggcagaucgauaacuucucucugggaguccuuggcauggcucucuuucuggaagagaugcugagaacccgcguggggacaaaacacgcgauucuccugguugccgugagcuucgucacccuuaucacaggaaauauguccuuucgggaccugggcagagugaugguuauggugggcgcuaccaugacggaugacaucgggaugggagucacauaucucgcccugcuggccgcuuucaaggugcgcccuaccuuugccgcgggccuucugcucagaaaacugacaucuaaggagcucaugauggcuaccauugggaucgcccugcuuagccaguccaccauucccgaaacaauccuggagcucacggaugcccuggcucugggaaugaugguucuuaaaauugugcggaacauggaaaaguaccaacuggccgucaccaucauggcgaucucuugcgugccuaaugcugugauucuccgcaacgccuggaaggucagcuguacaauccuggccgcuguuuccgugagcccccuccugcuuaccucuucccagcagaaagccgacuggauuccucuggcucucacaaucaagggccugaaucccaccgccauuuuccugacgacacuuagcagaaccucuaaaaagcgguccuggccgcugaacgaggcgaucauggccguggggauggucagcauccucgcuucuucccugcucaaaaaugacauuccuaugaccggaccccugguggccggcggccuucugacaguuugcuaugugcugaccgggcgcagcgcugaucucgaacuggagagagccgccgaggucaagugggaagaccaggcugagaucuccggaagcucuccuauucuuagcaucacaauuuccgaagauggcucuaugagcaucaaaaacgaggaggaggaacaaacgcugaccauucucauccggacagggcugcucgugaucuccggaguuuuucccgugucuauuccgaucaccgcggccgcuugguaccugugggaagucaagaagcagcgcgccggcgugcuuugggacgucccuucucccccucccguggggaaagccgagcuggaagauggagcuuauagaauuaagcagcggggcauccugggcuacucccagauuggggccggaguuuauaaagagggcacauuccacaccauguggcaugugacgcgcggggcgguccucaugcacagaggaaagcggaucgagcccuccugggcugacgugaaaaaggaucugaucagcuacggcgggggauggaaacuugaaggcgaguggaaagaaggcgaggaaguucaagugcuggcccucgagccugggaagaauccgagagccguccagaccaaacccggaauuuuuaagacaaacaccggcacaaucggggcugugucccuggacuucagcccuggaaccucuggcucccccauuguggaucgcaaagggaagguugucggacucuacggcaauggcguggugacacggagcggggccuaugucucugcgaucgcucagacggagaaguccauugaagacaacccugagaucgaagaugacaucuuucgcaagaagcgccugaccauuauggaucuucaucccggagccggcaaaacaaagcgguaccugccugccaucgugagagaggcuauuaaacgcgggcugcggacccucauccuggccccgaccagaguuguggcugccgaaauggaggaggcgcuucgcggacugcccauucgguaucagaccccugccaucaaggcugaacacacgggcagagagauugucgaccucaugugucaugccaccuucacaaugcggcugcucagccccgugcgcguuccuaacuacaaucugaucaucauggacgaagcucacuucaccgaucccgccuccauugccgcuagaggguauaucucuacacggguggagaugggcgaggcggccggaauuuuuaugaccgcuacgccgccuggcagccgcgaccccuucccccaauccaacgccccuaucauggaugaagagagagaaauucccgagcggagcuggaacucugggcacgaaugggucacagacuuuaagggaaaaaccgugugguucguuccuuccaucaaggccggcaacgauaucgcugccugccuucgcaagaaugggaagaaagugauucagcugagccgcaagaccuuugacucugaguacgucaagacacgggcgaacgauugggacuucguggugaccacagauaucagcgagaugggagcuaauuuuaaagccgaaagagucauugacccgcgccgguguaugaagcccguuauccugaccgauggcgaggaaagagugauucucgccgggccuaugcccgugacgcauuccucugcugcccagcgccggggcagaaucggacgcaacccuaaaaaugagaacgaccaauauaucuacaugggcgaaccccuggagaaugacgaggauugcgcgcacuggaaggaagccaaaaugcuucuggacaacauuaauacaccggaggggaucauuccuagcauguucgaacccgagagagaaaaggucgaugcuaucgacggagaguaccggcuccgcggcgaggccagaaaaaccuuuguggaucugaugcggcgcggggaccugccuguuuggcucgcuuauaagguggccgcugaaggaauuaacuacgccgauagaaagugguguuucgacggcaucaaaaauaaccagauucuugaggaaaacgucgagguggagaucuggacaaaggaaggggagcggaaaaagcugaaacccagauggcuggaugcgcgcaucuauuccgacccucucgcccugaaggaauuuaaggaguucgcugccggccggaaaucucuuacccugaaucucauuacggaaaugggaagacugcccaccuucaugacacagaaggcucgcaacgcccuggauaaucucgccguucuucauaccgcugaggcgggcgggcgggccuacaaccacgcucugagcgagcugccggaaacacucgagacccugcuucugcucacacugcuggccaccgugacgggaggcaucuuucucuuccuuauguccgggaaaggaauuggcaagaugacacugggcaugugcugcaucauuaccgccagcguccugcucugguaugcucagauccaaccucacuggaucgccgcgucuauuauccuggaauuuuuccuuauugugcugcucauccccgagcccgaaaaacagagaaccccucaggacaaucagcugacauacgucgugauugccauccugaccguuguggcugccacaauggcuaacgagaugggguuucucgagaagacgaagaaagaucuuggacugggcuccaucaccacacaagaaagcgaguccaauauucuggacaucgaccuccggccggccucugcguggacccuguaugccguggcuacaaccuucgucacgcccaugcuucgccauagcauugaaaacuccucuguuaaugugagccugaccgccaucgcuaaccaggccacagugcucauggggcugggaaagggcuggccucuguccaaaauggauauuggggucccccuccuugcuaucggauguuacagccaggugaauccuauuacccugacagccgcgcugcuccugcuuguugcccacuacgcuaucaucggccccggccugcaggccaaggcuaccagagaggcccaaaaacgggccgcggcugggauuaugaagaacccuacgguggacggaaucacagucauugaucucgaaccgauccccuaugacccuaaguuugagaaacagcugggccaggugaugcugcucauucuuugcgucacccaggugcugaugaugcgcacaaccugggcccugugugaggcucucacccuggccacagggcccaucucuacgcuuugggaaggaaauccuggcagauucuggaacaccacaaucgccguuuccauggcuaauauuuuucgggggagcuaccuggccggagcgggccuccuguucucuaucaugaagaacaccacaaauacccgcagaggcacggggaacauuggagagacacugggcgaaaaauggaagucccggcucaacgcccuugggaaaagcgaguuucaaaucuauaagaaaucuggcauucaggagguggaucgcacccuggcuaaggaaggcaucaagagaggggagaccgaccaucacgccgucagccggggauccgcuaaacugagaugguucguggaacgcaauaugguuacacccgagggcaagguggucgaucucggcugcgggcggggaggcuggucuuacuauugugggggacugaaaaacgugagagaagugaagggccuuaccaaagggggaccgggccaugaggagccuauccccaugagcacauacggcuggaaucugguucgccuccaguccggggucgacguguuuuucacgcccccugaaaagugcgauacccugcugugugacauuggagagagcucccccaacccuacaaucgaagccggccggacccucagagugcuuaaucuggucgagaacuggcugaauaacaauacacaauucugcauuaagguucucaacccguauaugcccucugugaucgagaagauggagacccugcagcgcaaguacgggggagcgcuugugcggaauccucugagcagaaacuccacgcacgagauguacugggucucuaaugccaccggcaacauugugagcuccguuaauaugaucucucgcaugcucaucaaccgguuuacaaugaaacacaagaaagcuaccuaugaacccgauguggaccuggggagcggaacaagaaacauuggcaucgaguccgaaauuccuaaucuggauaucauuggcaagcgcaucgagaagauuaaacaggaacaugagaccagcuggcacuacgaccaggaccaucccuauaagacaugggccuaccacgggucuuaugagaccaaacaaacgggauccgcuagcucuauggucaacggcgugguucggcuccuuacaaagccgugggauguggucccuauggugacccagauggccaugaccgacacaacgcccuucgggcagcagagaguguuuaaagaaaaggucgauacccgcacacaagagccuaaggaaggaaccaaaaagcugaugaaaaucacagcugaguggcuguggaaggagcucggcaaaaagaaaacccccagaauguguacacgggaagaguucacccgcaagguuagauccaaugccgcgcugggggccaucuuuacggacgaaaacaaguggaaaagcgcucgggaggccguggaagauggaagauucugggagcuuguggaccgggagcgcaaucugcaccucgaaggcaagugcgagaccugugucuacaacaugaugggcaaaagagaaaagaaacugggggaguuuggaaaggcuaagggcucucgggccauuugguauauguggcugggggcccgcuuccucgaauuugaggcgcugggauuccuuaaugaggaucauugguuuuccagaggcaacagccuguccgggguggaaggcgagggacuccaccggcugggcuacauccuucgcgacguuagcaaaaaggaagggggagcuauguacgccgaugacacagccggcugggauaccagaauuacacuggaggaccucaaaaaugaagagauggugaccaaccauaugaagggggagcacaaaaagcuggcugaagccaucuucaagcugacguaucagaauaaagucgugcggguucagcgcccuacacccagaggaaccgugauggacauuaucucucggcgcgaucagagaggcagcgggcaagucggcacauacggacucaacaccuuuacgaauauggaggcucagcugauccggcagauggaaggcgaggggauuuucaaguccauccaacaucuuaccgccacagaggaaaacgcggugcagaauuggcuggcccgcguuggaagagagcggcucucuagaauggcuauuagcggcgacgauugcguggucaaaccgaucgacgaucgcuucgccuccgcucugaccgcccuuaacgacauggggaaggugcggaaagauauucagcagugggaaccuucuagaggauggaacgacuggacacaaguccccuuuugcagccaccacuuccaugagcuggugaugaaggauggccgcguucucgugguccccugucggaaucaggacgaacugaucgggagagcgcgcaucucccagggcgccggauggucucugaaggagaccgcuugccucggcaaaagcuaugcccagauguggacacugauguacuuucaccggagagaucuucgccuggcugccaacgcuauuuguuccgccgugccuagccauugggugccgaccucucggacgacaugguccauccacgcgaagcacgaguggaugaccaccgaagacaugcucgccguuuggaauagaguguggauucaagagaaccccuggauggaagauaaaacaccugucgagagcugggaagaggugcccuaucuggggaagcgcgaggaccaguggugcggaucucuuaucggccugaccucccgggcuacaugggccaaaaauauucagacggccaucaaccagguuagaagccucauugggaaugaagaguacaccgacuauaugccuuccaugaagcgguucagacgcgaagaggaagaggcuggagugcugugguga

SEQ ID NO: 19661 - RNA, 9876 nt, Artificial Sequence
  derived and/or modified CDS sequence (opt5) from DENV-2__GU131947__SS-prME
accgccggagugaucgucaugcugauucccacagcuaucgccuuccaccucacgacccggaauggggagccucauaugauuguuggacggcaggaaaagggcaagagccugcuuuuuaagacagaggacggggugaauaugugcacccugauggcgaucgaucucggagaacugugugaggacacaauuaccuacaagugcccgcuucugcgccaaaaugaacccgaggauaucgacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauucugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacaucguccucgagcacggguccugugugacaaccauggccaagaauaagcccacacuggauuucgaacuuauuaagaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgucacaugcgccauguuuacgugcaaaaagaauauggaagggaaaguugugcagccugagaaccucgaauacaccauugugaucacaccccacagcggggaggagcaugcggucggaaaugacaccggcaagcacggcaaagaaaucaagauuacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgaucgugauuagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucaucggcguggagcccggacagcucaaacugaauugguucaagaagggcuccagcauugggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucgggguggugaucaccuggauuggaaugaacagccgguccacaagccugucuguuucccuuguccucgugggcguggucacccuguaucugggggccauggugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacacgaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacgaacauuuggcugaaacuucgggagaaacaggacguguuuugugauuccaagcugaugagcgccgcuaucaaagacaauagagccguucacgcggauaugggcuauuggaucgaaucugcccucaacgacacauggaagauggagaaggcuuccuucauugaggugaaaagcugccacuggccuaagucucauacccuguggagcaaugggguccuggaauccgagaugaucauucccaaaaacuucgccggaccggugagccagcacaacuaccgcccuggcuaucauacccaaacagcugggcccuggcaccuuggaaagcucgaaauggauuuugaccugugugagggcaccacgguggucguuacagaagauugcgggaaucggggacccucucugagaaccacaaccgccuccggcaaacucaucacagaguggugcugucggagcugcacccugccuccgcuucgcuacagaggcgaggacggguguugguacggaauggaaauucggccccugaaggagaaggaagagaaccucgugaauagccuggugacggccggccaugggcagaucgauaacuucucucugggaguccuuggcauggcucucuuucuggaagagaugcugagaacccgcguggggacaaaacacgcgauucuccugguugccgugagcuucgucacccuuaucacaggaaauauguccuuucgggaccugggcagagugaugguuauggugggcgcuaccaugacggaugacaucgggaugggagucacauaucucgcccugcuggccgcuuucaaggugcgcccuaccuuugccgcgggccuucugcucagaaaacugacaucuaaggagcucaugauggcuaccauugggaucgcccugcuuagccaguccaccauucccgaaacaauccuggagcucacggaugcccuggcucugggaaugaugguucuuaaaauugugcggaacauggaaaaguaccaacuggccgucaccaucauggcgaucucuugcgugccuaaugcuaugauucuccgcaacgccuggaaggugagcuguacaauccuggccgcugucuccguuagcccccuccugcuuaccucuucccagcagaaagccgacuggauuccucuggcucucacaaucaagggccugaaucccaccgccauuuuccugacgacacuuagcagaaccucuaaaaagcgguccuggccgcugaacgaggcgaucauggccguggggauggugagcauccucgcuucuucccugcucaaaaaugacauuccuaugaccggaccccuggucgccggcggccuucugacagugugcuauguucugaccgggcgcagcgcugaucucgaacuggagagagccgccgaggugaagugggaagaccaggcugagaucuccggaagcucuccuauucuuagcaucacaauuuccgaagauggcucuaugagcaucaaaaacgaggaggaagaacaaacgcugaccauucucauccggacagggcugcucgucaucuccggaguguuucccguuucuauuccgaucaccgcggccgcuugguaccugugggaagugaagaagcagcgcgccggcguccuuugggacgugccuucucccccucccgucgggagagccgagcuggaagauggagcuuaucggauuaaacagcgcggcauccugggcuacucccagauuggggccggaguguauaaggagggcacauuccacaccauguggcauguuacgagaggggcggugcucaugcaccggggaaaaagaaucgagcccuccugggcugacgucaagaaagaucugaucagcuacggcgggggauggaaacuugaaggcgaguggaaggaaggcgaggaagugcaaguucuggcccucgagccugggaaaaauccgcgcgccgugcagaccaagcccggaauuuuuaaaacaaacaccggcacaaucggggcugucucccuggacuucagcccuggaaccucuggcucccccauuguggaucggaaggggaaagugguuggacucuacggcaauggcgucgugacaagaagcggggccuaugugucugcgaucgcucagacggagaaguccauugaagacaacccugagaucgaagaugacaucuuucgcaagaaacggcugaccauuauggaucuucaucccggagccggcaagacaaaaagauaccugccugccaucguccgcgaggcuauuaagcgggggcugagaacccucauccuggccccgacccgcgugguugcugccgaaauggaggaggcgcuucggggacugcccauuagauaucagaccccugccaucaaagcugaacacacgggccgggagauuguggaccucaugugucaugccaccuucacaaugcgccugcucagccccgucagagugccuaacuacaaucugaucaucauggacgaagcucacuucaccgaucccgccuccauugccgcucggggguauaucucuacacgcguugagaugggcgaggcggccggaauuuuuaugaccgcuacgccgccuggcagcagagaccccuucccccaauccaacgccccuaucauggaugaggagcgggaaauucccgagagaagcuggaacucugggcacgaaugggugacagacuuuaagggaaagaccgucugguucgugccuuccaucaaagccggcaacgauaucgcugccugccuucgcaagaaugggaaaaagguuauucagcugagccggaaaaccuuugacucugaguacgugaagacaagagcgaacgauugggacuucgucgugaccacagauaucagcgagaugggagcuaauuuuaaggccgaacgcgugauugacccgcggagauguaugaaacccgucauccugaccgauggcgaggaacgcguuauucucgccgggccuaugcccgugacgcauuccucugcugcccagcggagaggccgcaucggaagaaacccuaagaaugagaacgaccaauauaucuacaugggcgaaccccuggagaaugacgaggauugcgcgcacuggaaagaagccaagaugcuucuggacaacauuaauacaccggaggggaucauuccuagcauguucgaacccgagcgggaaaaaguggaugcuaucgacggagaguaccgccucagaggcgaggcccggaagaccuuugucgaucugaugcgcagaggggaccugccuguguggcucgcuuauaaaguugccgcugaaggaauuaacuacgccgaucggaagugguguuucgacggcaucaagaauaaccagauucuugaggaaaacguggaggucgagaucuggacaaaagaaggggagagaaagaaacugaagccccgcuggcuggaugcgcggaucuauuccgacccucucgcccugaaagaauuuaaggaguucgcugccggcagaaagucucuuacccugaaucucauuacggaaaugggacgccugcccaccuucaugacacagaaagcucggaacgcccuggauaaucucgccgugcuucauaccgcugaggcgggcgggagagccuacaaccacgcucugagcgagcugccggaaacacucgagacccugcuucugcucacacugcuggccaccguuacgggaggcaucuuucucuuccuuauguccgggaagggaauuggcaaaaugacacugggcaugugcugcaucauuaccgccagcgugcugcucugguaugcucagauccaaccucacuggaucgccgcgucuauuauccuggaauuuuuccuuauuguccugcucauccccgagcccgaaaagcagcggaccccucaggacaaucagcugacauacguggucauugccauccugaccgugguugcugccacaauggcuaacgagaugggguuucucgagaaaacgaagaaggaucuuggacugggcuccaucaccacacaagaaagcgaguccaauauucuggacaucgaccuccgcccggccucugcguggacccuguaugccguggcuacaaccuucgugacgcccaugcuuagacauagcauugaaaacuccucugucaauguuagccugaccgccaucgcuaaccaggccacagugcucauggggcugggaaaaggcuggccucuguccaagauggauauuggggugccccuccuugcuaucggauguuacagccaggucaauccuauuacccugacagccgcgcugcuccugcuuguggcccacuacgcuaucaucggccccggccugcaggccaaagcuacccgggaggcccaaaagcgcgccgcggcugggauuaugaaaaacccuacgguugacggaaucacagugauugaucucgaaccgauccccuaugacccuaaguuugagaagcagcugggccaggucaugcugcucauucuuugcgugacccagguccugaugaugagaacaaccugggcccugugugaggcucucacccuggccacagggcccaucucuacgcuuugggaaggaaauccuggccgguucuggaacaccacaaucgccguguccauggcuaauauuuuucgcgggagcuaccuggccggagcgggccuccuguucucuaucaugaaaaacaccacaaauaccagacggggcacggggaacauuggagagacacugggcgaaaaguggaaaucccgccucaacgcccuuggaaagagcgaguuucaaaucuauaaaaagucuggcauucaggagguugauagaacccuggcuaaagaaggcaucaagagaggggagaccgaccaucacgccgugagcagaggauccgcuaagcugcgcugguucgucgaacggaauauggugacacccgagggcaaaguuguggaucucggcugcgggagaggaggcuggucuuacuauugugggggacugaagaacguccgcgaagugaaaggccuuaccaaagggggaccgggccaugaggagccuauccccaugagcacauacggcuggaaucuggugcggcuccaguccgggguugacgucuuuuucacgcccccugaaaaaugcgauacccugcugugugacauuggagagagcucccccaacccuacaaucgaagccggcagaacccuccgcgugcuuaaucugguggagaacuggcugaauaacaauacacaauucugcauuaagguccucaacccguauaugcccucuguuaucgaaaagauggagacccugcagcggaaauacgggggagcgcuugugagaaauccucugagccgcaacuccacgcacgagauguacugggugucuaaugccaccggcaacauugucagcuccgugaauaugaucucucggaugcucaucaacagauuuacaaugaagcacaaaaaggcuaccuaugaacccgauguugaccuggggagcggaacacgcaacauuggcaucgaguccgaaauuccuaaucuggauaucauuggcaaacggaucgagaagauuaagcaggaacaugagaccagcuggcacuacgaccaggaccaucccuauaaaacaugggccuaccacgggucuuaugagaccaagcaaacgggauccgcuagcucuauggugaacggcgucgugagacuccuuacaaaaccgugggauguugugccuauggucacccagauggccaugaccgacacaacgcccuucgggcagcagcgcguguuuaaggaaaaaguggauaccagaacacaagagccuaaggaaggaaccaagaaacugaugaagaucacagcugaguggcuguggaaagagcucggcaagaaaaagacaccccggauguguacacgcgaagaguucaccagaaaaguccgguccaaugccgcgcugggggccaucuuuacggacgaaaacaaguggaaaagcgcuagagaggccguugaagauggacgguucugggagcuuguggaccgcgagagaaaucugcaccucgaaggcaaaugcgagaccuguguguacaacaugaugggcaagcgggagaagaagcugggggaguuuggaaaagcuaagggcucucgcgccauuugguauauguggcugggggccagauuccucgaauuugaggcgcugggauuccuuaaugaggaucauugguuuucccggggcaacagccuguccggggucgaaggcgagggacuccaccgccugggcuacauccuuagagacgugagcaagaaagaagggggagcuauguacgccgaugacacagccggcugggauacccggauuacacuggaggaccucaagaaugaagagaugguuaccaaccauaugaaaggggagcacaagaaacuggcugaagccaucuucaagcugacguaucagaauaaggugguccgcgugcagagaccuacaccccggggaaccguuauggacauuaucucucgcagagaucagcggggcagcgggcaagugggcacauacggacucaacaccuuuacgaauauggaggcucagcugauccgccagauggaaggcgaggggauuuucaaauccauccaacaucuuaccgccauugaggaaaucgcgguccagaacuggcuggccagagugggacgggagagacucucucgcauggcuauuagcggcgacgauugcguugugaagccgaucgacgaucgguucgccuccgcucugacagcccuuaaugacauggggaaagucagaaaggauauccagcagugggaaccuucucgcggauggaacgacuggacccaagugcccuuuugcagccaccacuuccaugagcuggucaugaaagauggccgggugcucguugugcccuguagaaaccaggacgaacugauugggcgcgcgcggaucucccagggcgccggauggucucugaaggagacagcuugccucggcaagagcuaugcccagauguggacccugauguacuuucacagacgcgaucuucggcuggcugccaaugcuauuuguuccgccgucccuagccauugggugccgacaucuagaaccacgugguccauccacgcgaaacacgaguggaugacaaccgaagacaugcucgccguguggaaccgcguuuggauucaagagaaucccuggauggaagauaagaccccuguggagagcugggaagagguccccuaucuggggaaacgggaggaccaguggugcggaucucuuaucggccugacauccagagcuaccugggccaagaacauucagacagccaucaaucaggugcggagccucaucgggaacgaagaguacacggacuauaugccuuccaugaaaagauuccgccgggaagaggaagaggcuggaguucugugguga

SEQ ID NO: 19662 - RNA, 9876 nt, Artificial Sequence
  derived and/or modified CDS sequence (opt5) from DENV-2__GQ868558__SS-prME
acagccggagugaucgugaugcugauucccacagcuaucgccuuccaccucacgacccggaauggggagccucauaugauuguuggacggcaggaaaagggcaaaagccugcuuuuuaagacagaggacggggugaauaugugcacccugauggcgaucgaucucggagaacugugugaggacacaauuaccuacaaaugcccgcuucugaagcaaaaugaacccgaggauaucgacuguuggugcaauuccacaucuaccugggugacguauggcaccuguacaaccacaggggagcaccgccgggaaaaacggagcguggcucucgugccucauguuggaaugggccuggagacccgcacggaaacauggauguccucugagggcgccuggaagcacgugcagagaaucgagaccuggauucugcggcaucccggguucacaaucauggccgcuauucucgccuacaccaucggaaccacacacuuucagcgcgcucugauuuucauccuucugacggccgucgcgccuagcaugaccaugagaugcauuggcaucuccaaccgggauuuuguggaagggguuucuggaggcagcuggguggacaucguccucgagcacggguccugugugacaaccauggccaagaauaaacccacacuggauuucgaacuuauuaagaccgaggcuaaacagccugccacgcugcgcaaguauugcaucgaagcuaaacucacaaacaccaccacagagagcagauguccgacccaaggagagcccucucugaaugaagaacaggacaagcgguuuauuugcaagcauuccaugguggaucgcggcuggggcaacggguguggacuguucggcaaagggggaaucgucacaugcgccauguuuacgugcaagaaaaauauggaaggcaagguugugcagccugagaaccucgaauacaccauugugaucacaccccacagcggggaggagcaugcggucggaaaugacaccggcaaacacggcaaggaaaucaaaauuacaccucagucuuccaucaccgaggccgaacugacgggguauggaaccgugacaauggaguguagccccagaaccggccuugauuucaacgaaaugguucugcuccaaauggaggacaaggcuuggcuggugcaccggcagugguuucuugaucugccgcucccuuggcugcccggggccgacacacagggaucuaauuggauucagaaggagacccuggucacguucaaaaacccucaugcuaagaaacaagacgugguugugcucggcucccaggaaggggccaugcacacagcccugaccggcgcuacagagauccagaugagcuccggaaaucuucuguuuaccggccaucucaagugccgccugagaauggauaaacuucaacugaaggggaugucuuacagcauguguaccggaaaguucaaaauugucaaggaaaucgcggagacacagcacggcacgaucgugauucggguccaguaugagggggacggaucccccugcaaaauccccuucgaaauuaccgaucucgagaagagacaugugcugggccgccugaucacaguuaacccuauugugaccgaaaaagacagcccggucaacaucgaggccgaacccccuuuuggggauucuuacauuaucaucggcguggagcccggacagcucaagcugaauugguucaagaaaggcuccagcauugggcaaauguuugagacaaccaugcggggagcuaagagaauggccauccuuggcgacacggccugggauuucgggucucugggaggcguuuuuacaagcauugggaaagcucuccaccagguguucggcgccaucuacggagcggcuuuuuccggcgucucuuggaccaugaagauucugaucgggguggugaucaccuggauuggaaugaacagccgcuccacaagccugucuguuucccuuguccucgugggcguggucacccuguaucugggggccauggugcaggccgacagcggauguguugugucuuggaaaaauaaggaacucaagugcggcuccgggaucuucauuacagauaacguccacacguggaccgagcaguacaaauuucaaccugaaagccccuccaagcuggcuucugccauccagaaagcucaugaggaaggcauuuguggaauccggagcgugacaagacuugagaaucugauguggaagcagaucaccccggagcucaaccacauucuguccgaaaaugagguuaaacugacaaucaugaccggcgacacgaaggggauuaugcaggccggaaaacgcucucuucggccucaacccaccgaacucaaguauagcuggaagacauggggcaaagcgaagaugcauuccaccgagagccacaaccagacauuccugaucgaugggccugaaaccgccgagugccccaauacaaacagagcuuggaacucucuggagguggaagacuacggauuuggcgucuucaccacgaacauuuggcucaaacugcgcgagaagcaggacguguuuugugauuccaaacuuaugagcgccgcuaucaaggacaaucgggccguucacgcggauaugggcuauuggaucgaaucugcccugaacgacacauggaagauggagaaggcuagcuucauugaggucaagagcugccauuggccuaaaucucacacccucuggagcaaugggguccuggaauccgagaugaucauucccaagaacuucgccggaccggugagccagcauaacuacagaccuggcuaucacacccaaacagcugggcccuggcaucugggaaaacuugaaauggauuuugaccucugugagggcaccacgguggucguuacagaagauugcgggaaucgcggacccucucugcggaccacaaccgccuccggcaagcugaucacagaguggugcuguagaagcugcacccucccuccgcugcgguaccgcggcgaggacggguguugguacggaauggaaauuagaccccuuaaggagaaagaagagaaccuggucaauucccucgugacggccggccacgggcagaucgauaacuucucucugggaguccugggcauggcucuuuuucucgaagagaugcugcggaccagaguggggacaaagcacgcgauucugcucguugccgugagcuucgucacccugaucacaggaaauauguccuuucgcgaccuuggccgggugaugguuauggugggcgcuaccaugacggaugacaucgggaugggagucacauaucuggcccuccuggccgcuuucaaagugagaccuaccuuugccgcgggccugcuucugcgcaagcucacaucuaaagagcugaugauggcuaccauugggaucgcccuccugagccaguccaccauucccgaaacaauccuugagcugacggaugcccucgcucugggaaugaugguucugaagauugugagaaacauggaaaaguaccaacuugccgucaccaucauggcgaucucuugcgugccuaaugcugugauucugcggaacgccuggaaagucagcuguacaauccucgccgcuguuuccgugagcccccugcuccugaccucuucccagcagaaggccgacuggauuccucuugugcugacaaucaaaggccucaaucccaccgcuauuuuccugacgacacugagccgcaccucuaagaaaagauccuggccgcuuaacgaggccaucauggcggucgggauggugagcauccuggccucuucccuccugaagaaugacauuccuaugaccggaccccucguugcuggcggccugcuuacagugugcuauguccugaccgggcggagcgccgaucuggaacucgagcgcgcugccgaggugaaaugggaagaccaggccgagaucuccggaagcucuccuauucugagcaucacaauuuccgaagauggcucuaugagcaucaagaacgaggaggaagaacaaacgcuuaccauucugaucagaacagggcuccugguuaucuccggaguguuucccgucucuauuccgaucaccgcugcggccugguaccucugggaagugaagaaacagcgggcuggcguccugugggacgugccuucucccccucccguugggaaggccgagcuugaagauggagccuaucgcauuaaacagagaggcauccugggcuacucccagauuggggcuggaguguauaaggagggcacauuccauaccauguggcacgucacgagaggggccgugcugaugcaucgcggaaaaagaaucgagcccuccugggcggacguuaagaaggaucucaucagcuacggcgggggauggaaacuggaaggcgaguggaaggaaggcgaggaagugcaaguccuugcucuggagccugggaaaaauccgcgggccgugcagaccaagcccggaauuuuuaaaacaaacgccggcaccaucggggcugugucccucgacuucagcccuggaacaucuggcucccccauuguugauagaaaggggaaggucgugggacuguacggcaauggcguggucacccgcagcggggccuaugugucugcgaucgcucagacagagaaauccauugaagacaacccugagaucgaagaugacaucuuucggaagaaaagacucacgauuauggaucugcaccccggagccggcaagaccaaacgcuaccuuccugccaucguucgggaggcuauuaagagagggcugcgcacacugauccucgccccgacccggguggucgcugccgaaauggaggaggcgcugagaggacuucccauucgcuaucagaccccugccaucaaggcugaacauacaggccgggagauuguggaccugaugugucacgccacguucaccaugagacuccugagccccguucgggugccuaacuacaaucucaucaucauggacgaagcucacuucacagaucccgccuccauugccgcucgcggguauaucucuaccagagucgagaugggcgaggcggccggaauuuuuaugacagcuaccccgccuggcagccgggaccccuucccccaauccaacgccccuaucauggaugaggagcgcgaaauucccgagagaagcuggaacucugggcaugaaugggugacggacuuuaaaggaaagacaguuugguucgugccuuccaucaaagccggcaacgauaucgcugccugccugcggaagaaugggaaaaaggucauucagcuuagcagaaagaccuuugacucugaguacgugaaaacccgcgcgaacgauugggacuucguggucacaaccgauaucagcgagaugggagcuaauuuuaaggccgaacggguuauugacccgagacgcuguaugaaacccgugauccugacagauggcgaggaacgggugauucuggccgggccuaugcccgucacccacuccucugcugcccagagacgcggccggaucggaagaaacccuaagaaugagaacgaccaauauaucuacaugggcgaaccccucgagaaugacgaggauugcgcgcauuggaaagaagccaagaugcugcuugacaacauuaauacgccggaggggaucauuccuagcauguucgaacccgagcgcgaaaaaguggaugcuaucgacggagaguacagacugcggggcgaggcccgcaagacauuuguugaucucaugagaagaggggaccugccuguguggcuggcuuauaaggucgccgcugaaggaauuaacuacgccgaucgcaaaugguguuucgacggcaucaagaauaaccagauucucgaggaaaacguggagguugagaucuggaccaaagaaggggagagaaagaaacuuaagccccgguggcuggaugcgagaaucuauuccgacccucuggcccucaaggaauuuaaagaguucgcugccggccgcaagucucugacacuuaaucugauuaccgaaaugggacggcuccccacguucaugacccagaaagcuagaaacgcccuggauaaucuggccgugcuccacacagcugaggcgggcgggcgcgccuacaaccacgcucuuagcgagcugccggaaacccuggagacacuccugcuucugacccuccuggccacagucaccggaggcaucuuucuguuccucauguccgggaagggaauuggcaaaaugacgcuuggcaugugcugcaucauuacagccagcgugcugcugugguaugcucagauccaaccucauuggaucgccgcgucuauuauccucgaauuuuuccugauuguccuucugauccccgagcccgaaaagcagcggaccccucaggacaaucagcucaccuacgugguuauugccauccugacagugguggcugccaccauggcuaacgagaugggguuucuggagaagaccaagaaggaucucggacuuggcuccaucacgacccaagaaagcgaguccaauauucuggacaucgaccugagaccggccucugcguggacacucuaugccgucgcuaccacauucguuacccccaugcugcggcacagcauugaaaacuccucugugaaugugagccuuacggccaucgcuaaccaggccaccguccugauggggcucggaaaaggcuggccucuguccaagauggauauuggggugccccugcucgcuaucggauguuacagccagguuaauccuauuacacuuaccgccgcgcugcugcuccugguggcccauuacgcuaucaucggccccggccuucaggccaaagcuacacgcgaggcccaaaagagagccgcggcugggauuaugaagaacccuaccgucgacggaaucacggugauugaucuggaaccgauccccuaugacccuaaauuugagaagcagcucggccaggucaugcugcugauucucugcgugacacagguucuuaugaugcggaccacaugggcccugugugaggcucugacccucgccaccgggcccaucucuacacugugggaaggaaauccuggccgcuucuggaacacgaccaucgccguguccauggcuaauauuuuuagagggagcuaccuugccggagcgggccuccuguucucuaucaugaaaaacacaaccaauacacggcgcggcaccgggaacauuggagagacgcugggcgaaaaguggaaauccagacugaacgcccucggaaagagcgaguuucaaaucuauaaaaagucuggcauucaggaggucgaucggacacuugcuaaggaaggcaucaaacgcggggagaccgaccaccaugccgugagcagaggauccgcuaagcugcggugguucguugaaagaaauauggugacccccgagggcaaagucguggaucugggcugcgggcgcggaggcuggucuuacuauugugggggacucaagaacgugcgggaaguuaaaggccugacaaaaggcgggccggggcacgaggagccuauccccaugagcaccuacggcuggaaucuugucagacugcaguccgggguggacguguuuuucacacccccugaaaagugcgauacgcuccugugugacauuggagagagcucccccaacccuaccaucgaagccggccgcacacugcggguccucaaucuuguugagaacuggcugaauaacaauacccaauucugcauuaaagugcugaacccguauaugcccucugugaucgaaaagauggagacacuccagagaaaauacgggggagcgcugguccgcaauccucuuagccggaacuccacccacgagauguacugggugucuaaugccacgggcaacauuguuagcuccgugaauaugaucucuagaaugcugaucaaccgcuuuaccaugaagcauaaaaaggcuacauaugaacccgaugucgaccucgggagcggaacccggaacauuggcaucgaguccgaaauuccuaaucuggauaucauuggcaagagaaucgagaaaauuaagcaggaacacgagacaagcuggcauuacgaccaggaccaccccuauaaaaccugggccuaccacgggucuuaugagacaaagcaaaccggauccgcuagcucuauggugaacggcguugugcgccugcucacgaaaccgugggaugucgugccuauggugacacagauggccaugaccgacaccacacccuucgggcagcagcgggucuuuaaggaaaagguugauacgagaacccaagagccuaaagaaggaacaaagaaacuuaugaagaucaccgcugaguggcuguggaaagagcugggcaagaaaaagacaccccgcauguguaccagagaagaguucacacggaaggugcgcuccaaugccgcgcucggggccaucuuuaccgacgaaaacaaauggaaaagcgcuagagaggccguggaagauggacgguucugggagcuggucgacagagagcggaaucuucaucuggaaggcaaaugcgagacguguguguacaacaugaugggcaagcgcgagaaaaagcucggggaguuuggaaaggcuaaaggcucuagagccauuugguauauguggcugggggcccgguuccuggaauuugaggcgcucggauuccugaaugaggaucacugguuuucccgcggcaacagccuuuccgggguugaaggcgagggacugcauagacucggcuacauccugcgggacgugagcaagaaagaagggggagcuauguacgccgaugacaccgccggcugggauacacgcauuacccuugaggaccugaagaaugaagagauggucacaaaccacaugaaaggggagcauaagaagcucgcugaagccaucuucaaacugaccuaucagaauaaggugguuagagugcagcggccuacgccccgcggaacagucauggacauuaucucuagacgggaucagcgcggcagcgggcaagugggcaccuacggacugaacacauuuaccaauauggaggcucagcucaucagacagauggaaggcgaggggauuuucaaauccauccaacaccugacggccauugaggaaaucgcgguucagaacuggcuugccaaggugggacgggagcgccugucuagaauggcuauuagcggcgacgauugcgucgugaaaccgaucgacgaucgguucgccuccgcucucaccgcccugaaugacauggggaaggucagaaaggauauccagcagugggaaccuucucgcggauggaacgacuggacacaagugcccuuuugcagccaccauuuccacgagcuuguuaugaaagauggccgggugcuggucgugcccuguagaaaccaggacgaacucauugggcgcgcgcggaucucccagggcgccggauggucucugaaggagaccgcuugccugggcaaaagcuaugcccagauguggacacucauguacuuucauagacgcgaucugcggcuugcugccaaugcuauuuguuccgccgugccuagccacuggguuccgaccucuagaacaaccugguccauccacgcgaagcaugaguggaugacgacagaagacaugcuggccguguggaaccgcgucuggauucaagagaaucccuggauggaagauaaaaccccuguggagagcugggaagagguucccuaucucgggaagcgggaggaccaguggugcggaucucugaucggccuuaccuccagagcuacaugggccaagaacauucagaccgccaucaaucaggugcgcagccugaucgggaacgaagaguacacagacuauaugccuuccaugaaacgguucagacgggaagaggaagaggcuggaguccucugguga

SEQ ID NO: 19663 - RNA, 9876 nt, Artificial Sequence
  derived and/or modified CDS sequence (opt5) from DENV-2__KJ189305__SS-prME
accgccggcgugaucgucaugcugauucccaccgcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuuaaagagaagcaggacgucuuuugugauuccaaacugaugagcgccgcuaucaaggacaaucgggccgugcacgcggauaugggcuauuggauugaaucugcccucaacgacacguggaagauggagaaggcuagcuucaucgagguuaagagcugccacuggccuaaaucucauacacuguggagcaauggggugcuggaauccgagaugauuauccccaagaacuucgccggaccggcuagccagcacaacuacagaccuggcuauuacacccaaaccgccgggcccuggcaucuuggaaaacucgaaauggauuuugacuucugugagggcacaaccgucguggugacggaagauugcgggaaucgcggacccucucugcggacaaccacagccuccggcaagcugauuaccgaguggugcuguagaagcugcacacucccuccgcugcgguaccgcggcgaggacggguguugguauggaauggaaaucagaccccuuaaggagaaagaagagaaccuggucaauucccucguuaccgcuggccacgggcagauugauaacuuuucucugggagugcugggcauggcgcuuuuccucgaagagaugcugcggacgagaguggggaccaagcaugccauccugcucgucgcugugagcuuuguuacacugaucaccggaaauauguccuuccgcgaccuuggccgggugauggucauggugggcgccacaaugaccgaugacauugggaugggaguuacguaccuggcccuccuggcugccuuuaaagugagaccuacauucgcggcuggccugcuucugcgcaagcucaccucuaaagagcugaugauggccacaaucgggauugcccuccugagccaguccaccauccccgaaaccauucuugagcugacagaugcucucgcccugggaaugaugguccugaagaucgugagaaacauggaaaaguaucaacuugcgguuacgaucauggcuauuucuugcgugccuaaugccgucauccugcagaacgccuggaaagugagcuguaccauucucgcugccguguccgucagcccccugcuccugacaucuucccagcagaaggcugacuggaucccucuugcccugaccauuaaaggccucaaucccacagcgaucuuucugaccacgcugagccggacaucuaagaaacgcuccuggccgcuuaacgaggccaucauggcuguugggauggugagcauucuggccucuucccuccugaagaaugacaucccuaugaccggaccccucguggcuggcggccugcuuaccgucugcuacgugcugacagggagaagcgccgaucuggaacucgagcgggccgcugacguuaaaugggaggaucaagcggaaauuuccggaagcucuccuauccugagcauuaccaucuccgaggacggcucuaugagcauuaagaacgaagaggaggaacagacacuuacgauccugauccgcaccgggcuccuggugauuuccggagucuuccccgugucuaucccgauuacagccgcugccugguaucucugggagguuaagaaacagagagccggcgugcugugggaugucccuucucccccucccguggggaaggcugaacuugaggacggagccuaccggaucaaacagcgcggcauucugggcuauucccaaaucggggcgggagucuacaaggaaggcaccuuucacacaauguggcacgugaccagaggggcuguucugaugcaucggggaaaacgcaucgagcccuccugggccgaugugaagaaggaccucauuagcuacggcgggggauggaaacuggagggcgaauggaaggagggcgaagagguccaggugcuugcccuggaaccugggaaaaauccgagagcuguucagacgaagcccggaaucuucaaaaccaacacaggcaccauuggggccgugucccucgauuuuagcccuggaacaucuggcucccccaucgucgacaagaaggggaaaguggugggacuguauggcaauggcguugucacccggagcggggcguacgugucugcuauugcccagacagagaaguccaucgaggauaacccugaaaucgaggacgauauuuuccgcaagaagcgccucacgaucauggaccugcaccccggagccggcaaaaccaagcgguaucuuccugcuauugugagagaagccaucaagcgcgggcugcggacacugauucucgcuccgaccagagucguggccgcggagauggaagaggcccugcgcggacuucccauccgguaccaaaccccugcuauuaaagccgagcauacaggcagagaaaucguugaccugaugugucacgcuacguucaccaugcgccuccugagccccgugcgggucccuaacuauaaucucaucauuauggaugaggcccauuuuacagaccccgccuccaucgcugcgagaggguacauuucuacccggguggaaaugggcgaggccgcuggaaucuucaugacagccaccccgccuggcagccgcgaucccuuuccccaguccaacgccccuauuauggacgaggaaagagagauccccgaacggagcuggaacucugggcacgaguggguuacggauuucaagggaaaaacagugugguuugucccuuccaucaaggcuggcaacgacauugccgcgugccugcgcaaaaaugggaagaaggugauccagcuuagcagaaaaaccuucgauucugaauauguuaagacccgggcuaacgacugggauuuuguggucacaaccgacauuagcgagaugggagccaauuucaaagccgagagagugaucgauccgcgccgguguaugaagcccgugauucugacagacggcgaagagagagucauccuggcugggccuaugcccguuacccacuccucugccgcgcaacgccggggcagaaucggacgcaacccuaaaaaugaaaacgaccaguacauuuacaugggcgagccccucgaaaaugaugaggacugcgcccauuggaaggaggcuaaaaugcugcuugauaacaucaauacgccggaagggauuaucccuagcauguuugagcccgaacgggagaagguggacgccauugauggagaauauagacugcgcggcgaggcuagaaagacauucguggaccucaugcggcgcggggaucugccugucuggcuggccuacaaaguggcugccgagggaaucaacuaugcggacagaaagugguguuuugauggcauuaaaaauaaccagauccucgaagagaacguugaaguggagaucuggaccaaggagggggaacggaagaaacuuaaaccccgcuggcuggacgccagaauuuacuccgauccucuggcucucaaagaguucaaggaguucgccgcuggccggaaaucucugacacuuaaucugaucaccgagaugggaagacuccccacguuuaugacccagaaggcccgcaacgcccuggacaaucuggcuguccuccacacagcggaagccggcgggcgggcuuauaaccaugcccuuagcgagcugccggagacccuggaaacacuccugcuucugacccuccuggccacagugaccggaggcauuuuccuguuucucauguccgggaaaggaaucggcaagaugacgcuuggcaugugcugcauuaucacagcuagcauccugcugugguacgcccaaauucagccucacuggaucgcggccucuauuauccucgaguucuuucugauuguucuucugauccccgaacccgagaagcagagaaccccucaggauaaucaacucaccuauguggucaucgcuauucugacaguggucgccgcuaccauggccaacgaaaugggguuccuggagaaaacaaagaaagaccucggacuuggcuccaucacgacccaggagagcgaauccaauauucuggacaucgaucugcgcccggcgucugccuggacacucuacgcuguggccaccacauuuguuacccccaugcugcggcacagcauugagaacuccucugugaaugugagccuuacggcuaucgccaaccaggcuaccguccugauggggcucggaaagggcuggccucuguccaaaauggacauugggguuccccugcucgccaucggauguuacagccaggugaauccuaucacacuuaccgcggcccugcugcuccugguggcucauuaugccauuaucggccccggccuucaagcuaaggccacaagagaagcccagaagcgggcggcugccgggauuaugaaaaacccuaccgucgauggaaucacggugauugaccuggagccgauccccuacgauccuaaguucgaaaaacagcucggccagguuaugcugcugauccucugcgugacacaaguccuuaugaugcgcaccacaugggcucugugugaggcccugacccucgccaccgggcccauuucuacacugugggagggaaauccuggcagauuuuggaacacgaccaucgcuguguccauggccaauauuuuccgggggagcuaucuugcgggagccggccugcucuuuucuaucaugaagaacacaaccaauacacgcagaggcaccgggaacauuggagaaacgcugggcgagaaauggaagucccggcugaacacacucgggaaaagcgaguuccagaucuacaagaagucuggaauccaggaggucgaccgcacccuugcuaaagagggcauuaagagaggggaaaccgaucaccaugccgugagccggggauccgcuaaacugcgcugguuuguugagagaaauauggugacacccgaaggcaaggucguggaccugggcugcgggcggggaggcuggucuuauuacugugggggacucaaaaacguuagagaggugaagggccugaccaaagggggaccgggccacgaagaaccuauccccaugagcacauauggcuggaaucuuguccgccugcaauccgggguggauguguucuucacgcccccugagaaaugcgacacccuccugugugauauuggagaaagcucccccaacccuacaaucgaggccggccggacccugagaguucucaaucuugucgaaaacuggcugaauaacaauacacaguuuugcauuaaggugcugaacccguacaugcccucugugaucgagaaaauggaaacccuccagcgcaaguacgggggagcgcugguccggaauccucuuagcagaaacuccacgcaugagauguauuggguuucuaaugccaccggcaacaucgugagcuccgugaauaugauuucucgcaugcugaucaaccgguucacaaugaaacacaagaaggcuaccuacgagcccgacgucgaucucgggagcggaacaagaaacauuggcaucgaauccgagauuccuaaucuggacaucauuggcaaacgcaucgaaaagaucaaacaggagcacgaaaccagcuggcauuaugaccaagaucaccccuacaagacaugggccuaucaugggucuuacgagaccaaacagacgggauccgcuagcucuauggugaacggcguugugcggcugcucacaaagccgugggacgucgugccuaugguuacccagauggccaugaccgauacaacgcccuuugggcagcaaagaguguucaaggagaaagucgacacccgcacacaggaaccuaaggagggaaccaagaaacuuaugaaaauuacagcugaauggcuguggaaagagcugggcaaaaagaagacaccccggauguguacaagagaggaauuuacccgcaaagugagauccaaugccgcgcucggggccaucuucacggaugagaacaaguggaaaagcgcucgggaagccguggaggacggacgcuuuugggaacuggucgauagagagcggaaucuucaccuggagggcaagugcgaaaccuguguuuauaacaugaugggcaaaagagagaagaagcucggggaguucggaaaagcuaagggcucucgggccauuugguacauguggcugggggcccgcuuucuggaguucgaagcgcucggauuucugaaugaggaccacugguucuccagaggcaacagccuuuccgggguggagggcgaaggacugcaucggcucggcuacauccugcgcgauguggggaaaaaggagggaggcgcuauguaugccgacgauacagccgggugggacaccagaauuacacuugaagaccugaaaaaugaggaaauggucaccaaccacaugaagggagagcauaagaaacucgcugaggccaucuuuaagcugacguaccagaauaaagugguucgggugcagcgcccuacacccagaggcaccgucauggauaucauuagccggcgcgaccaaagagggucuggccaggugggaacauauggccugaacaccuucacgaauauggaagcucagcucauccggcaaauggagggggaaggaauuuucaagagcauccagcaccugaccgccacagaggagauugcgguucagaacuggcuugcccgcgugggcagagaacggcugucccgcauggcuaucucuggggaugacugcgucgugaaaccgaucgaugacagauuugccagcgcucucaccgcccugaaugauaugggaaagguucggaaggacauucagcaaugggagccuuccagaggcuggaacgauuggacacaggugcccuucugcucucaucacuuucacgaacuugucaugaaagacgggcgcgugcuggucgugcccugucggaaccaggaugagcucaucggcagagcgcgcauuagccagggagccggcuggucccugaaggaaaccgcuugccuggggaaaucuuacgcccaaauguggacacucauguauuuccaucggagagaccugcgccuugcugccaaugcuaucuguagcgccguuccuucccacugggugccgaccagccggacgacauggucuauucaugcgaagcacgaguggaugaccaccgaggauaugcuggccgucuggaacagaguguggauccaggaaaaucccuggauggaggacaaaacaccuguggaauccugggaggaaguucccuaccucggaaagcgcgaggaccaguggugcggcagccugauugggcuuaccucucgggcuacaugggccaagaacauccagacggccaucaaucaagugagaucccugauuggaaacgaggaauauaccgauuacaugccuagcaugaaacgcuuucggagagaggaagaggaagcuggcguccucugguga

SEQ ID NO: 19664 - RNA, 9876 nt, Artificial Sequence
  derived and/or modified CDS sequence (opt5) from DENV-2__FJ898451__SS-prME
accgccggagugaucgugaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggaucccccugcaagauucccuucgaaaucacagaucucgagaaacgccauguccugggccggcugauuaccgugaacccuaucguuacagaaaaggacagcccggugaacauugaggccgaacccccuuuuggggauucuuacaucauugucggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggucauggugcaggccgacagcggauguauuguuucuuggaagaauaaagaacucaagugcggcuccgggaucuucauuacggauaacgugcacaccuggacagagcaguacaaguuucaaccugaaagccccuccaaacuggccucugcuauccagaaggcccaugaggaaggcauuuguggaaucagaagcgucacccgccuugagaaucugauguggaaacagaucacaccggagcucaaccacauucuguccgaaaaugaggugaagcugaccaucaugacgggcgacauuaaagggaucaugcaggcuggaaagcggucucuuagaccucaacccaccgaacucaaauauagcuggaagacauggggcaaggccaaaaugcuguccaccgagagccauaaccagacauuccugauugaugggccugaaaccgcggagugccccaauacaaaccgcgccuggaacucucucgagguugaagacuacggauuuggcguguucuccaccaacaucuggcugaaacuucgggagaaacaggacgucuuuugugauagcaagcugaugucugcugccaucaaagacaauagagcugugcacgccgauaugggcuauuggauugaauccguucucaacgacacguggaagauggagaaggcgagcuucaucgaggugaaaucuugccacuggccuaagagccauacacugugguccaaugggguccuggaaagcgagaugauuauccccaaaaacuucgccggaccggugucucagcacaacuaccgcccuggcuaucauacccaaaccgcugggcccuggcaccuuggaaagcucgaaauggauuuugacuucugugagggcacaaccguggucguuacggaagauugcgggaaucggggacccucccugagaacaaccacagccagcggcaaacugauuaccgaguggugcugucgguccugcacacucccuccgcugcgcuacagaggcgaggacggguguugguacggaauggaaauccggccccuuaaggagaaggaagagaaccuggucaauucucucgugaccgcuggccaugggcagauugauaacuuuagccugggaguccugggcauggcccuuuuccucgaagagaugcugagaacgcgcguggggaccaaacacgccauccugcucguugcucuguccuuugugacacuuaucaccggaaauaugucuuuccgggaccugggcagagucauggugaugguuggcgcgacaaugaccgaugacauugggaugggagugacguaucucgcccugcuggcugccuuuaagguccgcccuacauucgccgcuggccuucugcucagaaaacugaccagcaaggagcucaugauggccacaaucgggauugcgcugcuuucccagucuacccugcccgaaaccauccucgagcugacagaugcucuggcccuuggaaugauggugcugaaaauuguucggaacauggaaaaguaccaacucgccgugacgaucauggcuaucagcugcgucccuaaugccgugauucugcagaacgcguggaagguguccuguaccauccucgcugccgucagcguuucuccccugcuucugacauccagccagcagaaagccgacuggauuccucucgcucugaccaucaagggccugaaucccacagccauuuuucuuaccacgcugucucgcacauccaaaaagagaagcuggccgcucaacgaggcuaucauggccguggggauggugucuauccuggcguccagccuccugaaaaaugacauuccuaugaccggaccccuugucgccggcggccugcugaccgugugcuauguucucacagggcgguccgcugaucuggaacuugagcgcgccgcugacgugaagugggaggaucaagccgaaaucagcggaucuagcccuauucuguccaucaccauuucugaggacggcagcauguccaucaaaaacgaagaggaggaacagacacucacgauucugaucagaaccgggcuccuggucaucucuggaguguuccccguuagcauuccgaucacagccgcugcgugguaccuuugggaggugaagaagcagcgggccggcguccugugggaugugccuucucccccucccgucgggaaagcugaacuggaggacggagccuaucgcauuaagcagagaggcauccucggcuacagccaaauuggggccggaguguauaaagaaggcaccuuucacacaauguggcauguuaccagaggggcugugcugaugcaccgcggaaagagaaucgagcccagcugggccgaugucaaaaaggaccuuaucuccuacggcgggggauggaagcuggagggcgaauggaaagagggcgaagaggugcagguucucgcgcuggaaccugggaagaauccgcgggcugugcagacgaaacccggaauuuucaagaccaacacaggcaccaucggggccgucagccucgauuuuucuccuggaacauccggcagccccauuguggacagaaaagggaaggugguuggacuguacggcaauggcgucgugacccgcucuggggccuauguguccgcuaucgcccagacagaaaagagcauugaggauaacccugaaaucgaggacgauaucuuccggaaaaagagacuuacgauuauggaccugcaucccggagcgggcaaaaccaagcgcuaccugccugcuaucguccgggaagccauuaaaagagggcuccgcacacugauccuugccccgacccgggugguugcugccgagauggaagaggcucugagaggacuccccauucgcuaucaaaccccugccauccgggcggagcacacaggcagagaaauuguggaccugaugugucaugccacguucaccaugcggcuccugucccccguccgcgugccuaacuacaaucuuaucaucauggaugaggcucacuuuacagaccccgccucuauugcugccagaggguauaucagcacccggguugaaaugggcgaggccgcuggaauuuucaugacagcgaccccgccuggcucccgcgaucccuuuccccagagcaacgccccuaucauggacgaggaaagagagauucccgaacggucuuggaacuccgggcacgagugggugacggauuucaagggaaagacagucugguuugugccuagcaucaaagcuggcaacgacaucgccgccugccugagaaagaaugggaaaaagguuauucagcugucucgcaaaaccuucgauagcgaauacgugaagacccgggcuaacgacugggauuuugucgugacaaccgacaucuccgagaugggagccaauuucaaggcggagagagugauugauccgcgccgguguaugaaacccgucauccucacagacggcgaagagagaguuauucuggcugggccuaugcccgugacccauucuagcgccgcccaacgccggggcagaaucggacgcaacccuaagaaugaaaacgaccaguauaucuacaugggcgagccccuugaaaaugaugaggacugcgcucacuggaaagaggccaagaugcugcucgauaacauuaauacgccggaagggaucauuccuuccauguuugagcccgaaagagagaaaguggacgcgaucgauggagaauaccggcugcgcggcgaggccagaaagacauucgucgaccugaugcggcgcggggaucucccuguguggcuugcuuauaaaguugccgcugagggaauuaacuacgccgacagaaagugguguuuugauggcaucaagaauaaccagauucuggaagagaacguggaagucgagaucuggaccaaagagggggaacggaagaaacugaagcccagauggcucgacgcucgcaucuauucugauccucuggcccuuaaagaguucaaggaguucgcggccggccggaagucccugacacucaaucugauuaccgagaugggaagacugcccacguuuaugacccagaaagcucgcaacgcccucgacaaucuugcugugcugcauacagccgaaguuggcgggcgggccuacaaccacgcucuguccgagcucccggagacccuggaaacacuucugcuccugacccugcucgcgacagugaccggaggcaucuuccuuuuucugaugagcgggaagggaauuggcaaaaugacgcugggcaugugcugcaucauuacagccucuauccuccugugguaugcucaaauccagccucacuggauugccgccuccaucauucuugaguucuuucugaucguccuccugauucccgaacccgagaagcagagaaccccucaggauaaucaacugaccuacguggucaucgcuauccucacagugguugccgcgaccauggccaacgaaaugggguuccuugagaaaacaaagaaggaccugggauuuggcagcauuacgacccaggaguccgaaucuaauauccuggacauugaucuccggccggcuagcgccuggacacuguaugcuguggccaccacauucgugacccccaugcuucgccauuccaucgagaacucuagcgucaauguuucccugacggcgauugccaaccaggcuaccgugcucauggggcugggaaaaggcuggccucugagcaagauggacaucggggugccccuccuugccauuggauguuacucucaggucaauccuaucacacugaccgcugcccugcuccugcuuguggcucacuacgccaucauuggccccggccugcaagcgaaagccacaagagaagcucagaagcgggccgcugccgggaucaugaaaaacccuaccguugauggaauuacggugaucgaccucgagccgauucccuaugauccuaaguuugaaaagcagcugggccaggucaugcugcucauccuuugcgugacacaaguccugaugaugcgcaccacaugggcccugugugaggcgcucacccuggcuaccgggcccaucuccacacuuugggagggaaauccuggcagauucuggaacacgaccauugccgugagcauggcuaauaucuuucgggggucuuaccuggccggagccggccuccuguucuccauuaugaaaaacacaaccaauacacgcagaggcaccgggaacguuggagaaacgcugggcgagaaguggaaaagccggcucaacgcucuugggaagucugaauuucagaucuauaaaaagagcggcauucaggagguggaccgcacacuggccaaagagggcaucaagagaggggaaaccgaucaucacgcggucucccggggaucugccaagcugagaugguucguggagcgcaauaugguuacccccgaaggcaaaguggucgaccucggcugcgggcggggaggcuggagcuacuauugugggggacugaagaacgugagagaggugaaaggccuuacaaaagggggaccgggccaugaggaaccuauccccauguccaccuacggcuggaaucugguucgccuccaaagcggggucgauguguucuuuacacccccugagaaaugcgacacgcugcugugugauauuggagaauccucucccaacccuaccaucgaggcuggccggacacucagagugcuuaaucuggucgaaaacuggcugaauaacaauacccaguucugcauuaagguucucaacccguauaugcccagcgugaucgagaagauggaaacacugcagcgcaaauacgggggagcccuugugcggaauccucuguccagaaacucuacccacgagauguacugggucagcaaugcuacgggcaacauuguguccucuguuaauaugaucagccgcaugcucaucaaccgguuuaccaugaagcacaaaaaggccacauaugagcccgacguggaucugggguccggaaccagaaacauuggcaucgaaagcgagauuccuaaucuggacaucauuggcaaacgcaucgaaaagauuaagcaggagcaugaaacaucuuggcacuacgaccaagaucaucccuauaaaaccugggcguaccacggguccuaugagacaaagcagaccggaagcgccucuuccauggucaacggcgugguucggcuccuuacgaaaccgugggacguggucccuauggugacacagauggcuaugaccgauaccacacccuucgggcagcaaagaguguuuaaggagaaagucgacacgcgcacccaggaaccuaaggagggaacaaagaaacugaugaagaucaccgccgaauggcuguggaaagagcucggcaagaaaaagacacccagaauguguacccgggaggaguucacacgcaaaguuagaagcaaugcugcccugggggcuaucuuuaccgaugagaacaaguggaagucugcccgggaagcgguggaggacggaagauucugggaacuuguggaucgggagcgcaaucugcaccucgagggcaaaugcgaaacgugugucuacaacaugaugggcaagagagagaaaaagcugggggaauuuggaaaagccaagggcucccgggcuauuugguauauguggcugggggcccgcuuccucgaguuugaagcucugggauuccuuaaugaggaccauugguuuagcagaggcaacucccugagcgggguggagggcgaaggacuccaccggcugggcuacauccuucgcgagguugggaagaaagaaggaggcgccauguacgccgaugacaccgcggggugggauacaagaauuacccuggaggaccucaagaaugaagagauggugacaaaccauaugaaaggagagcacaagaaacuggcugaagccaucuucaagcugaccuaucagaauaaggucgugcggguucagcgcccuacgcccagaggcacagugauggacauuaucucucggaaagaucaacgcgggagcggccaggucggaaccuacggccucaacacauucaccaauauggaggcccagcugaucagacaaauggaaggggagggaauuuuuaaguccauccagcaucuuacggcuaccgaggaaauugccgugcagaacuggcuggcucggguuggccgcgagagacucucucggauggccaucagcggggacgauugcguggucaaaccgauugacgauagauucgcguccgcccugacagcucuuaaugacaugggaaaggugcgcaaagauauccagcaaugggaaccuucucggggcuggaacgacuggacccagguccccuuuugcagccaccacuuccaugagcuggugaugaaggaugggagaguucucgugguccccugucgcaaccaggacgaacugaucggccgggccagaauuucccagggagcuggcuggucucugaaggagacagccugccucgggaaaagcuaugcgcaaauguggacccugauguacuuucaccgccgggaucuuagacuggccgcuaaugccaucuguuccgcugugccuagccauugggugccgacaucucgcaccacgugguccauucacgccaagcacgaguggaugacaaccgaagacaugcucgcuguuuggaaccggguguggauccaggagaaucccuggauggaagauaaaaccccugucgagagcugggaagaggugcccuaucugggaaagagagaggaccaguggugcggcucucuuauugggcugacaucccgcgccaccugggcgaaaaacauccagacagccauuaaucaaguucggagccucaucggaaacgaagaguacacggacuauaugccuuccaugaagagauuccggagagaagaggaagaggcuggcgugcugugguga

SEQ ID NO: 19665 - RNA, 9876 nt, Artificial Sequence
  derived and/or modified CDS sequence (opt5) from DENV-2__HM488257__SS-prME
accgccggaaucauuaucaugaugauucccacggugauggcuuuccaccugacgaccagaaacggggaaccucauaugaucgucagccggcaggaaaagggaaaaagccuccuguuuaagacagagaauggcguuaacaugugcacccuuauggccauggaccugggggaacucugugaggauacaauuaccuacaauugcccgcugcuucgccaaaacgaacccgaggacaucgauuguuggugcaauucuacaagcaccugggugacguauggaaccuguacagugaccggcgagcacagacgggaaaaacgcuccgucgcgcuggugccucauguugggaugggacucgagacaagaaccgaaacguggaugucuagcgagggcgcuuggaagcacgcccagcggaucgagacaugggugcugcgccaucccggcuucaccauuauggccgcuauccuggccuacacaauugggaccaccuauuuucagagaguccucaucuucauucugcuuacagcuguggccccuuccaugacgaugcggugcaucggaauuucuaaccgcgacuuuguugaaggcgugagcgggggauccugggucgauaucgugcuggagcacggcagcugugugaccacaauggcgaaaaauaagcccacccucgacuucgaacugaucaagacagaggccaaacacccugcuacccuuagaaaguacugcauugaagccaaacugacgaacacaaccaccgcuucucgguguccgacacagggggagcccucccucaaugaggaacaagauaagcgcuuugucugcaaacauagcaugguugacagaggauggggcaacggcugugggcuguucggaaagggcgggaucgugaccugcgccauguuuacaugcaagaaaaauauggagggaaagauugugcagccugaaaaccuggaguauacgaucgucauuacaccccacucuggcgaagagaaugcgguggggaacgauacaggaaaacauggcaaggagaucaaaguuaccccucaguccagcaucacagaagccgagcucaccggcuacgggacggugaccauggaauguucuccccggacaggacuggacuucaaugagaugguccuucugcagauggaaaacaaggcuuggcucgugcaccgccaaugguuucuggaucuuccgcugccuuggcuccccggcgccgacacccagggguccaacuggauucagaaagagacacugguuaccuucaagaauccucacgcuaagaaacaggauguggucgugcugggaagccaagagggcgccaugcauacggcccucacaggggcuaccgaaauccagauguccucuggcaaccugcuuuuuacaggacaccugaagugcagacuccggauggacaaacugcagcuuaagggcaugagcuauuccauguguaccgggaaauucaaggucgugaaggagauugcggaaacccaacauggaacaaucguuauuagagugcaguacgagggcgacgggagccccugcaaaauccccuucgagaucauggaucuggaaaagcgccacguccucggacggcugauuacggugaauccuaucguuaccgagaaagacucuccggugaacauugaagccgagcccccuuuuggcgauuccuacaucauugucgggguggaacccggccagcugaagcucagcugguucaaaaagggaucuagcaucggccagauguuugagacaaccaugagaggggcuaagcgcauggccauucugggagacacagccugggauuucggcucccuugggggaguguuuaccucuaucggcaaagcucugcaucaaguuuucggggccaucuauggcgcggcuuuuagcggagucuccuggacgaugaagauucucaucggcguggugauuacauggaucgggaugaauagccggucuaccucccugagcgucucucuggugcuuguuggaguggucacccucuaccugggcgugaugguucaggccgacuccggguguguggucagcuggaaaaacaaggagcugaaaugcggauccggcauuuucaucacagauaaugugcacaccuggacagaacaguauaaguuucagccugagucucccagcaagcucgccuccgcuauccaaaaagcccacgaagaggggauuuguggcaucagaucuguuacgcgccuggaaaaccuuauguggaagcagauuaccccggagcugaaucauauccucagcgagaacgaagugaaacugacaauuaugaccggagacaucaagggcaucaugcaggcugggaaacggucccugagaccucagcccacagagcuuaaguacagcuggaaagccuggggaaaggcgaagaugcucucuaccgaacugcacaaucauacguuccugauugauggcccugagaccgccgaaugccccaacacaaaucgcgcuuggaacucccucgaggucgaggacuauggguuuggaguguucaccacaaauaucuggcugaaacuuaaggaacggcaagauguguuuugugacagcaaacugaugucugccgcuauuaaggacaacagagccguccacgcggauaugggcuacuggaucgaguccgcccucaacgacaccuggaaaauugaaaaggcuagcuucaucgagguuaagucuugccacuggccuaaaagccauacacugugguccaauggcgugcuggagagcgaaaugaucauucccaagaacuucgccgggccggugucucagcacaauuaucgcccuggauaccauacccagacggcuggccccuggcaccuugggcggcucgagauggauuuugacuucugugaaggaacaaccgucgugguuaccgaggauugcggcaacagagggcccucccugcggacaaccacggccagcggaaaacugaucacagaauggugcugucgcuccugcacccucccuccgcugagauaccggggcgaggacggcuguugguaugggauggagauuagaccccuuaaggaaaaagaggaaaaucuggugaacucucucgucacagccggacauggccagaucgauaauuuuagccugggggugcugggaauggcucuuuuccucgaggaaaugcugcgcacccggguuggcacaaagcacgcgauucugcucguggccgucuccuuugugacccugaucacggggaacaugucuuucagagaccuuggacgcguuauggugauggucggcgcuaccaugacagaugacauuggcaugggggugaccuaccuggcccuccuggccgcuuuuaaggugagaccuacauaugccgcgggacugcuucugcggaaacucaccagcaaggagcugaugaugacgacaaucggcaucguccuccugucccaaucuaccauucccgagacaauccuugaacugaccgaugcucucgcccuggggaugaugguucugaaaauugugcgcaauauggagaaguaccagcuugccgugaccaucauggcuauucugugcgucccuaacgccgugauccuccagaaugcguggaaaguuagcuguacaacgcuggcuaugguguccgucagcccccuccugcuuaccucuucccaacagaaggccgacuggaucccucuggcccucacaauuaagggacugaaccccaccgcuaucuuccugacaacccuuagcagaacgucuaaaaagcgguccuggccgcugaaugaagccauuauggcugugggcaugguuagcauccucgccucuucccugcucaaaaacgauauuccuaugacagggccccugguggcgggaggccuucugaccgucugcuaugugcugaccggccgcagcgccgaccucgagcuggaaagagcugccgacguccggugggaggagcaggcugaaaucuccgggagcucuccuauccuuagcauuacaaucuccgaggauggaucuaugagcauuaagaaugaagaggaggaacagacccugacaauccucauucgcacgggccugcucgugaucuccgggcuguuucccguuucuauuccgaucaccgccgccgcuugguaccuuugggaggugaaaaagcaaagagcgggaguccugugggacgugccuucucccccucccguuggcaaagccgaacuggaggauggggcuuaucggaucaagcagaagggcauucucggcuacucccagaucggcgccgggguguacaaagaaggaacauuccacaccauguggcaugucacacgcggcgccgugcugaugcacaaggggaaaagaauugagcccuccugggcugacgugaagaaagaucuuaucagcuauggaggcggguggaagcuggagggagaauggaaggagggcgaagagguucagguccucgcccuggaaccuggcaaaaacccgcgggcggugcaaaccaagcccgggcucuuuaaaacgaacaccggaacaauuggcgcugugucccuggacuucagcccugggaccucuggaucccccaucgucgauaagaaaggcaaggugguugggcuuuacggaaauggcguggucacaagaagcggcaccuaugugucugccaucgcccagacagagaaguccauugaggacaacccugaaaucgaggaugacauuuuucgcaaaaagcggcugacgaucauggaucugcaucccggggcuggaaaaaccaagagauaccucccugccauuguucgcgaagcgaucaaacggggccugagaacacuuauccuggcuccgacccgcguggucgccgccgagauggaagaggcucuccgggggcugcccauuagauaucagaccccugccauccgcgcugagcacacaggacgggaaauuguggaccucaugugucaugccacguucaccaugagacugcuuagccccauccggguuccuaauuacaaccugauuaucauggaugaggcgcacuucacagaccccgccuccauugcugcccgcggcuauaucucuaccagaguggaaaugggggaggcugccggcaucuuuaugacagccaccccgccuggaagccgggaccccuucccccaguccaaugcuccuauuauggaugaggaacgcgagauccccgaaagaagcuggaacucuggccacgagugggucacggacuuuaaggggaagacagugugguucgugccuuccauuaaagcgggaaaugauaucgccgcuugccugcggaagaacggcaaaaaggucauucaacucagcagaaaaaccuuugacucugaauacaucaagacccgcacaaaugauugggacuucguugugaccacagauaucagcgagaugggggccaacuuuaaggccgagcgggugauugacccgagacgcuguaugaaacccgucauccugaccgauggagaagaacgggugauucuugcuggcccuaugcccguuacgcauuccucugccgcgcagagacgcgggcgggugggcagaaauccuaagaacgaaaaugaccaguacaucuauaugggagagccccuggaaaacgaugaggacugcgcucacuggaaagaggccaagaugcuccuggacaauauuaacacaccggaaggcaucaucccuagcauguucgagcccgaacgcgagaaagucgaugccauugacggggaauacagacugcggggagaggcucgcaagaccuuuguggaucucaugagacggggcgaccuuccuguuuggcuggccuaucgcguggcggccgaggggaucaacuacgcugauagacggugguguuucgacggagucaaaaauaaccaaauucuggaagagaauguggaagucgagaucuggacaaaggagggcgaaagaaagaaacucaagccccgcuggcuggaugcccggauuuauuccgacccucuugcucugaaagaguuuaaggaguucgccgcugggagaaaaucucucacccugaaccugaucacggagaugggccgccuccccaccuucaugacacagaaggcccggaaugcgcuugauaaccuggccgugcugcauaccgcugaagccggaggcagagcuuacaaucacgcccucagcgagcugccggagacacuugaaacccugcuccugcugacacuccuugccaccguuacaggcgggauuuuucuguuccugauguccgggaaggggaucggaaaaaugacacucggcaugugcugcaucauuaccgcuagcauccugcuuugguaugcgcagauucagccucacuggaucgccgcuucuauuauccuggaguuuuuccucaucgugcugcugauucccgaacccgagaagcaacggaccccucaggacaaccagcucacauacguggucaucgccauucuuaccguuguggccgcuacaauggccaaugaaaugggcuuucuggagaaaacgaagaaagauuucgggcugggauccaucaccacacagcaaccggagagcaacauucucgacaucgaucugcgccccgcguccgccuggacccuuuacgcuguggccacaaccuuuaucacgccuaugcugagacauucuauugaaaauagcuccgucaacgugucucucaccgcuaucgccaaucaggcgacaguucugaugggccuggggaagggauggccccucagcaagauggacauuggcgugccucuucuggccaucggguguuauucccaggucaaccccauuacccugacagcugcccuccugcuucugguggcucacuacgccaucauuggaccuggccuccaggcuaaagccacccgggaggcgcaaaagcgcgccgcugccggcaucaugaaaaauccgacggucgacgggaucacagugauugaucuggaccccaucccuuaugaucccaaguucgaaaaacagcugggacagguuaugcuccuugugcugugcgucacccaggugcugaugaugagaacaaccugggcucucugugaggcccugacccuugccacaggcccuauuagcacgcugugggaagggaaccccggacgguuuuggaauaccacaaucgcgguuucuauggcuaacauuuuccgcggcuccuaccucgccggggcuggacugcuguuuagcaucaugaagaacaccgccaauacaagacggggcaccggcaacacgggggagacacucggagagaaguggaaacaucgccuuaaugcccugggcaagucugaguuccaaaucuauaaaaaguccgggauucaggagguggacagaacccuggcuaaagaaggaaucaagcggggcgagaccgaucaccaugccgucagcagagggucugcgaaacuccgcugguuuguggagcggaaccuggugacaccggaaggaaagguugucgaccuuggcugcggcagagggggauggagcuacuauuguggcgggcugaagaaugugaaagaggugaagggacucaccaaaggcgggccuggacacgaagaacccauucccauguccacauacggcuggaaccugguccgccugcagucuggcguugauguguucuucacgccucccgaaaagugcgacacccuccuuugugauaucggggagagcuccccuaauccgacaguggaggccggacggacccugagaguccugaaccucguggaaaauuggcugaacaauaacacacaauuuugcauuaaaguucuuaaucccuacaugccuagcgugaucgagaagauggaagcucugcagcgcaaguauggcggggcccucguccggaacccccuguccagaaauucuacccacgagauguacugggugagcaacgcuuccggaaacaucguuucuagcgugaauaugauuucccgcaugcugaucaaccgguucacgaugagacauaaaaaggccaccuaugaaccugacgucgaucucggcucugggacacgcaauauuggaaucgagagcgagacccccaaccuugacauuaucggcaaacggaucgaaaagauuaaacaggagcacgaaacauccuggcauuacgaucaggaccacccguauaagaccugggcguaccacggcagcuaugagacaaagcaaaccgggucugccuccagcauggugaauggaguggucagacugcugacgaaaccuugggacguuauccccauggugacacagauggcuaugaccgauaccacaccuuuuggccagcagcgcguguucaaggaaaaagucgacacgagaacccaagagcccaaggaggggaccaaaaagcucaugaagauuaccgccgaauggcuguggaaagagcuuggaaagaaaaagacaccucggauguguacccgcgaagaguuuacaagaaaagugcggucuaacgcugcccugggcgcuaucuucaccgaugagaauaaguggaaauccgccagagaagcgguugaggacagcggguuuugggaacucguggauaaggagcggaaccugcaucuggaaggaaagugcgagacgugugucuacaauaugaugggcaaacgcgagaagaaacucggcgaguucgggaaggccaaaggaucuagagcuauuugguacauguggcugggcgcccgguuucuugaguucgaagcucugggguuucucaacgaggaccacugguucucccgcaagaauagccuguccggaguggaaggcgaggggcuucauaagcugggcuauauccucagagauguuagcaaaaaggagggaggcgccauguacgccgacgauaccgcggggugggacacacggauuacccuggaagaucugaaaaacgaggaaauggugacaaaucacauggagggagaacauaagaaacucgcugaggccaucuuucgccugaccuaucagaacaaggucgugagaguucagcggcccacgccgcgcggcacagugauggacaucauuucuagacgggaccagcgcgggagcggacaagucgugaccuacggccuuaauacauucaccaacauggaggcccagcugaucagacagauggaaggggagggcgucuucaaguccauucaacaccucacggcuaccgaagagaucgccgugaaaacauggcugguucgggugggacgcgagagacuuucucggauggcuauuagcggcgaugacugcgucgugaagccucuggaugacagauuugccuccgcgcucaccgcccugaacgauauggggaaagugcgcaaggacauccagcagugggaacccucucggggauggaaugauuggacacagguucccuucugcagccaccauuuucacgagcugaucaugaaagacggcagagugcucgucgugccuugucgcaaccaagaugaacugauugggcgggcuagaaucucccagggagccggcuggucucuucgcgagaccgcuugccugggaaagagcuaugcccagauguggucccucauguacuuccaucggagagaccugcgccuugcggccaaugcuauuuguagcgccguuccgucucacugggugcccacaucccggaccacguggagcauccacgcuacacaugaauggaugaccaccgaggauaugcugacagucuggaacagaguguggauucaggagaauccuuggauggaagacaagacccccgucgagucuugggaagagaucccuuaucucggcaaacgcgaagaucaauggugcggaucccugaucggccugacaagccgggccacgugggcuaagaacauucagaccgccaucaaucaggugagaucccucauugggaacgaggaguacacagacuacaugcccucuaugaaacgguuuagacgcgaagaggaagaggcgggaguucugugguga

SEQ ID NO: 19666 - RNA, 9876 nt, Artificial Sequence
  derived and/or modified CDS sequence (opt5) from DENV-2__HQ999999__SS-prME
accgccggcgugaucguuaugcugauucccacagcuauggccuuccaccucacgacccggaauggggagccucauaugaucguuggacggcaggaaaagggcaagagccugcuuuuuaagacagaggacggggugaauaugugcacccugauggccauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcguggcucucgugccucauguuggaaugggccuggagaccagaacggaaacauggauguccucugagggcgccuggaaacacauccagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuuguugaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccgaucaacauugaggccgaacccccuuuuggggauucuuacaucaucauuggcguggagcccggacagcucaaacugaauugguucaagaagggcuccagcaucgggcaaauguuugagacaaccaugagaggagcuaaacgcauggccauucuuggcgacacggccugggauuucgggucucugggaggcgucuuuacaagcaucgggaaggcucuccaccagguguucggcgccauuuacggagcggcuuuuuccggcguuucuuggaccaugaaaauccugaucggggugauuaucaccuggauuggaaugaacagccgguccacaagccugucugucucccuugugcucgugggcguugucacccuguaucugggggccauggugcaggccgacagcggauguguggucucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcaucuguggaauuagaagcguuacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgaggucgaagacuacggauuuggcguguucacaaccaacauuuggcugaaacuuaaagagaagcaggacgucuuuugugauuccaaacugaugagcgccgcuaucaaggacaaucgggccgugcacgcggauaugggcuauuggauugaaucugcccucaacgacacguggaagauggagaaggcuagcuucaucgaggucaagagcugccacuggccuaaaucucauacacuguggagcaauggggugcuggaauccgagaugauuauccccaagaacuucgccggaccgguuagccagcacaacuacagaccuggcuaucauacccaaaccgcugggcccuggcaccuuggaaaacucgaaauggauuuugaccugugugagggcacaaccguggucgugacggaagauugcgggaaucgcggacccucucugcggacaaccacagccuccggcaagcucauuaccgaguggugcuguagaagcugcacacugccuccgcuucgguaccgcggcgaggacggguguugguacggaauggaaaucagaccccugaaggagaaagaagagaaccucgucaauucccuggucaccgccggccaugggcagaucgauaacuucucucugggaguucuuggcauggcucucuuucuggaagagaugcugcggacgagaauugggaccaagcacgcgauccuccugguggccgugagcuucgucacacuuauuaccggaaauauguccuuucgcgaccugggccgggugaugguuauggugggcgcuacaaugaccgaugacaucgggaugggagucacguaucucgcccugcuggccgcuuucaaagugagaccuacauuugccgcgggccuucugcuccgcaagcugaccucuaaagagcucaugauggcuacaauugggaucgcccugcuuagccaguccaccauccccgaaaccauucuggagcucacagaugcccuggcucugggaaugaugguucuuaagguggucagaaacauggaaaaguaccaacuggccgugacgaucauggcgauuucuugcguuccuaaugcugugauccuccagaacgccuggaaagucagcuguaccauucuggccgcuguguccgugagcccccuccugcuuacaucuucccagcagaaggccgacuggaucccucuggcucucaccaucaaaggccugaaucccacagccauuuuccugaccacgcuuagccggacaucuaccaagcgcuccuggccgcugaacgaggcgaucauggccgucgggaugguuagcauucucgcuucuucccugcucaaaaaugacaucccuaugaccggaccccugguggccggcggccuucugacagugugcuauguccugaccgggagaagcgcugaucucgaacuggagcgggccgccgacgugaagugggaggaucaagcugaaauuuccggaagcucuccuauccuuagcauuacaaucuccgaggacggcucuaugagcaucaaaaacgaagaggaggaacagacgcugaccauucucauccgcacagggcugcucguuauuuccggaguguuucccgucucuaucccgauuaccgcggccgcuugguaccugugggaggugaagaagcagagagccggcguucuuugggaugugccuucucccccucccgucgaaaaagccgagcuggaagacggggcuuaucggaucaagcagcgcggaauccugggcuacucccaaauuggcgccgggguguauaaagagggaacauuccacaccauguggcaugucacgagaggcgcggugcucaugcaccgggggaagcgcaucgagcccuccugggcugauguuaaaaaggaccugauuagcuacggaggcggguggaaacuugaaggagaguggaaagaaggcgaggaagugcagguccuggcccucgagccuggcaagaauccgagagccgugcagaccaaacccgggaucuuuaagacaaacaccggaacaauuggcgcuguuucccuggauuucagcccugggaccucuggaucccccaucguggaccggaaaggcaaggucguggggcucuacggaaauggcgugguuacaagaagcggcgccuaugucucugcgaucgcucagacggagaaguccauugaagauaacccugagaucgaagacgauauuuuucgcaaaaagcggcugaccaucauggaccuucaucccggggccggaaaaacaaagagauaccugccugccauugugcgcgaggcuaucaaacggggccugagaacccucauucuggccccgacccgcguggucgcugccgaaauggaggaggcgcuucgggggcugcccaucagauaucaaaccccugccaucaagacggaacacaccggacgcgagauuguggaccucaugugucaugcuacauucaccaugcggcugcucagccccguuagagugccuaacuacaaucugaucauuauggaugaagcccacuucacagaccccgcuuccaucgccgcccggggcuauauuucuacccgcgucgagaugggggaggcugcgggcaucuuuaugacggccacaccgccuggaagcagagaucccuucccccaguccaacgcuccuaucauggacgaggaacgggaaauucccgagcgcagcuggaacucuggccacgaaugggugaccgauuuuaaggggaaaaccguuugguucgugccuuccaucaaggccggaaacgacauugccgcuugccuucgcaagaauggcaagaaagucauccagcugagccggaagacauuugauucugaguacgugaagaccagagccaacgacugggauuucguugugacaaccgacauuagcgagaugggggcgaauuuuaaagcugaacgcgucaucgauccgcggagauguaugaagcccgugauccugacggacggagaggaacgcgugauucucgccggcccuaugcccgucacacauuccucugccgcucaacggagagggcgcaucggccggaacccuaaaaaugagaacgaccaguauauuuacaugggagaaccccuggagaaugaugaggacugcgcccacuggaaggaagcgaaaaugcuucuggauaacaucaauaccccggagggcauuaucccuagcauguucgaacccgagagagaaaagguugacgccauugauggggaguaccgccucagaggagaggcucggaaaacauuuguggaccugaugcgcagaggcgaucugccuguguggcucgccuauaaggucgcugccgaagggaucaacuacgcugaccggcgcugguguuucgauggaaucaagaauaaccagauucuugaggaaaacauggagguggagaucuggaccaaagaaggcgagagaaagaaacugaagccccgguggcuggacgccagaauuuauuccgauccucucgcgcugaaagaauuuaaggaguucgccgcugggcgcaagucucuuacgcugaaucucaucaccgaaaugggccggcugcccacauucaugacccagaaagccagaaacgcucuggacaaucucgccguucuucauacagccgaggcuggaggccgcgcguacaaccacgcccugagcgagcugccggaaacccucgagacacugcuucugcucacccugcuggcuacggugacagggggaauuuuucucuuccuuauguccggcaaggggaucggaaaaaugacccugggcaugugcugcaucauuaccgccagcauccugcucugguaugcccaaauucagccucacuggaucgcugccucuauuauccuggaauuuuuccuuaucguccugcucauucccgagcccgaaaagcagcggacaccucaggauaaucaacugaccuacgugguuaucgcgauucugacaguggucgccgcuacgauggccaacgagaugggcuuucucgagaaaaccaagaaggaccuugggcugggauccaucacaacccaggaaagcgaguccaauauucuggacaucgaucucagaccggcuucugccuggacacuguaugcgguggccaccacguuccuuacccccaugcugcggcauagcauugaaaacuccucugucaaugugagccucacagcuaucgccaaccaggcuaccguucugaugggccuggggaaaggauggccucucuccaagauggacaucggcgcgccccuucuggcuauuggguguuacagccaggugaauccuaucacacugaccgccgcgcuccugcuucugguggcccacuacgcuauuaucggacccggccuccaagccaaagcuacgcgcgaggcccagaagagagccgcggcuggcauuaugaaaaacccuacagucgaugggaucaccguuaucgaccuggauccgauucccuaugacccuaaguuugaaaagcagcugggacaggugaugcuccuuauccugugcgugacacaaguccugaugaugcggaccaccugggcccucugugaggcucugacacuugccacgggccccauuucuacccugugggaggggaauccuggacgcuucuggaacacaaccaucgccguguccauggcuaauauuuuuagaggcagcuaccucgccggggcgggacugcuguucucuaucaugaaaaacacaaccuccacgcggcgcggcacaggcaauaucggggaaacccucggagagaaguggaaaagcagacuuaacgcccugggcaagucugaauuucagauuuauaaaaagagcgggauccaggagguugaucggacccuggcuaaagagggaauuaagcgcggcgaaacagaccaucacgccguguccagagggucugcuaagcuccggugguucgucgagagaaacauggugacccccgaaggaaaagucguggaucugggcugcggccgcgggggauggagcuacuauuguggcgggcuuaagaauguucgggaggugaaaggacugacaaagggcgggccgggacaugaggaaccuauccccauguccacguacggcuggaaccucgucagacugcaaagcggcguggacgucuuuuucacacccccugagaaaugcgauacccugcucugugacauuggggaauccucucccaauccuaccaucgaggccggacgcacacuucgggugcugaaccuggucgaaaauuggcucaacaauaacacccaguucugcaucaaggugcugaauccguauaugcccagcgugauugagaagauggaagcgcuucagagaaaauacggcggggcccugguucgcaacccucucuccagaaauucuacgcacgagauguacugggucagcaacgcuaccggaaauaucguguccucugugaacaugauuagcagaaugcugaucaaucgcuuuacaaugaagcacaaaaaggccaccuaugagcccgaugucgaccugggcuccgggacacggaacauuggaaucgaaagcgagguuccuaaccucgacauuaucggcaaaagaaucgaaaagauuaagcaggagcaugaaaccucuuggcacuacgaucaagaccaucccuauaaaacaugggcuuaccacggcuccuaugagaccaagcagacggggagcgccucuuccauggugaauggagugguccgccuucugacaaaaccgugggaugugguuccuauggugacccagauggcuaugaccgacacaacgcccuucggccagcaacgggucuuuaaggagaaaguggauaccagaacacaggaaccuaaggaggggaccaagaaacugaugaagaucacagccgaauggcucuggaaagagcugggaaagaaaaagacacccagaauguguacaagagaggaguucacccggaaaguucgcagcaacgcggcccuuggcgcuauuuuuacggacgagaauaaguggaagucugccagagaagcuguggaggaugggcgguucugggaacuggucgacagagagcggaaccuccaccuggagggaaaaugcgaaaccuguguguacaauaugaugggcaagcgcgagaaaaagcugggcgaauuugggaaagccaagggauccagagccaucugguauauguggcucggcgcgcgguuccuggaguuugaagcucuuggguuccugaacgaggaucauugguuuagccgcggaaauucccucagcggcguggagggggaaggccugcacagacuuggauacauucugcgggaggucucuaagaaagaaggcggggccauguacgccgacgauacagcuggaugggacacccgcaucacacucgaggaccugaagaacgaagagaugguuaccaaucauaugaaaggcgagcacaagaaacuggccgaagcuaucuucaagcucacguaucagaacaagguggugagaguccagcggccuacaccccgcgggaccgugauggauauuaucagcagacgggaccaacgcggauccggccagguugggacauacggccugaauaccuuuacgaacauggaggcccagcuuauuagacaaauggaaggagagggcaucuucaaaucuauucagcaucugaccgcgacagaggaaaucgccgugcagaauuggcucgcucgggucgggcgcgagagacugagccggauggccaucuccggagaugacugcgugguuaagccgauugaugacagauucgcuucugcccuuaccgcgcugaacgauaugggcaaagugcgcaaggacauccagcaaugggaaccuagccggggguggaaugauuggacacagguccccuuuugcucccaccacuuccaugagcucgugaugaaagacggaagaguucuggugguccccugucgcaaccaggaugaacugauuggccgggccagaaucucucagggggcuggcuggagccucaaggagaccgccugccugggaaaguccuaugcucaaauguggacacuuauguacuuucaccgccgggaccugagacucgccgcuaacgccauuuguagcgcggugccuucucauugggucccgaccucccgcacgacauggagcauccacgccaaacacgaguggaugaccaccgaagauaugcuggcuguguggaaucggguuuggauucaggagaaccccuggauggaagacaagacaccuguggagucuugggaagagguccccuaucuuggcaaaagagaggaccaguggugcgggucccugaucggacucaccagccgcgccacaugggccaagaauauccagacggcuauuaaccaagugcggucccugaucggcaaugaagaguacaccgauuauaugccuucuaugaaaagauuccggagagaagaggaagaggccggggugcugugguga

SEQ ID NO: 19667 - RNA, 9876 nt, Artificial Sequence
  derived and/or modified CDS sequence (opt5) from DENV-2__FJ898449__SS-prME
accgccggaaugaucauuaugcugauccccacagucauggcuuuccaccucacgacccggaacggggagccucauaugauugucagccggcaggaaaagggaaaaucccugcuuuuuaagacaaaagacggcaccaauaugugcacacugauggccauggaucucggggagcugugugaagacaccaucacauacaagugcccguuccuuaaacaaaacgagcccgaagauauugacuguuggugcaauucuaccagcacguggguuaccuauggaacauguaccacaaccggcgagcaccgccgggagaagcgguccguggcgcuggugccucaugucgggaugggacucgaaacgcgcacagagaccuggaugucuagcgaaggcgcuuggaagcacgcccagcggaucgagacauggauccugcggcaucccggcuuuaccauuauggccgcuauccuggccuacaccauugggacaacgcacuuccagcgcgugcucaucuuuauucugcuuaccgcuaucgccccuuccaugacaaugagaugcauuggaaucucuaaccgggauuucguugagggcgugagcgggggauccugggucgacaucgugcuggaacacggcagcuguguuaccacaauggcgaaaaauaagcccacccucgauuuugagcugauuaaaacggaagccaagcagccugcuacacuucgcaaauauugcaucgaggccaagcugaccaacaccacaaccgacucuagauguccgacacaaggggaacccacgcucaaugaggagcaggauaagcgguucgugugcaaacauuccauggucgaccgcggauggggcaacggcugugggcuguuuggaaagggcgggauugugaccugcgcuauguucacaugcaaaaagaauauggaaggaaaaaucgugcagccugagaaccuggaauacaccgucguuauuacaccccacagcggcgaggaacaugccguggggaaugauaccggaaagcacggcaaagaggugaagaucacgccucagucuuccaucaccgaggcggaacucacaggcuaugggaccgucacaauggaguguagccccagaaccggacuggacuuuaacgaaauggugcuucugcaaauggaggauaaggccuggcucguucaccggcagugguuccuggaccuuccgcugccuuggcuccccggcgcugacacgcaggggucuaauuggauucagaaagaaacacuggugaccuuuaagaacccucaugccaaaaagcaagaugucgugguucugggaucccaggagggcgcuaugcacacagcccucaccggggccaccgagauccagaugagcuccggcaaucugcuuuucacaggacaucugaaaugccgccucagaauggacaagcugcaacuuaagggcaugucuuacagcauguguacggggaaauucaagauugugaaagaaaucgcugagacccagcacggaacaauugucauccgggugcaguaugaaggcgaugggucccccugcaagauccccuuugagauuauggaccuggagaaaagacauguccucggacgccugaucaccgugaacccuauuguuacagaaaaggauagcccggugaacaucgaggcggaacccccuuucggcgacucuuacauuaucauuggggucgagcccggccagcugaagcucgauugguuuaaaaagggauccagcaucggccaaauguucgaaaccacgaugagaggggccaaaagaauggcuauccugggagacacagccugggauuuuggcucucuugggggaguguucaccagcauuggcaaggcccugcaccagguuuuuggggcuaucuacggcgccgcguucuccggagugucuuggaccaugaaaauucucaucggcgucauuaucacauggaucgggaugaauagccgcuccaccagccugucugugucccuggugcuuguuggaauugucacacucuaucugggcgugauggugcaggcugacagcgggugugucgugucuuggaagaacaaggagcugaaaugcggauccggcaucuuuguuacggauaaugugcacaccuggacagagcaguacaaguuccaaccugaaagccccuccaaacucgccucugccauucagaaggcucaugaggaagggaucuguggcauucggagcgucaccagacuggagaaccuuauguggaaacagaucacauccgaacugaaucacauccucucugagaacgaggugaagcugaccauuaugacgggagacaucaaaggcauuaugcagguugggaagcgcagccugcggccgcaaccuaccgaacuuagauauuccuggaagacauggggaaaagccaagaugcucagcaccgagcugcauaaucagacauuucugaucgacggccccgaaaccgcugagugcccuaacacaaaucgcgccuggaacucucucgaaguggaggauuacggguucggagucuuuaccacgaauauuuggcugcggcuuagagagaaacaggacguguucugugauuccaagcugaugagcgcggccaucaaagacaaccgcgcuguucacgccgauaugggcuauuggaucgaaucugcucucaaugacacauggaagauugagaaggccuccuucaucgaagugaaaagcugccacuggcccaagucucauacccuguggagcaacggcguccuggaguccgagaugauuaucccuaaaaauuuugcggggcccgugagccagcacaacaaccggccgggauaccauacccaaacagccggcccuuggcaccuugggaagcucgaaauggauuucgacuuuugugagggaaccacgguggucguuacagaagagugcggcaauagagggcccucucugcggaccacaaccgcuuccggaaaacugauuacagaauggugcugucgcagcugcacccugcccccucugagauaucggggcgaggauggcuguugguacgggauggagaucagaccgcuuaaggaaaaggaggaaaaccugguguccucucucgugacggccggacauggccagauugacaauuucagccuggggauccugggaauggcucuuuuucucgaggaaaugcugcgcacccgggucggcacaaaacacgccauccugcucguggccguuuccuucgugacccugauuacagggaacaugucuuuuagagaucuuggacgcgucauggugaugguuggcgcuaccaugacggacgauaucggcaugggggugacauaccuggcgcuccuggccgcuuucaaggucagacccaccuuugccgccggacugcuucugcggaaacucacaagcaaggagcugaugaugaccaccauuggcaucgugcuccugucccagucuagcauuccugagacaauccuugaacugacggacgcucucgcccuggggaugaugguucugaaaauggugcgcaauauggagaaguaucaacuugcggucaccaucauggcuauucugugcgugcccaacgccgugauccuccagaaugccuggaaggucuccuguacaauucuggcuguugugagcgugucuccucuccugcuuaccuccagccagcagaaagccgacuggaucccccuggcgcucacaauuaagggacugaacccuaccgcuaucuuccugacgacacuuucuagaaccuccaaaaagcggagcuggccccugaaugaagccaucauggccgucggcauggugucuauucucgcuuccagccugcucaaaaacgauaucccgaugaccgggccucugguugccggaggccuucugacagugugcuacguccugaccggccgcuccgcugaccucgagcuggaaagagccacagaugugaagugggacgaucaagcggagauuagcgggucuagccccauccuuuccauuacgaucucugaggacggaagcauguccauuaaaaaugaagaggaggaacagacccugacaauccucauccggaccggccugcucguuauuucugggcuguuuccugugagcauccccauuacagccgcugccugguaucuuugggaggucaagaagcagcgcgcuggagugcugugggaugucccguccccucccccugugggcaaagccgaacuggaggacggggccuacagaaucaagcagaaaggcauucucggcuauucucaaaucggcgcugggguuuacaaggaaggaaccuuccacacgauguggcaugugacccggggcgcgguccugaugcacaaagggaagcgcaucgagcccagcugggccgaugugaagaaagaccuuauuuccuauggaggcggguggaagcuggaaggagaguggaaagagggcgaagagguucaggugcucgcucuggaacccggcaagaacccuagagccguccagacaaaaccggggcucuuucggaccaauacaggaaccaucggcgccgugagccuggauuucucucccgggacauccggaagcccuauuguggacaagaagggcaaaguugucgggcuuuacggaaacggcguggugacgagaucuggcgcuuacgucuccgccaucgcgcagaccgaaaagagcauugaagauaaucccgagaucgaggacgacaucuuccgcaaacggagacugacaauuauggaucugcauccuggggcuggaaagaccaaaaaguaucuccccgccaucgugcgcgaagccauuaagcggggccugagaacccuuauccuggcuccuacacgcguuguggccgcggagauggaagaggcucuccgggggcugccgauuagauaccaaacgcccgccauccgcgccgaacacaccggacgggagauugucgaccucaugugucaugcuacauuuaccaugagacugcuuuccccuauccgggugcccaacuauaaccugaucauuauggaugaggcccacuucacagacccugcuucuaucgccgcgcgcggcuacauuagcaccagaguugaaaugggggaggccgcuggcaucuuuaugacggccacacccccgggaucccgggauccuuucccccagagcaaugcucccauuauggacgaggaacgcgagaucccugaaagaucuuggaacuccggccacgagugggugaccgauuuuaaagggaagaccgucugguucgugcccagcaucaaaacaggaaaugacauugccgccugccugcggaagaacggcaaaagaguuauccagcucucucgcaagaccuuugauagcgaauaugugaagacacggaccaaugacugggauuucgucgugacgacagacauuuccgagaugggggcuaacuuuaaagcggaaagagugaucgacccucgccgguguaugaagccggucauucugaccgauggagaggagagaguuauccuugccggccccaugccugugacacauucuagcgcugcccaacgccgggggagaaucggccgcaaucccagaaacgaaaaugaccaguacauuuauaugggagagccucuggaaaacgaugaggacugcgcccacuggaaagaagcuaagaugcuccuggauaauaucaacacccccgagggcauuaucccguccauguucgagccugaacgggagaaaguggacgccauugauggggaauaccgccugagaggagaggcgcggaagacguuugucgaccucaugcgcagaggcgaucuucccguguggcuggcuuacaaaguugccucugaagggaucaauuaugccgaccggagaugguguuucgauggaacccgcaacaaucagauucuggaggagaacguggaagucgagaucuggacaaaggaaggcgagcggaagaaacucaagccuagauggcuggacgcucgcaucuacagcgauccccuugcccugaaagaguucaaggaauuugcggccgggcggaaaucccucacccugaaccugauuacagagaugggcagacucccuaccuucaugacacagaaggcucgggacgcccuugacaaucuggcugugcugcauaccgccgaagcuggaggcaaggccuauaaccacgcgcucagcgagcugcccgaaacgcuugagacacugcuccugcugacccuccuugccaccguuacagggggaaucuuucuguuccugaugucuggccgcgggauuggaaaaaugacccucggcaugugcugcaucauuacagcuuccauccugcuuugguacgcccaaauccagccgcacuggauugcugccagcaucauucuggaguuuuuccucaucgugcugcugauuccugaacccgagaagcagagaacgccccaggauaaucaacucaccuaugucaucaucgccauucuuacaguggucgcugcgaccauggccaacgaaaugggcuuucuggagaaaacaaagaaagaccuggggcucggacauaucgcuacccagcagccugaauccaauauucuggauaucgaccuucggccggccucugccuggacgcuguacgcuguggccaccacauucauuacccccaugcuccgccacagcaucgagaacuccucuguuaaugugagccugacagcgauugccaaccaggcuaccgugcugaugggccucgggaagggauggccucuuuccaagauggauaucggcgucccccugcuggccaucggguguuauagccaaguuaauccuauuacgcucacagcugcccugcuucugcucguggcgcauuacgccaucauuggacccggccugcaggcuaaagccaccagagaggcucagaagcgggccgcugccggcaucaugaaaaacccuacaguggacgggauuaccgucaucgaucuggacccgauccccuacgauccuaaguuugaaaaacagcucggacaagugaugcuucugguucugugcgugacccagguccucaugaugcgcacaacgugggcgcugugugaggcccuuacccuggcuacaggccccgugucuacccucugggaagggaauccuggaagauucuggaacacaaccauugccgucuccauggcuaauaucuuucggggcagcuaucuggccggggccggacuccucuucucuauuaugaagaacacgacauccacccgcagaggcaccggcaauaucggggagacacuuggagaaaaguggaaaagccggcugaacgcgcugggcaagucugaguuucagauuuacaaaaagagcgggauccaagagguggacagaacccucgcuaaagaaggaaucaagcgcggcgagacagaucaccaugccguuucccgggggucugcuaaacugagaugguucguggaacgcaaucuugucacgcccgagggaaaggugguugaccugggcugcggcagaggcggguggagcuauuacuguggagggcucaagaacgugagagaggucaaagggcugaccaagggcgggccgggacacgaggaaccuauucccauguccacauauggcuggaaccuggugcgccuccagagcggcguggauguuuucuuugugcccccugaacggugcgacacccuucugugugacaucggggaguccucucccaauccuacaguggaagccggaagaacccugcgcgugcucaaccuggucgagaauuggcuuaacaauaacacgcaguucugcguuaaagugcugaauccguacaugcccagcgugauugagcggauggaaacccuccagagaaaguauggcggggcccugguccgcaacccucuguccagaaauucuacacacgagauguacugggugagcaacgcuuccggaaauaucguuucuagcgugaacaugauuuccagaaugcucaucaaucgcuuuaccaugagacauaaaaaggccacauacgaacccgaugucgaccuuggcagcgggacccggaacaucggaauugagucugaaacaccuaaucuggauaucauuggcaagcgcaucgagaaaauuaagcaagagcacgaagcguccuggcauuaugaccaggaucaccccuacaaaaccugggccuaucacggcagcuacgagacgaagcagacagggucugcuuccagcauggugaacggaguugugagacugcucaccaaaccgugggacgucgugccuauggugacccagauggccaugacagauacgacccccuucggccaacagcgggucuuuaaggaaaagguugacacaagaacccaggagccuaaagaagggacaaagaaacugaugaagaucaccgcugaguggcuuuggaaagagcugggaaaggaaaagacaccccggauguguacccgcgaggaguucacgaaaaaggugagaucuaacgccgcgcucggcgccauuuuuaccgaugagaauaaauggaaguccgcucgggaggccguggaagacaaccgcuucugggagcuggucgauaaagaaagaaaucugcaucucgaggggaagugcgaaacauguguguauaacaugaugggaaaacgggagaagaagcugggcgaguuuggcaaagcuaaggggagccgcgccaucugguacauguggcuuggagcuagauuccuggaauuugaggcccucggcuuccugaaugaagaccacugguuuucccgggagaacagccuuucugggguugaaggagagggccugcauaaacucggguauauccugcgcgaggugagcaagaaagaaggcggagcgauguacgccgacgauaccgcuggcugggacacaagaauuaccaucgaggaucugaagaaugaagagaugauuacgaaccacauggccggggaacauaagaaacucgcugaggccaucuucaagcugacauaccagaauaaagucgugcggguucaacgcccuacccccagaggaacagugauggacauuaucucccggcgcgaucagagaggcucugggcaggucggaaccuauggccuuaacacguucaccaauauggaggcccaacugauccggcagauggaaggggagggcauuuuuaagagcauccagcaccucacagcguccgaagagauugcugugcaggacuggcugguuagagugggacgcgagcggcuuucuagaauggccaucagcggcgaugacugcgucgugaaaccgcuggaugaccgcuucgcccgggcucucaccgcccugaacgauauggggaaggucagaaaggacauucaacagugggaaccuucccgcggauggaaugauuggacacaggugcccuuuugcucucaccauuuccacgagcugaucaugaaagacggccggacccucguugugcccuguagaaaccaggacgaacugaucgggcgcgcucggauuagccaaggagccggcuggucccuuagagagacagcgugccugggaaagagcuacgcccagauguggucucucauguauuuucaucgccgggaucugagacuugcugccaaugcuaucuguuccgccgucccuagccacugggugccgaccucucggacgacaugguccauucacgcgagccaugaauggaugaccaccgaggacaugcugacaguguggaacagaguuuggauccucgagaaccccuggauggaagauaaaaccccuguggaguccugggaagagauucccuaccugggcaagcgcgaagaccaguggugcggaucucugaucggccucacaagccgggccacgugggcuaaaaauauucagaccgccaucaaccaagucagaucccugaucgggaaugaggaguauacagauuacaugccuagcaugaagcgcuucagacgggaagaggaagaggcuggagugcuuugguga

SEQ ID NO: 19668 - RNA, 9876 nt, Artificial Sequence
  derived and/or modified CDS sequence (opt5) from DENV-2__FJ906966__SS-prME
acagccggaaugaucauuaugcugauccccacggugauggcuuuccaccucacgacacggaacggggaaccucauaugauugucucccggcaggaaaagggaaaaucccugcuuuuuaagacagaggacggaguuaauaugugcacccugauggccauggaucucggggaacugugugaggacacaaucaccuacaaaugcccguuccuuaagcaaaacgaacccgaggauauugacuguuggugcaauucuacaagcaccugggugacguauggaaccuguacaaccacaggcgagcaccgcagagaaaaacgguccguggcgcuggucccucauguggggaugggacucgagacccgcacggaaacauggaugucuagcgagggcgcuuggaagcacgcccagagaaucgagaccuggauccugcggcaucccggcuuuacaauuauggccgcuauccuggccuacaccauugggaccacacacuuccagcgcgcucucaucuuuauucugcuuacggccguugcgccuuccaugaccaugagaugcaucggaauuucuaaccgggauuucguggaaggcgucagcgggggauccuggguggacaucguucuggagcacggcagcugugugacaaccauggccaagaauaaacccacacucgauuuugaacugaucaagaccgaggcuaaacagccugccacgcuucgcaaguauugcauugaagcuaaacugacaaacaccaccacagacucuagauguccgacccaaggggagcccucccucaaugaggaacaggauaagcgguucgucugcaagcauagcaugguggaccgcggauggggcaacggcugugggcuguuuggaaaaggcgggaucgugacaugcgccauguucacgugcaagaaaaauauggagggaaaggucguucagccugaaaaccuggaguacaccauugugaucacaccccacucuggcgaagaacaugcgguggggaaugauaccggaaaacacggcaaggagauuaaaaucacaccucaguccagcaucaccgaagccgagcucacgggcuaugggaccgucacaauggaauguucucccagaaccggacuggacuuuaacgagauggugcuucugcaaauggaaaauaaggcuuggcucguucaccggcagugguuccuggaucuuccgcugccuuggcuccccggcgccgacacacaggggcugaacuggauucagaaggagacccuggugacguuuaaaaauccucaugcuaagaaacaagacgucgugguucucggaucccaggagggcgccaugcacacagcccugaccggggcuacagaaauccagaugagcuccggcaaccuucuguucaccggacaucucaagugccgccugagaauggauaaacuucaacugaagggcaugucuuacagcauguguaccgggaaguucaaaguggucaaggagauugcggaaacacagcacggaacgaucgugauucggguccaguaugagggcgacgggucccccugcaaaauccccuuugagaucauggaucucgaaaagagacaugugcugggacgccugauuaccguuaacccuaucgugacagagaaagacagcccggucaauauugaagccgagcccccuuucggcgauucuuacaucauuaucgggguggaacccggccagcucaagcugaacugguuuaagaaaggauccagcauuggccaaaugaucgagaccacaaugagaggggcuaagagaauggccauccuuggagacaccgccugggauuucggcucucucggcgggguuuuuacgagcauugggaaagcucuccaccagguguucggggccaucuacggcgcggcuuuuuccggagucucuuggauuaugaagauccugauuggcgugaucaucacauggauugggaugaauagccgcuccaccagccugucugugucccuuguucucgucggaguggugacccuguaucugggcgucauggugcaggccgacagcggguguguugugucuuggaaaaacaaggagcucaagugcggauccggcaucuucauuacagauaauguccacaccuggacagaacaguacaaauuucaaccugagagccccuccaagcuggccucugcuauccagaaagcccaugaagaggggauuuguggcauccggagcgugacgagacuugaaaaccugauguggaagcagaucaccccggagcucaaucacauucuguccgagaacgaaguuaaacugacaaucaugaccggagacauuaagggcaucaugcaggcugggaaacgcucucuucaaccucagcccacagagcucaaguauagcuggaagaccuggggaaaagccaagaugcuguccacggaaagccauaaucagaccuuccugauugauggcccugagacagcggaaugccccaacaccaaucgggccuggaacucucucgagguggaggacuacggguuuggagucuucacaaccaauaucuggcugaaacuuagagaaaagcaggacguguuuugugauuccaaacugaugagcgcugccaucaaggacaaccgcgcuguucacgccgauaugggcuauuggauugagucugcgcucaaugacacauggaagaucgaaaaagccuccuucauugaggugaaguccugccacuggccuaaaucucauacccuguggagcaacggcguccuggaguccgaaaugaucauucccaagaacuucgcugggccggugagccaacacaauuaccggccuggauaucauacgcagacagccggccccuggcaccuugggaaacucgagauggauuuugacuucugugaaggaaccaccguggucguuacagaggauugcggcaacagagggcccucucugcgcaccacgacagcuuccggaaagcugaucaccgaauggugcugucggagcugcacacucccuccgcugagauaccggggcgaggacggcuguugguacgggauggagauucgcccccuuaaggaaaaagaggaaaaucuggugaacucccucgugaccgccggacauggccagaucgauaauuuuucucuggggguccugggaauggcccuuuuccucgaggaaaugcugagaacacgggugggcaccaagcacgcuauccugcucguugcggugagcuuugucacgcugauuaccgggaacauguccuucagagaccuuggacgcgugaugguuauggugggcgccacaaugaccgaugacaucggcaugggggucacauaucuggcucuccuggccgccuuuaaagugcggccuaccuucgcugccggacugcuucugagaaagcucacgucuaaagagcugaugaugacaaccauuggcaucguucuccugagccaauccacaauucccgagaccauccuugaacugaccgaugcgcucgcucuggggaugauggugcugaagaugguccgcaagauggagaaauaccagcuugccgugacaaucauggccauucugugcgugccuaaugcugucauccuccagaacgccuggaagguuucuuguacgauucuggcgguggugagcgucagcccccuguuucugaccagcucucagcaaaaagcugacuggaucccucuugcccugacaauuaagggacucaaucccaccgccaucuuccugacaacccuguccagaacgaacaaaaagcggagcuggccgcuuaaugaagcuaucauggccgugggcaugguuucuauucuggcuuccagccuccugaaaaacgacaucccuaugacagggccccucguggccggaggccugcuuaccgucugcuaugugcugaccggccgcucugcggaucuggagcucgaaagagccgcugacguuaagugggaggaucaggccgagauuuccgggagcuccccuauccugagcauuacaaucucugaagacggaagcauguccauuaagaaugaggaagaggagcagacccuuacaauccugauccggacgggccuccuggugauuucugggcucuuucccgucagcaucccgauuaccgcugccgccugguaccugugggaagugaaaaagcagcgcgcuggaguccuuugggaugugccuucucccccucccguuggcaaagcggagcuggaagacggggccuauagaaucaagcaaaaaggcauucugggcuacagccagaucggcgcugggguguauaaggagggaacauuccacaccauguggcaugucacacggggcgccgugcucaugcacaaggggaaacgcaucgaacccagcugggccgauguuaagaaagaccugauuuccuacggaggcggguggaaacuugagggagaguggaaagaaggcgaggaagugcagguccuggcucucgagccuggcaagaacccgagagccgugcagaccaagcccgggcuguuuaaaacgaaugcgggaaccaucggcgcugugucucucgauuucagcccugggacauccggaagccccauuaucgacaagaaaggcaagguugucgggcuguacggaaacggcguggugacccggucuggcgccuaugucuccgccauugcucaaacagaaaagagcaucgaggauaacccugagaucgaggacgauauuuuccgcaagagaaaacuuaccaucauggaccugcaucccggggccggaaaaacaaagcgguaccugccugcgauugugagagaggcuaucaaacgcggccuccggacgcugauucuugccccgaccagaguuguggccgcugaaauggaggaagcccugcgcgggcuccccauccgguaucagaccccugcuauuagagccgagcacaccggacgcgagaucgucgaccugaugugucaugcgaccuuuacaaugcggcuccugucucccgugagaguuccuaauuacaaccuuaucauuauggaugaagcccacuucacggaccccgcuuccaucgccgcucgcggcuauauuagcacccggguggagaugggggaagccgccggcaucuuuaugacagcuaccccgccuggauccagagaucccuucccccagucuaaugcgccuauuauggacgaggagcgggaaauccccgagcgcagcugguccagcggccacgaaugggucacagauuuuaaggggaaaaccgugugguucguuccuucuaucaaggccggaaacgacauugcugccugccugagaaagaauggcaaaaaggugauccaacugucccggaaaacguuugauagcgaguacgucaagacacgcaccaacgacugggauuucguggugaccacagacauuucugaaaugggggccaauuuuaaagcugagagagucaucgauccgcggagauguaugaagcccguuauucucaccgacggagaggaacgcgugauccuggccggcccuaugcccgugacacauagcuccgcggcucagcggagagggcgcaucggccggaacccuaaaaaugagaacgaccaguauauuuacaugggagaaccccuugagaaugaugaagacugcgcccacuggaaggaggccaagaugcugcucgauaacaucaauaccccggagggcauuaucccuucuauguucgaacccgagagagaaaaagucgacgcuauugauggggaguaccgccugcggggagaagccagaaagacguuuguggaccugaugcgcagaggcgaucucccuguuuggcuugcguaucggguggccgcugaggggaucaacuacgccgaccgcagaugguguuucgauggaauuaaaaauaaccagauccuggaggaaaacgucgagguggaaaucuggacaaaggagggcgagcggaaaaagcugaagccccgcuggcucgacgcuagaauuuauagcgauccucuggcccuuaaagaguucaaggaguuugcugccgggcggaaaucccugacccucaaucugaucacagaaaugggcagacugcccaccuucaugacgcaaaaggcgcgcgacgcccucgauaaccuugcuguucugcauaccgccgaggcuggaggccgggccuacaaucacgcccugucugaacucccggagacacuggagacccuucugcuccugacacugcucgcuaccgugacagggggaauuuuucuuuuccugaugagcggcagagggaucggaaaaaugacccugggcaugugcugcauuaucacggcguccauccuccugugguaugcccagauucagccucacuggaucgcugccagcauuauccuugaauuuuuccugauuguccuccugauccccgagcccgaaaagcagcgcacaccucaagacaaccagcugaccuacguggucaucgccauucucaccgugguugcugccacaauggcgaaugagaugggcuuucuugaaaagaccaaaaaggaccuggggcugggaucuaucacaacgcagcagccggaguccaacauucucgauaucgaccugcggcccgccagcgcuuggacccuuuaugccguggcuacaaccuucgugacaccuaugcugagacauuccauugaaaauucuagcgucaacguuucccucaccgccaucgcgaaucaagccacggugcugaugggccuggggaaaggauggccccucucuaagauggauauuggcgugccucuucuggcuaucggguguuacagccaggucaaccccaucacccugacagccgcucucuuucugcuuguggcccacuacgcuauuaucggaccuggccugcaggccaaagcgacccgggaagcccagaagcgcgcugccgcuggcauuaugaagaauccgacaguugacgggaucaccgugauugaucucgaccccaucccuuaugaucccaaauucgagaagcaacugggacaggucaugcugcucgugcuuugcgucacacaggugcugaugaugagaacaaccugggcccugugugaagcccucacacuggcgaccggcccuaucuccacccuuugggaggggaaccccggacgguuuuggaauacaacgauugcuguuagcauggccaacaucuuccgcggcucuuaccuggcuggggccggacuccuguuuuccauuaugaaaaauaccacaaacaccagacggggcacaggcaauaucggggaaacccugggagagaaguggaaaagccgccucaacgcccuuggcaagucugaguuccaaauuuauaaaaaguccgggauccaggaaguggacagaacgcuggcuaaggagggaaucaaacggggcgaaacagaucaucacgccgucagccgcgggucugcgaagcugagaugguucguggagcggaacaugguuaccccggagggaaaaguggucgaccucggcugcggcagagggggauggagcuacuauuguggcgggcugaagaaugugcgcgaagugaaaggacuuaccaagggcgggccuggacaugaggaacccauucccauguccacauacggcuggaaccugguucggcuccagucuggcgucgauguguuuuucaccccucccgagaagugcgacacacugcugugugauaucggggaaagcuccccuaauccgacgguggaggccggaagaacccuccgcguccuuaaccugguugagaauuggcugaacaauaacacacaguuuugcauuaaagugcucaaucccuauaugccuagcgugaucgaaaagauggaggcucugcaacggaaauacggcggggcccuugucagaaacccccugucccgcaauucuacccacgaaauguacugggugagcaacgcuuccggaaauauuguuucuagcgugaacaugaucucccggaugcucaucaauagauucacaaugcgccacaagaaagccaccuaugagccugacgucgaccugggcucugggacgcggaacauuggaaucgaaagcgagauucccaaccuggauaucauuggcaagagaaucgagaagauuaaacaggaacaugagaccuccuggcacuacgaccaggaucauccguauaagacaugggcguaccacggcagcuaugaaaccaaacagacagggucugccuccagcauggugaauggaguugugcgccuccuuaccaagccuugggacgucgugcccauggugacacaaauggcuaugaccgauacgacaccuuuuggccagcagcgggucuucaaagagaagguugacaccagaacccaggaacccaaggaggggaccaagaagcugaugaaaaucacggccgaguggcuguggaaggaacucggcaaaaagaaaaccccucgcauguguacaagacaagaguuuacccggaaggugcgcucuaacgcugcccugggcgcuaucuucacagaugaaaauaaguggaaauccgccagagaggcgguggaggacagccgguuuugggaacuugucgauaaggagagaaaccugcaccucgaagggaaaugcgagaccuguguguacaauaugaugggaaagcgggagaaaaagcugggcgaguucggcaaggccaaagggucucgcgcuauuugguauauguggcugggagccagauuucucgaguucgaagcucugggcuuucuuaacgaggaccauugguucucccgggaaaauagccuguccgggguugagggagaaggccuccacaagcugggguacauccuucgcgaugugagcaaaaaggagggcggagccauguacgccgacgacacagcgggcugggauaccagaauuacgcuggaggaccucaaaaacgaagagauggucaccaaucauauggaaggggagcacaagaagcuggcugaagccaucuucaaacugacauaucagaacaaggugguucgggugcagcgccccaccccgagaggaacagucauggauauuaucucucggcgcgaccaaagaggcagcggacaggugggaaccuacggccucaauacguuuacaaacauggaggcccagcugauccggcagauggagggggaaggcguuuucaaauccauucaacaucuuaccgugacagaggaaaucgcuguccagaauuggcuggcccgcgugggaagagagcggcucucucgcauggcuauuagcggcgaugacugcgucgugaagccucuggaugacagauuugccuccgcgcuuaccgcccugaacgauauggggaaaguucggaaggacauccagcagugggagcccucuagaggauggaaugauuggacgcaagugcccuucugcagccaccacuuucaugaacucauuaugaaggacggccgcguccugguggugccuugucggaaccaggaugagcugaucgggagagcucgcaucucccagggagccggcuggucucuccgggaaaccgcuugccuggggaaaagcuaugcccagauguggucccuuauguacuuccacagacgcgaccugcggcucgcggccaacgcuauuuguagcgccguuccgucucauugggugcccacauccagaaccacauggagcauccacgcuaagcacgaguggaugaccacagaagacaugcugaccgucuggaaucgcguguggauucaagagaacccuuggauggaggauaaaacgcccguugaaucuugggaggaaaucccuuaucuuggcaagcgggaggaccaguggugcggaucccugauuggccucacaagcagagccaccugggcuaaaaauauccagaccgccauuaaccaggugcgcucccugaucgggaaugaagaguacacagauuauaugcccucuaugaagcgguuuagacgggaggaagaggaagcgggaguccugugguga

SEQ ID NO: 19669 - RNA, 9876 nt, Artificial Sequence
  derived and/or modified CDS sequence (opt5) from DENV-2__FJ906968__SS-prME
accgccggcaugaucauuaugcugauccccacagugauggcuuuccaccucacgaccagaaacggggagccucauaugauugucagccggcaggaaaagggaaaaucccugcuuuuuaagacagaggacggcguuaauaugugcacccugauggccauggaucucggggaacugugugaggacacaaucaccuacaaaugcccguuccuuaagcaaaacgaacccgaggauauugacuguuggugcaauucuacaagcaccugggugacguauggaaccuguacaaccacaggcgagcaccgcagagaaaaacgguccguggcgcuggucccucauguggggaugggacucgagacccgcacggaaacauggaugucuagcgagggcgcuuggaagcacgcccagagaaucgagaccuggauccugcggcaucccggcuuuacaauuauggccgcuauccuggccuacaccauugggaccacacacuuccagcgcgcucucaucuuuauucugcuuacggccguugcgccuuccaugaccaugagaugcaucggaauuucuaaccgggauuucguggaaggcgucagcgggggauccuggguggacaucguucuggagcacggcagcugugugacaaccauggccaagaauaaacccacacucgauuuugaacugaucaagaccgaggcuaaacagccugccacgcuucgcaaguauugcauugaagcuaaacugacaaacaccaccacagacucuagauguccgacccaaggggagcccucccucaaugaggaacaggauaagcgguucgucugcaagcauagcaugguggaccgcggauggggcaacggcugugggcuguuuggaaaaggcgggaucgugacaugcgccauguucacgugcaagaaaaauaugaagggaaaagucguucagccugagaaccuggaauacaccauugugaucacaccccacucuggcgaggaacaugcgguggggaaugauaccggaaagcacggcaaagagauuaagaucacaccucaguccagcaucaccgaggccgaacucacgggcuaugggaccgucacaauggaguguucucccagaaccggacuggacuuuaacgaaauggugcuucugcaaauggagaauaaggcuuggcucguucaccggcagugguuccuggaucuuccgcugccuuggcuccccggcgccgacacacagggguccaacuggauucagaaagaaacccuggugacguuuaagaauccucaugcuaaaaagcaagacgucgugguucugggaagccaggagggcgccaugcacacagcccucaccggggcuacagagauccagauguccucuggcaaccugcuuuucaccggacaucugaaaugccgccucagaauggauaagcugcaacuuaagggcaugagcuacuccauguguaccgggaaauucaagguggucaaagaaauugcggagacacagcacggaacgaucgugauucggguccaguaugaaggcgacgggagccccugcaagauccccuuugagaucauggaucuggagaaaagacaugugcucggacgccugauuaccguuaacccuaucgugacagaaaaggacucuccggucaauauugaggccgaacccccuuucggcgauuccuacaucauuaucgggguggagcccggccagcugaagcucaacugguuuaaaaagggaagcucuauuggccaaaugaucgaaaccacaaugcggggggcuaaaagaauggccauccugggagacaccgccugggauuucggcagccuugggggaguuuuuacguccauuggcaaggcucugcaccagguguucggggccaucuacggcgcggcuuuuucuggagucagcuggauuaugaaaauccucauuggcgugaucaucacauggauugggaugaauucccgcagcaccucucuguccgugagccugguucuugucggaguggugacccucuaucugggcgucauggugcaggccgacucuggguguguuguguccuggaagaacaaggagcugaaaugcggaagcggcaucuucauuacagauaauguccacaccuggacagagcaguacaaguuucaaccugaaucccccucuaaacucgccagcgcuauccagaaggcccaugaggaagggauuuguggcauccgguccgugacgagacuggagaaccuuauguggaaacagaucaccccggaacugaaucacauucucucugagaacgagguuaagcugacaaucaugaccggagacauuaaaggcaucaugcaggcugggaagcgcagccugcaaccucagcccacagaacuuaaguauuccuggaaaaccuggggaaaggccaaaaugcucagcacggagucucauaaucagaccuuccugauugauggcccugaaacagcggagugccccaacaccaaucgggccuggaacucccuggaaguggaggacuacggguuuggagucuucacaaccaauaucuggcucaagcugagagagaaacaggacguguuuugugauagcaagcuuaugucugcugccaucaaggacaaccgcgcuguucacgccgauaugggcuauuggauugaauccgcgcugaaugacacauggaaaaucgagaaggccagcuucauugaagugaaaucuugccacuggccuaagagccauacccucugguccaacgagguccuggagagcgaaaugaucauucccaaaaacuucgcuggcccggugucucaacacaauuaccggccuggguaucauacgcagacagccggacccuggcaccugggcaagcuugagauggauuuugacuucugugaagggaccaccguggucguuacagaggauugcggaaacagaggccccucccuccgcaccacgacagcuagcgggaagcugaucaccgaauggugcugucgguccugcacacugccuccgcucagauaccggggagaggacggcuguugguacggcauggagauucgcccccugaaagaaaaggaggaaaaucuugugaacucucuggugaccgccgggcauggacagaucgauaauuuuagccucggcguccuggggauggcccuguuccuugaggaaaugcucagaacacgggugggaaccaaacacgcuauccugcugguugcgguguccuuugucacgcucauuaccggcaacaugucuuucagagaccuggggcgcgugaugguuauggugggagccacaaugaccgaugacaucggcaugggcgucacauaucuugcucugcucgccgccuuuaaggugcggccuaccuucgcugccgggcugcugcuuagaaaacugacgagcaaggagcucaugaugacaaccauuggaaucguucugcucucccaaucuacaauucccgagaccauccuggaacuuaccgaugcgcuggcucucggcaugauggugcugaagaugguccgcaaaauggagaaguaccagcuggccgugacaaucauggccauucuuugcgugccuaaugcugucauccugcagaacgccuggaaaguuagcuguacgauucucgcggugguguccgucagcccccuguuucucaccucuucccagcaaaaggcugacuggaucccucuggcccuuacaauuaaagggcugaaucccaccgccaucuuccucacaacccugagcagaacgaacaagaaacggucuuggccgcugaaugaagcuaucauggccgugggaaugguuuccauucuugcuagcucucugcucaagaacgacaucccuaugacaggcccccugguggccgggggacuccugaccgucugcuaugugcuuaccggccgcuccgcggaucuggagcuggaaagagccgcugacguuaagugggaggaucaggccgagauuagcggcuccagcccuauccucucuauuacaaucagcgaagacggguccaugucuauuaaaaaugaggaagaggagcagauccugaccauccuuauucggacaggacugcucgugaucagcggccuguuucccgucuccauuccgaucacggcugccgccuggugucucugggaagugaagaaacagcgcgcugggguccugugggaugugccuucucccccucccguuggaaaggcggagcuugaagacggcgccuacagaauuaaacaaaaggggauccugggauauagccagaucggcgcuggcguguacaaggaggggaccuuccacacaauguggcaugucacccggggagccgugcugaugcacaaaggcaagcgcauugaacccuccugggccgauguuaaaaaggaccucaucucuuaugggggaggcuggaaacuggagggggaguggaaggaaggagaggaagugcagguccuugcucuggagccuggcaagaacccgagagccgugcagacaaaacccggccucuuuaagaccaaugcggggacgauuggagcugugagccuggauuucuccccuggcaccagcgggucucccaucauugacaaaaagggaaaaguugucggccucuacgggaacggaguggugacacgguccggcgccuacgucagcgccaucgcucaaaccgaaaagucuaucgaggauaacccugagauugaagacgauaucuuccgcaagagaaaacugacaauuauggaccuucaucccggcgccgggaagaccaaacgguaucugccugcgaucgugagagaggcuauuaagcgcggacugcggacacucauccuggccccgacgagaguuguggccgcugaaauggaggaagcccuucgcggccugcccauucgguaccagaccccugcuaucagagccgagcacacagggcgcgagaucgucgaccucaugugccaugcgaccuuuaccaugcggcugcucucccccgugagaguuccuaauuauaaccugauuaucauggaugaagcccacuucacagaccccgcuagcauugccgcucgcggauacaucuccacgcggguggagaugggcgaagccgccgggauuuuuaugaccgcuacaccgccuggcucuagagaucccuucccccagagcaaugcgccuaucauggacgaggagcgggaaauccccgagcgcuccuggagcucuggacacgaaugggucaccgauuuuaaaggcaagacagugugguucguuccuuccauuaaggccgggaacgacaucgcugccugucuuagaaaaaauggaaagaaagugauucaacugagccggaagaccuuugauucugaguaugucaaaacgcgcacaaacgacugggauuucguggugaccaccgacaucagcgaaaugggcgccaauuuuaaggcugagagagucauugauccgcggagaugcaugaaacccguuauccugacagacggggaggaacgcgugauccucgccggaccuaugcccgugacccauuccucugcggcucagcggagaggccgcauugggcggaacccuaagaaugagaacgaccaguacaucuauaugggcgaaccccuggagaaugaugaagacugugcccacuggaaggaggccaaaaugcuucuggauaacauuaauacaccggagggaaucauuccuagcauguucgaacccgagagagaaaaggucgacgcuaucgauggcgaguaccgccuccggggggaagccagaaaaaccuuuguggaccugaugcgcagaggagaucugccuguuuggcucgcguaccggguggccgcugagggcauuaacuaugccgaccgcagauggugcuucgaugggaucaagaauaaccagauccuugaggaaaacgucgagguggaaauuuggacgaaagagggagagcggaagaagcugaaaccccgcuggcuggacgcuagaaucuacuccgauccucucgcccugaaggaauucaaagaguuugcugccggccggaagucucuuacacugaaucucauuaccgaaauggggagacugcccacauucaugacccaaaaagcgcgcgacgcccuggauaaccucgcuguucuucauacggccgaggcuggcggacgggccuauaaucacgcccugagcgaacugccggagacccucgagacacugcuucugcucacccugcuggcuacagugaccggcgggaucuuucucuuccuuauguccggaagaggcauugggaagaugacacugggaaugugcuguaucaucaccgcgagcauucugcucugguacgcccagauccagccucacuggauugcugccucuaucauucuggaauuuuuccuuaucguccugcucauccccgagcccgaaaagcagcgcacgccucaagacaaccagcugacauauguggucauugccauccugaccgugguugcugccaccauggcgaaugagaugggcuuucucgaaaaaacaaagaaagaccuuggccugggguccauuaccacacagcagccggagagcaacauccuggauauugaccuccggcccgccuccgcuuggacgcuguacgccguggcuaccacauucgugaccccuaugcuuagacauucuaucgagaauagcuccgucaacguuucucugacagccauugcgaaucaagccaccgugcucaugggacugggcaagggguggccccugagcaaaauggauaucggagugccucuccuugcuaucggcugcuauucccaggucaaccccauuacgcugaccgccgcucuguuucuccugguggcccacuacgcuaucauugggccuggacuucaggccaaggcgacacgggaagcccagaagcgcgcugccgcuggcaucaugaaaaauccgaccguugacggcauuacagugaucgaucuggaccccaucccuuacgaucccaaguucgagaaacaacucgggcaggucaugcugcuggugcucugugucacccaggugcuuaugaugagaacgacaugggcccugugcgaagcccugacccucgcgacaggaccuauuagcacccugugggagggcaaccccgggcgguuuuggaauaccacaaucgcuguuucuauggccaacauuuuccgcggauccuaucuugcuggcgccgggcugcucuuuagcaucaugaagaauacgaccaacacaagacggggaaccggcaauauuggcgaaacacugggggagaaauggaagucucgccugaacgcccucggaaaauccgaguuccaaaucuacaagaagagcggcauccaggaaguggacagaacccuugcuaaagaggggauuaagcggggagaaacggaucaucacgccgucucucgcggcagcgcgaaacugagaugguucguggagcggaacaugguuacaccggaggggaagguggucgaccugggauguggcagaggcgggugguccuauuacugcggaggccucaaaaaugugcgcgaagugaaggggcugaccaagggaggcccugggcaugaggaacccauccccaugucuaccuauggauggaaccuuguucggcugcagagcggcgucgauguguuuuucacaccucccgagaaaugugacacccuccugugcgauauuggcgaauccagcccuaauccgacaguggaggccgggagaacgcugcgcguccucaaccuuguugagaauuggcugaacaauaacacccaguuuuguaucaaggugcugaaucccuacaugccuuccgugauugaaaaaauggaggcucuccaacggaaguauggaggcgcccuggucagaaacccccuuucucgcaauagcacacacgaaauguacuggguguccaacgcuucugggaauaucguuagcuccgugaacaugaucucucggaugcugauuaauagauucaccaugcgccacaaaaaggccacauacgagccugacgucgaccucggaagcggcacccggaacaucgggauugaauccgagauccccaaccuggauauuaucggaaagagaauugagaaaaucaagcaggaacaugagacgagcuggcacuaugaccaggaucauccguacaaaaccugggcguaucacggcucuuacgaaacaaagcagaccggcuccgccagcucuauggugaaugggguugugcgccugcucacaaaaccuugggacgucgugcccauggugacccaaauggcuaugacagauaccacgccuuuuggacagcagcgggucuucaaggagaagguugacacaagaacccaggaacccaaagagggcaccaagaaacuuaugaagaucacagccgaguggcuguggaaagaacuggggaagaaaaagacgccucgcaugugcaccagagaggaauuuacacggaaggugcgcuccaacgcugcccucggagcuauuuucaccgaugagaauaaauggaagagcgccagagaggcgguggaagacucucgguuuugggagcuggucgauaaagaaagaaaccuucaccuggagggcaagugugaaacaugcguguauaauaugauggggaaacgggagaagaagcucggagaguucggcaaagccaagggcucccgcgcuaucugguacauguggcugggggccagauuucuggaauucgaggcucucggauuucugaacgaagaccauugguucagccgggagaauucccuuagcggcguugaaggggagggacugcacaaacucggcuauauucugcgcgaugugucuaagaaagaggggggcgccauguacgccgacgacaccgcgggaugggauacaagaaucacccuugaagaccugaagaacgaggaaauggucacgaaucauauggagggcgaacacaagaaacucgcugaggccauuuucaagcugaccuaccaaaacaaagugguucgggugcagcgccccacaccgagagggaccgucauggauaucaucagccggcgcgaccagagaggauccggccaaguggggacauauggacugaauaccuuuacgaacauggaggcccagcucauucggcagauggaaggcgaggggguuuucaagucuauccagcaucugacagugaccgaagagauugcuguccaaaauuggcuugcccgcgugggcagagagcggcugagccgcauggcuaucuccggagaugacugcgucgugaaaccucucgaugacagauuugccucugcgcugacagcccuuaacgauaugggcaagguucggaaggacauucagcagugggaacccagcagaggguggaaugauuggacccaggugcccuucuguucccaccacuuucaugagcugaucaugaaagacggacgcguccucguggugccuugccggaaccaagaugaacugaucggcagagcucgcauuucucagggggccggauggagccugcgggagacggcuugucucggcaaguccuacgcccagauguggagccugauguauuuccacagacgcgaccuucggcuggcggccaacgcuaucugcucugccguuccgucccauugggugcccaccagcagaacaaccuggucuauucacgcuaaacacgaauggaugacaaccgaggacaugcucacagucuggaaucgcguguggauccaggagaacccuuggauggaagauaagacccccguugaguccugggaagagauuccuuaccuggggaaacgggaagaccaaugguguggcagccuuaucggacugacguccagagccacaugggcuaagaauauucagaccgccaucaaccaggugcgcucucucaucggcaaugaggaguauaccgauuacaugcccagcaugaagcgguuuagacgggaagaggaagaggcggggguccugugguga

SEQ ID NO: 19670 - RNA, 9876 nt, Artificial Sequence
  derived and/or modified CDS sequence (opt5) from DENV-2__FJ906969__SS-prME
accgccggcaugaucauuaugcugauccccacagugauggcuuuccaccucacgaccagaaacggggagccucauaugauugucagccggcaggaaaagggaaaaucccugcuuuuuaagacagaggacggcguuaauaugugcacccugauggccauggaucucggggaacugugugaggacacaaucaccuacaaaugcccguuccuuaagcaaaacgaacccgaggauauugacuguuggugcaauucuacaagcaccugggugacguauggaaccuguacaaccacaggcgagcaccgcagagaaaaacgguccguggcgcuggucccucauguggggaugggacucgagacccgcacggaaacauggaugucuagcgagggcgcuuggaagcacgcccagagaaucgagaccuggauccugcggcaucccggcuuuacaauuauggccgcuauccuggccuacaccauugggaccacacacuuccagcgcgcucucaucuuuauucugcuuacggccguugcgccuuccaugaccaugagaugcaucggaauuucuaaccgggauuucguggaaggcgucagcgggggauccuggguggacaucguucuggagcacggcagcugugugacaaccauggccaagaauaaacccacacucgauuuugaacugaucaagaccgaggcuaaacagccugccacgcuucgcaaguauugcauugaagcuaaacugacaaacaccaccacagacucuagauguccgacccaaggggagcccucccucaaugaggaacaggauaagcgguucgucugcaagcauagcaugguggaccgcggauggggcaacggcugugggcuguuuggaaaaggcgggaucgugacaugcgccauguucacgugcaagaaaaauaugaagggaaaagucguucagccugagaaccuggaauacaccauugugaucacaccccacucuggcgaggaacaugcgguggggaaugauaccggaaagcacggcaaagagauuaagaucacaccucaguccagcaucaccgaggccgaacucacgggcuaugggaccgucacaauggaguguucucccagaaccggacuggacuuuaacgaaauggugcuucugcaaauggagaauaaggcuuggcucguucaccggcagugguuccuggaucuuccgcugccuuggcuccccggcgccgacacacagggguccaacuggauucagaaagaaacccuggugacguuuaagaauccucaugcuaaaaagcaagacgucgugguucugggaagccaggagggcgccaugcacacagcccucaccggggcuacagagauccagauguccucuggcaaccugcuuuucaccggacaucugaaaugccgccucagaauggauaagcugcaacuuaagggcaugagcuacuccauguguaccgggaaauucaagguggucaaagaaauugcggagacacagcacggaacgaucgugauucggguccaguaugaaggcgacgggagccccugcaagauccccuuugagaucauggaucuggagaaaagacaugugcucggacgccugauuaccguuaacccuaucgugacagaaaaggacucuccggucaauauugaggccgaacccccuuucggcgauuccuacaucauuaucgggguggagcccggccagcugaagcucaacugguuuaaaaagggaagcucuauuggccaaauguucgaaaccacaaugcggggggcuaaaagaauggccauccugggagacaccgccugggauuuuggcagccuugggggaguuuucacguccaucggcaaggcucugcaccagguguuuggggccauuuacggcgcggcuuucucuggagucagcuggaucaugaaaauucucaucggcgugauuaucacauggaucgggaugaauucccgcagcaccucucuguccgugagccugguucuugucggaguggugacccucuaucugggcgucauggugcaggccgacucuggguguguuguguccuggaagaacaaggagcugaaaugcggaagcggcauuuuuaucacagauaauguccacaccuggacagagcaguacaaguuccaaccugaaucccccucuaaacucgccagcgcuauucagaaggcccaugaggaagggaucuguggcauucgguccgugacgagacuggagaaccuuauguggaaacagaucaccccggaacugaaucacauccucucugagaacgagguuaagcugacaauuaugaccggagacaucaaaggcauuaugcaggcugggaagcgcagccugcaaccucagcccacagaacuuaaguauuccuggaaaaccuggggaaaggccaaaaugcucagcacggagucucauaaucagaccuuucugaucgauggcccugaaacagcggagugccccaacaccaaucgggccuggaacucccuggaaguggaggacuacggguucggagucuuuacaaccaauauuuggcucaagcugagagagaaacaggacguguucugugauagcaagcuuaugucugcugccaucaaggacaaccgcgcuguucacgccgauaugggcuauuggaucgaauccgcgcugaaugacacauggaaaauugagaaggccagcuucaucgaagugaaaucuugccacuggccuaagagccauacccucugguccaacggcguccuggagagcgagaugauuauccccaaaaacuuugcugggccggugucucaacacaauuaccggccuggauaucauacgcagacagccggccccuggcaccuggggaagcuugaaauggauuucgacuuuugugagggaaccaccguggucguuacagaagauugcggcaacagagggcccucccuccgcaccacgacagcuagcggaaagcugauuaccgaguggugcugucgguccugcacacugccuccgcucagauaccggggcgaagacggcuguugguacgggauggagauccgcccccugaaagagaaggaagagaaucuugugaacucucuggugaccgccggacauggccagauugauaauuucagccucgggguccugggaauggcccuguuucuugaagagaugcucagaacacgggugggcaccaaacacgcuauccugcugguugcgguguccuucgucacgcucaucaccgggaacaugucuuuuagagaccugggacgcgugaugguuauggugggcgccacaaugaccgaugacauuggcaugggggucacauaucuugcucugcucgccgccuucaaggugcggccuaccuuugcugccggacugcugcuuagaaaacugacgagcaaggaacucaugaugacaaccaucggcauuguucugcucucccaaucuacaauccccgagaccauucuggagcuuaccgaugcgcuggcucucgggaugauggugcugaagaugguccgcaaaauggaaaaguaccagcuggccgugacaaucauggccauccuuugcgugccuaaugcugucauucugcagaacgccuggaaaguuagcuguacgauccucgcggugguguccgucagcccccuguuccucaccucuucccagcaaaaggcugacuggauuccucuggcccuuacaaucaaaggacugaaucccaccgccauuuuucucacaacccugagcagaacgaacaagaaacggucuuggccgcugaaugaggcuaucauggccgugggcaugguuuccauccuugcuagcucucugcucaagaacgacauuccuaugacagggccccugguggccggaggccuccugaccgucugcuaugugcuuaccggccgcuccgcggaucuggaacuggagagagccgcugacguuaagugggaagaucaggccgagaucagcggguccagcccuauucucucuaucacaauuagcgaggacggauccaugucuaucaaaaaugaagaggaagagcagauucugaccauccuuauccggacaggccugcucgugauuagcgggcuguuccccgucuccaucccgauuacggcugccgccuggugucucugggaggugaagaaacagcgcgcuggaguccugugggaugugccuucucccccucccguuggcaaggcggaacuugaggacggggccuacagaaucaaacaaaagggaauucugggcuauagccagaucggcgcugggguguacaaggaaggaaccuuucacacaauguggcaugucacccggggcgccgugcugaugcacaaagggaagcgcaucgagcccuccugggccgauguuaaaaaggaccucauuucuuauggaggcggguggaaacuggaaggagaguggaaggagggcgaagaggugcagguccuugcucuggaaccuggcaagaacccgagagccgugcagacaaaacccgggcucuucaagaccaaugcgggaacgaucggcgcugugagccuggauuucuccccugggaccagcggaucucccauuaucgacaaaaagggcaaaguugucgggcucuacggaaacggcguggugacacgguccggcgccuacgucagcgccauugcucaaaccgagaagucuaucgaagauaacccugagaucgaggacgauauuuuucgcaagagaaaacugacaaucauggaccuucaucccggggccggaaagaccaaacgguaucugccugcgauugugagagaagcuaucaagcgcggccugcggacacucauucuggccccgacgagaguuguggccgcugagauggaagaggcccuucgcgggcugcccauccgguaccagaccccugcuauuagagccgaacacacaggacgcgagaucgucgaccucaugugccaugcgaccuucaccaugcggcugcucucccccgugagaguuccuaauuauaaccugaucauuauggaugaggcccacuuuacagaccccgcuagcaucgccgcucgcggcuacauuuccacgcggguggaaaugggggaggccgccggcaucuucaugaccgcuacaccgccuggaucuagagaucccuuuccccagagcaaugcgccuauuauggacgaagagcgggagauccccgaacgcuccuggagcucuggccacgagugggucaccgauuucaaagggaagacagugugguuuguuccuuccaucaaggccggaaacgacauugcugccugucuuagaaaaaauggcaagaaagugauccaacugagccggaagaccuucgauucugaauaugucaaaacgcgcacaaacgacugggauuuuguggugaccaccgacauuagcgagaugggggccaauuucaaggcugaaagagucaucgauccgcggagaugcaugaaacccguuauucugacagacggagaggagcgcgugauccucgccggcccuaugcccgugacccauuccucugcggcucagcggagagggcgcaucggccggaacccuaagaaugaaaacgaccaguacauuuauaugggagagccccuggaaaaugaugaggacugugcccacuggaaggaagccaaaaugcuucuggauaacaucaauacaccggagggcauuaucccuagcauguuugagcccgaaagagagaaggucgacgcuauugauggggaauaccgccuccggggagaggccagaaaaaccuucguggaccugaugcgcagaggcgaucugccuguuuggcucgcguaccggguggccgcugaagggaucaacuaugccgaccgcagauggugcuucgauggaauuaagaauaaccagauccuugaggagaacgucgaaguggagaucuggacgaaagaaggcgagcggaagaagcugaaaccccgcuggcuggacgcuagaauuuacuccgauccucucgcccugaaggaguuuaaagaauucgcugccgggcggaagucucuuacacugaaucucaucaccgagaugggcagacugcccacauuuaugacccaaaaagcgcgcgacgcccuggauaaccucgcuguucuucauacggccgaagcuggaggccgggccuauaaucacgcccugagcgagcugccggaaacccucgagacacugcuucugcucacccugcuggcuacagugaccgggggaauuuuccucuuucuuauguccggcagagggaucggaaagaugacacugggcaugugcuguauuaucaccgcgagcauccugcucugguacgcccagauucagccucacuggaucgcugccucuauuauccuggaguucuuucuuauuguccugcucauccccgaacccgagaagcagcgcacgccucaagacaaccagcugacauauguggucaucgccauucugaccgugguugcugccaccauggcgaaugaaaugggcuuccucgagaaaacaaagaaagaccuugggcugggauccaucaccacacagcagccggaaagcaacauucuggauaucgaccuccggcccgccuccgcuuggacgcuguacgccguggcuaccacauuugugaccccuaugcuuagacauucuauugagaauagcuccgucaacguuucucugacagccaucgcgaaucaagccaccgugcucaugggccuggggaagggauggccccugagcaaaauggauauuggcgugccucuccuugcuaucgggugcuauucccaggucaaccccaucacgcugaccgccgcucuguuccuccugguggcccacuacgcuauuaucggaccuggccuucaggccaaggcgacacgggaggcccagaagcgcgcugccgcuggcauuaugaaaaauccgaccguugacgggaucacagugauugaucuggaccccaucccuuacgaucccaaguuugaaaaacaacucggacaggucaugcugcuggugcucugugucacccaggugcuuaugaugagaacgacaugggcccugugcgaggcccugacccucgcgacaggcccuaucagcacccugugggaagggaaccccggacgguucuggaauaccacaauugcuguuucuauggccaacaucuuucgcggcuccuaucuugcuggggccggacugcucuucagcauuaugaagaauacgaccaacacaagacggggcaccggcaauaucggggagacacugggagaaaaauggaagucucgccugaacgcccucggcaaauccgaguuccaaauuuacaagaagagcgggauccaggagguggacagaacccuugcuaaagaaggaaucaagcggggcgagacggaucaucacgccgucucucgcgggagcgcgaaacugagaugguuuguggaacggaacaugguuacaccggagggaaagguggucgaccugggcuguggcagagggggaugguccuauuacugcggcgggcucaaaaaugugcgcgaggugaagggacugaccaagggcgggccuggacaugaagagcccauucccaugucuaccuauggcuggaaccuuguucggcugcagagcggcgucgauguguucuuuacaccucccgaaaaaugugacacccuccugugcgauaucggggaguccagcccuaauccgacaguggaagccggaagaacgcugcgcguccucaaccuuguugagaauuggcugaacaauaacacccaguucuguauuaaggugcugaaucccuacaugccuuccgugaucgagaaaauggaagcucuccaacggaaguauggcggggcccuggucagaaacccccuuucucgcaauagcacacacgagauguacuggguguccaacgcuucuggaaauauuguuagcuccgugaacaugaucucucggaugcugaucaauagauuuaccaugcgccacaaaaaggccacauacgaaccugacgucgaccucggcagcgggacccggaacauuggaaucgaguccgaaauucccaaccuggauaucauuggcaagagaaucgagaaaauuaagcaggagcaugaaacgagcuggcacuaugaccaggaucauccguacaaaaccugggcguaucacggcucuuacgagacaaagcagaccggguccgccagcucuauggugaauggaguugugcgccugcucacaaaaccuugggacgucgugcccauggugacccaaauggcuaugacagauaccacgccuuucggccagcagcgggucuuuaaggaaaagguugacacaagaacccaggagcccaaagaagggaccaagaaacuuaugaagaucacagccgaguggcuguggaaagagcugggaaagaaaaagacgccucgcaugugcaccagagaagaguucacacggaaggugcgcuccaacgcugcccucggcgcuaucuuuaccgaugaaaauaaauggaagagcgccagagaggcgguggaggacucucgguucugggaacuggucgauaaagagagaaaccuucaccuggaagggaagugugagacaugcguguauaauaugaugggaaaacgggaaaagaagcucggcgaguuuggcaaagccaaggggucccgcgcuauuugguacauguggcugggagccagauuccuggaguuugaagcucucggcuuccugaacgaggaccauugguucagccgggaaaauucccuuagcgggguugagggagaaggccugcacaaacucggguauauccugcgcgaugugucuaagaaagagggcggagccauguacgccgacgacaccgcgggcugggauacaagaauuacccuugaggaccugaagaacgaagagauggucacgaaucauauggaaggggagcacaagaaacucgcugaagccaucuuuaagcugaccuaccaaaacaaagugguucgggugcagcgccccacaccgagaggaaccgucauggauauuaucagccggcgcgaccagagaggcuccgggcaagugggaacauauggccugaauaccuucacgaacauggaggcccagcucauccggcagauggagggggaaggcguuuuuaagucuauucagcaucugacagugaccgaggaaaucgcuguccaaaauuggcuugcccgcgugggaagagagcggcugagccgcauggcuauuuccggcgaugacugcgucgugaaaccucucgaugacagauucgccucugcgcugacagcccuuaacgauauggggaagguucggaaggacauccagcagugggagcccagcagaggauggaaugauuggacccaggugcccuuuuguucccaccacuuccaugaacugauuaugaaagacggccgcguccucguggugccuugccggaaccaagaugagcugaucgggagagcucgcaucucucagggagccggcuggagccugcgggaaacggcuugucucgggaaguccuacgcccagauguggagccugauguauuuucacagacgcgaccuucggcuggcggccaacgcuauuugcucugccguuccgucccauugggugcccaccagcagaacaaccuggucuauccacgcuaaacacgaguggaugacaaccgaagacaugcucacagucuggaaucgcguguggauucaggagaacccuuggauggaggauaagacccccguugaauccugggaggaaaucccuuaccugggcaaacgggaggaccaaugguguggaagccuuauuggccugacguccagagccacaugggcuaagaauauccagaccgccauuaaccaggugcgcucucucaucgggaaugaagaguauaccgauuacaugcccagcaugaagcgguucagacgggaggaagaggaagcgggaguccugugguga

SEQ ID NO: 19671 - RNA, 9876 nt, Artificial Sequence
  derived and/or modified CDS sequence (opt5) from DENV-2__FJ898454__SS-prME
accgccggcgugaucauuaugcugauccccaccgcuauggccuuccaccucacgaccagaaauggggaaccucauaugauugucagccggcaggaaaagggaaaaucccugcuuuuuaagaccgaagacggcguuaauaugugcacccugauggcgauggaucucggggaacugugugaagacacgaucaccuacaacugcccccuucugcgccaaaaugaacccgaagauauugacuguuggugcaacucuacaagcaccugggugacguauggaaccuguacagcuaccggcgaacacagacgggaaaaacgcuccguggcccucgucccucauguggggaugggacuggagacaagaaccgaaacguggaugucuagcgagggcgccuggaagcacgcucagcggaucgagacauggauccugcgccaucccggcuucaccauuauggccgcuauccucgccuacacaauugggaccaccuauuuucagagaguucugaucuucauucuucugacagcgguggccccuuccaugacgaugcggugcaucggaauuucuaaucgcgauuuugucgaaggcgugagcgggggauccuggguugacaucgugcucgagcacggcagcugugucaccacaauggcuaaaaacaagcccacccuggauuucgaacuuaucaagacagaggccaaacagccugcuacccugagaaaguacugcauugaagccaaacucacgaauacaaccaccgcgucucgguguccgacacaaggggagcccucccugaacgaggaacaggacaagcgcuuugugugcaaacacagcaugguggauagaggauggggcaauggcugugggcuguucggaaagggcgggaucgugaccugcgccauguuuacaugcaagaaaaacauggagggaaagauuguucagccugaaaaucucgaguauacgaucguggugacaccccauucuggcgaagagaacgcugucgggaaugacacaggaaaacacggcaaggagauuaaagugaccccucaguccagcaucacagaagccgagcugaccggcuacgggacgguuaccauggaauguucuccccggacaggacuugauuucaacgagauggugcugcuccaaauggaaaauaaggcuuggcugguccaucgccagugguuucuugaccugccgcucccuuggcugcccggcgccgauacccagggguccaacuggauccagaaagagacacuggugaccuucaagaacccucacgccaagaaacaagacguugugguccucggaagccaggagggcgcuaugcacacggcgcugacaggggccaccgaaauucagauguccucuggcaaucuucuguuuacaggacaucucaagugcagacugcggauggacaaacuucaacugaagggcaugagcuauuccauguguaccgggaaauucaagguggucaaggagaucgcugaaacccagcacggaacaauugugguuagagugcaguacgagggcgaugggagccccugcaaaauccccuucgagauuauggaccucgaaaagcgccauguccugggacggcugaucacggugaacccuaucguuaccgagaaagauucuccggugaauauugaagccgagcccccuuuuggcgacuccuacaucauuaucggggucgaacccggccagcucaagcugagcugguucaaaaagggaucuagcauuggccaaauguuugagacaaccaugagaggggccaagcgcauggcuauccuuggagauacagccugggacuucggcucccucggcgggguguuuaccucuauugggaaagcgcuccaccagguguucggggcuaucuauggcgccgccuuuagcggaguuuccuggacgaugaagauccugauuggcgucgugaucacauggauugggaugaacagccggucuaccucccugagcgugucucuuguccucgugggaguugugacccuguaccugggcgucauggugcaggcugauuccggguguguugugagcuggaaaaauaaggagcucaaaugcggauccggcaucuucauuacagacaacguccauaccuggacagaacaguauaaguuucaaccugagucucccagcaagcuggccuccgcuauccagaaagccuacgaagaggggaucuguggcauuagaucugugacgcgccuugaaaaucugauguggaagcagaucaccccggagcucaaccacauucugagcgagaaugaagcgaaacugacaaucaugaccggagauauuaagggcaucaugcaggccgggaaacggucccuuagaccucaacccacagagcucaaguauagcuggaaaaccuggggaaaggcuaagaugcugucuacggaaccucacaaccagaccuuccugaucgacggccccgagacagccgaaugcccuaauaccaaccgcgcuuggaacucccucgagguugaggauuacggguuuggaguguucacaaccaacauuuggcugaaacuuaaggaacggcaggacgucuuuugugacagcaaacugaugucugccgcgaucaagaauaacagagccgugcaugcugauaugggcuauuggauugaguccgcccucaacgacacauggaaaaucgaaaaggcuagcuucauugaggugaagucuugccacuggcccaaaagccauacccugugguccaauggcguccuggagagcgaaaugaucaucccgaagaacuucgccgggccuguuucucagcacaauuaccgccccggauaccacacgcaaacagccggccccuggcaucuugggaaacucgagauggauuuugacuucugugaaggaaccaccgugguggucacagaggauugcggcaaccgggggccuucccugagaaccacgacagcuagcggaaagcugauuaccgaauggugcugucgguccugcacacucccgccccugcgcuauagaggcgaggacggcuguugguacgggauggagauccggccucuuaaagaaaaggaggaaaaucuggugaacucucucguuaccgcgggacacggccagauugauaauuuuagccugggggugcugggaauggcccuuuuccucgaggaaaugcugagaacacgcgucggcaccaagcaugcugugcugcucguugccguguccuuuaugacgcugaucaccgggaacaugucuuuccgggaccuuggaagagucauggugaugguuggcgccgcuauuacagaugacaucggcaugggggugaccuaucuggcccuccuggcggcuuuuaaaguccgccccacauucgccgccggacugcuucugagaaagcucaccagcaaagagcugaugaugacgacaauuggcaucgugcuccugucccagucuaccaucccugagacaauucuugaacugaccgaugcucucgcccuggggaugaugauccugaagauugugcggaauauggagaaauaccaacuugcggucaccaucauggcuacacugugcguucccaacgccgugauucuccagaaugccuggaaggugagcuguacgauccuggcugucguguccguuagcccucuccugcuuaccucuucccagcagaaggccgacuggaucccccuggcucucacaauuaaaggacugaacccgaccgccaucuuucugacaacccuuagccgcacgaauaagaaaagaucuuggccucugaacgaagcgauuauggccgugggcauggucuccauccucgcuagcucucugcucaagaaugauauucccaugacagggccucugguggccggaggccuucugaccguuugcuaugugcugaccggccgguccgcugaccucgagcuggaacgcgccgccgacgucagaugggaggaucaagcugagaucagcggguccagccccauccuuucuauuacaaucagcgaagacggauccaugucuauuaaaaacgaggaagaggagcagacccugacaauccucauucggacgggccugcucgugaucagcgggcuguucccggucuccauuccuaucaccgcggccgcuugguaccuuugggaagugaagaaacagcgcgccggaguucugugggaugugcccucuccuccgcccgucggcaaggccgagcuggaagacggggcuuauagaaucaagcagaaagggauucugggcuacagccaaaucggcgccgggguguacaaggagggaacauuucacaccauguggcauguuacacggggcgcggugcugaugcacaaagggaagcgcauugaaccuuccugggcugaugucagaaaagaccuuaucucuuauggaggcggguggaagcuggagggagaguggaaggaaggcgaggaaguccaggugcucgcccuggagccgggcaaaaacccccgggccguucagaccaagccuggacucuucaaaacgaauaccggaacaauuggcgcugucagccuggauuuuucccccgggaccagcggaucuccuaucguggacaagaaaggcaagguggucgggcuuuacggaaacggcgugguuacaagauccggcaccuaugugagcgccaucgcgcagacagaaaagucuauugaggauaaucccgagaucgaagacgauauuuuccgcaaaaagcggcugacgaucauggaccugcacccuggggcuggaaaaaccaagagauaccucccggccauuguccgcgaggccaucaaacggggccugagaacacuuauccuggcucccacccgcgugguugccgcugaaauggaggaagcccuccgggggcugccuauuagauaucaaacccccgcgauccgcgccgagcauacaggacgggagauuguggaucucaugugucacgcuacguucaccaugagacugcuuuccccuguccgggugcccaacuacaaucugaucauuauggacgaagcccauuuuacagacccggcuagcaucgccgcccgcggcuauauuuccaccagaguugagaugggggaagcugcgggcaucuucaugacagccaccccucccggaucucgggaucccuuuccucagagcaacgcucccaucauggacgaggagcgcgaaauuccugagagauccuggaauagcggccacgaaugggugacggauuucaaggggaagacagucugguuugugccgucuaucaaagccggaaacgacauugccgcuugccugcggaagaauggcaaaaaggugauccagcucuccagaaaaaccuucgauagcgaguacauuaagacccgcacaaacgacugggauuuugucguuaccacagacaucucugaaaugggggccaauuucaaggcggagcgggugaucgaucccagacgcuguaugaaaccugugauucugaccgacggagaggaacgggucauccuugcuggccccaugccugugacgcauagcuccgccgcccaaagacgcgggcggauuggcagaaaccccaagaaugagaacgaucaguacaucuauaugggagaaccgcuggagaaugacgaagacugcgcucacuggaaagaggccaagaugcuccuggauaacauuaacacaccugagggcaucauccccucuauguuugaaccugagcgcgaaaaaguugacgcgauugauggggaguacagacugcggggagaagcccgcaagaccuucguggaccucaugagacggggcgaucuucccgucuggcuggcuuaucgcguggccgcugaggggaucaauuacgccgacagacggugguguuuugauggaauuaaaaacaaucagauccuggaggaaaacguugagguggaaauuuggacaaaggagggcgagagaaagaaacucaagccucgcuggcuggacgcucggaucuauagcgauccccuugcccugaaagaguucaaggaguucgcggccgggagaaaaucccucacccugaaucugauuacggaaaugggccgccucccgaccuuuaugacacagaaggcucggaacgcccuugacaaucuggcuguccugcacaccgccgaggccggaggcagagcuuacaaccaugcgcucucugaacugccugagacacuugagacccugcuccugcugacacuccuugccaccgugacagggggaaucuuccuguuucugaugagcggcaaggggaucggaaaaaugacacucggcaugugcugcauuaucaccgcuuccauucugcuuugguaugcccaaauccagccccacuggauugccgcuagcaucauccuggaguucuuucucauuguccugcugauccccgagccugaaaagcagcggaccccgcaggauaaucaacucacauacgugguuauugccauccuuaccgugguggcggccacaauggcuaacgagaugggcuuccuggagaaaacgaagcgcgacuuugggcugggaucuauugccacccagcagcccgaguccaauauccucgauaucgaccugagaccugcuagcgccuggacacuuuacgcggucgccaccacauucauuacccccaugcugcggcauuccaucgagaacucuagcguuaaugugucccucacggcuauugccaaccaggcuaccgugcugaugggccuggggaaaggauggccucucucuaagauggacaucggcgucccccuucuggccauuggguguuauagccaagugaauccuaucacacugaccgcugcccuccugcuucugguugcgcacuacgccauuaucggaccgggccuccaggcuaaggccacacgcgaagcucagaaaagagccgccgcgggcaucaugaagaaccccaccguggaugggauuacggucaucgaccuggauccuauucccuaugacccuaaauuugagaagcagcugggacaagugaugcuccuuguccugugcgugacacagguucugaugaugcggaccacaugggcucucugugaagcccugacccuugcuaccggccccaucuccacacugugggaggggaauccgggacgcuucuggaacacgaccauugccgugagcauggccaacaucuuuagaggcucuuaccucgcuggggccggacugcuguucuccaucaugaaaaauacaaccaacacacggcgcggcaccggcaauacgggggaaacacucggagagaaguggaagaacagacuuaauagccugggcaaaucugaguuucagauuuauaagcgguccgggauccaagaagucgauagaacccuggcgaaagagggaauuaagcgcggcgaaaccgaccaccaugccgugagccgggggucugcuaaacucagaugguucguugagcgcaaccuggugacaccugagggaaaggucguggaucuuggcugcggcagagggggauggagcuacuauuguggcgggcugaaaaaugugcgggaaguuaagggacucaccaagggcgggcccggacacgaggaacccaucccuauguccacauacggcuggaaccugguccgccugcagucuggcguggacguguucuuuacgcccccugagaaaugcgauacccuccuuugugacauuggggaaagcuccccgaaucccacagucgaggccggacggacccugagaguucugaaccucguggagaauuggcugaacaauaacacacaguucugcaucaaggugcuuaauccuuacaugcccagcgucaucgagaaaauggagacccugcagcgcaaguauggcggggcucucgugcggaacccucuguccagaaacucuacgcaugaaauguacuggguuagcaaugccuccggaaacauugugucuagcgucaauaugaucucccgcaugcugauuaaccgguuuaccaugagacacaaaaaggcgacauaugagcccgauguggaccucggcucugggacccgcaauaucggaauugaaagcgagacaccgaaccuugauaucaucggcaagagaauugagaaaaucaagcaagaacaugagaccuccuggcacuacgaccaggaccacccuuauaaaacaugggccuaccauggcagcuaugaaaccaagcagacggggucugcuuccagcaugguuaauggagugguccggcugcugacaaaacccugggaugugauuccuauggugacccagauggccaugaccgacacaacgcccuucggccaacagcgcgucuuuaaggagaagguugauaccagaacacaggaaccuaaagaggggaccaagaaacucaugaagaucacagcugaguggcuguggaaagaacuuggaaagaagaaaacaccccggauguguacaagagaggaguucacccggaaggugcgcucuaacgccgcucugggcgccauuuuuacggacgagaauaaauggaaguccgcgagagaggccguggaagauagccgguucugggagcucgucgacaaagaacgcaaccugcaccuggaggggaagugcgaaaccuguguguacaauaugaugggaaaaagagagaagaagaucggcgaguuuggcaaagcuaaggggucucgggccauuugguacauguggcucggagcucgcuuccuggaauuugaggcccuuggcuuccugaacgaagaucauugguuuuccagagagaauagccucuccgggguugaaggagagggccugcacaaacuuggguauauccugcgggaggugagcaagaaagaaggcggagccauguacgcggacgauacagcuggcugggacacccgcaucacacucgaggaucugaagaacgaagagauggucaccaaucacauggaaggggagcauaagaaacuggccgaggccauuuucaagcucacguaucagaacaaagugguuagagugcaacggccgacaccucgcggaaccgucauggacaucauuucuagacgggaccagcgcggcagcggacaggugggaacauacggccugaacaccuucacgaauaugggggcucaacuuaucagacagauggaaggcgagggaguuuuuaagggcauucagcaccugaccgccacagaagagguggcuguccaggauuggcucgcccggguggggagagagcgccugucccggauggcgaucucuggagacgauugcgucgugaaaccccuugacgauagauucgccagcgcucugaccgcccucaacgacaugggcaagauccgcaaggauauucaacagugggaacccucccggggguggaaugacuggacacagguuccuuuuugcucucaucacuuccaugagcugaucaugaaagauggaagagugcuggucgugccgugucgcaaccaggacgaacucauuggccgggcuagaaucagccaaggggccggcuggucccugcgcgagaccgcgugccuuggaaagucuuaugcccagauguggagccugauguacuuucaccggagagaucuccgccuggcugccaaugcuauuuguuccgccgugcccagccacuggguuccuacaucucggaccacgugguccauccaugcuagacacgaauggaugacaaccgaggacaugcuuaccguguggaaccgggucuggauccaggagaaucccuggauggaagauaaaacaccuguggagagcugggaagagauucccuaucugggcaagagagaagaccaguggugcgggucucucaucggacugaccucccgcgccacaugggcgaaaaacauucaaacggccaucaaucagguucggagccugauuggcuccgaggaguacaccgacuacaugccuucuaugaagagauuccgcagagaagaggaagaggcuggggugcucugguga

SEQ ID NO: 19672 - RNA, 9876 nt, Artificial Sequence
  derived and/or modified CDS sequence (opt5) from DENV-2__JQ922551__SS-prME
acagugggcaugaucauuaugcugauccccacggccauggcuuuccaccucacgacccggaacggggagccucauaugauugucagccggcaggaaaaggggaaaucccugcuuuuuaagacagaggacggcguuaauaugugcacccugauggccauggaucucggggaacugugugaggacacaaucaccuacaacugcccgcuucugaaacaaaaugaacccgaggauauugacuguuggugcaacucuacaagcaccugggugacguauggaaccuguacagcgaccggcgagcaccgcagagaaaagcgguccguggcucucgucccucauguggggaugggacuggagacacgcaccgaaacguggaugucuagcgagggcgccugcaaacacgcccagagaaucgagacauggauccugcggcaucccuccuucaccauuauggcugccauccucgcuuacacaauuggcaccaccuauuuucagcgcguuguguuccugaugguccuuacagccguggcgcugucuaugacgaugagauguaucgggauuagcaaucgggauuuuguugaaggaguguccggcgggagcugggucgacaucgugcucgagcacggaucuugcgugaccacaauggccaagaacaagccuacccuggauuucgaacuuauuaaaacagaggcuaagcagcccgccacccugcgcaaauacuguaucgaagcuaagcucacgaauacaaccaccgccuccagaugcccuacacaaggcgagccgagccugaacgaggaacaggacaaacgguuuguccgcaagcacucuaugguugauagaggguggggaaauggcuguggccuguucgggaagggaggcaucgugaccugcgcgauguuuacaugcaaaaagaacauggaggggaaaauugugcagcccgaaaaucucgaguauacgcuggucaucaccccucauuccggagaagagaacgccgugggcaaugacacagggaaccacggaaaggagauuaaaguuacaccccagagcucuaucacagaagcugcccuuaccggcuacggcacggugaccauggaguguuccccucggacagggcugaauuuccaugaaauggucagccuccccauggagaacaaggcuuggauggugcaccgccaaugguuucuggaucuuccgcugccuuggcuccccggagccgacacccagggcuccaacuggauucagaaagaaacacugguuaccuucaagaauccucacgccaagaaacaggauguggucgugcuggggucucaagagggagcuaugcauacggcgcucacaggcgccaccgagauccagaugagcuccgggaaccugcuuuuuacaggccaccugaagugcagacuccggauggacaaacugcagcuuaagggaaugagcuauucuauguguaccggcaaauucaaggucgugugggggaucgcuagaacccaacauggaacaauuguucaccgcgugcaguacgaaggcgacgggucccccugcaagaucccccugaauauuaugggacucgagaaacggcauguccugggcagaccuaucacggugaacccgauuguuaccgggaaggauagccccgugaauaucgaagccgagccuccccugggcgacucuuacaucauuaucggagucgagccuggccaggugaaacucacauguagccagaagggguccucuauuggacaaauguucgaaaccacaaugcgcggcgccaaacggauggcuauccugggggauaccgccugggacuuuggaagccuuggcgggguguucacguccauuggcaaggcgcugcaccagguuuuuggagcuaucuauggcgccgccuucagcggggucucuuggacaaugaagauucucaucggaguggugaucaccuggauuggcaugaacuccagaagcaccucucuguccgucagccuggugcuuguugggguggucacacucuaccugggagugaugguucaggcugauuccggcugcguggucucuuggaaaaauaaggagcugaaaugugggagcggcaucuuugugaccgacaacguucacacauggacggaacaguauaaguuccaacccgaguccccgucuaaacucgccagcgcuauucagaaggcccaugaagagggaaucugcggcauucgcuccgugacccggcuggagaaucuuauguggaagcagaucacaccugaacugaaccacauccucagcgagaaugaagucaaacugaccauuaugacaggggauaucaagggaauuaugcaggcgggcaaaagaucucugcgcccccaaccuaccgagcuuaaguacuccuggaaaacgugggggaaggccaaaaugcucagcaccgaaccccauaaccagacauuucugaucgacggaccugagaccgcugagugucccucuacaaaucgggccuggaacucccugaagggcggcgauuauggguucggaguguuuaccacaaauauuuggcucaagcugaaagaaagacaggacgugagcugcgauucuaaacuuaugagcgcugccaucaaagacaaccgcgcgguccacgccgacaugggcuacuggaucgaguccgcucugaacgauaccuggaagauugaaaaagccagcuucaucgagguuaagucuugucacuggccgaagucccauacgcucuggagcaauggggugcuggaauccgagaugauuaucccuaaaaaccuggcuggacccgugucucagcacaauuaucggcccggcuaccauacacaaaccgccgggccuuggcaccuuggaaagcucgagauggacuuugaucugugcgaaggcaccacagucgugguuaccgaggacugcggcaacagagggccgagccugcggacgacaaccgccuccggaaaacucauuacagaaugguguugccgcucuuguacccugcccccucuuagauaccggggcgaggaugggugcugguauggaauggagaucagaccccugaaggaaaaagaggaaaaucucgugaacagccuggucacagcugagcaugaacagaucgacaauuucucccugggcgugcuugggauggcgcucuuucuggaggagaugcugcgcacccggguuggaacgaagcacgccgugcuccuggucgcugugucuuucaugacccuuauuacaggcaacaugagcuucagagaucugggccgcguuauggugauggucggggccgccaugaccgacgauaucggaaugggcgugacauaccucgcucugcuggccgcguuuaaggugagaccuaccuucgcugccgggcuucugcuccggaaacugacguccaaggaacucaugaugacaaccauuggaaucguccugcuuagccagucuacaauucccgagaccauccuggaacucaccgacgcccuggcucugggcaugaugauucuuaaaaucguucgcaauauggagaaguaucaacuggccgugacaaucauggcgauucucugugugccuaacgcuaugauccugcagaaugccuggaaagucuccugcacgauucucgccgugguuagcgugucuccccugcuucugaccuccagccagcagaaggcugauuggaucccgcucgcccugacaauuaaggggcugaacccuaccgcuaucuuucuuacaacccugucuagaacgaauaaaaagcgguccuggccccucaacgaagccaucauggcggucggaauggugagcauucuggccuccagccuccugaaaaaugacaucccuaugacaggcccccuuguugcuggcgggcugcugaccguguguuaccuccugccgggacgcucugccgaucuugagcuggagagagcugccgaccuccggugggaagaccaagccgagauuagcggcuccucuccuauccugagcauuaccaucuccgaagaugggucuaugagcaucaagaaccaggaggaaaaacagacacucaccauucugaucaagacaggacuucuggucauuuccgagcuguuccccgugcagaucccuauuacggcugcggccugguaucucugggaggucaaaaagcaacgcgcuggcgugcugugggacguucccucucccccuccgguggggaaggccgaacuugaggauggagccuacggcaucaaacagaagggcauucugggguauagccagaucggagcuggcgucuacaaagaagggaccuuucacacaauguggcaugugaccagaggagccguucucaugcacaagggcaaacggaucgagcccuccugggcggacgugcgcaaggaucugauuagcuacgggggaggcuggaagcucgagggcgaauggaaagagggggaagagguccaggugcuggcucuugaaccuggaaagaaccccagagccgugcaaacacggccuggccuguucaaaaccaauacggggaccaucggagccguuucucuggacuuuucccccggcacaagcgggucuccuauugucgauaagaaaggaaagguggugggccucuauggcaacggggucgugaccagauccggaacauacguuagcgcuaucgcccagaccgagaaguccauugaggacaauccggaaaucgaggaugacaucuuccgcaaaaagcggcugacaauuauggaucuucaucccggcgcggggaaaacgaagagauaucugccugcuaucgugcgcgaagccauuaaacggggacucagaacccugauccucgcccccacacgcgucguggcugccgagauggaagaggcucugcggggccuuccuauuagauaccagacccccgccauccgcgcggagcacaccgggcgggaaaucguugaccugaugugccaugccacauuuacgaugagacugcucucuccggugcgggucccuaacuauaaucugauuaucauggaugaggcucacuucaccgaccccgccagcauugcugcccgcggcuacaucuccacaagaguggaaaugggagaggccgcuggcauuuuuaugaccgcgacacccccugggagccgggaccccuucccucaaucuaacgccccgaucauggaugaagaacgcgagauucccgaaagauccuggaauagcggacacgaguggguuaccgacuuuaagggcaagacggugugguucgucccuucuaucaaagcugggaacgauaucgccgccugucuucggaagaauggcaagaaggugauucagcugagcagaaaaacauucgacuccgaauauaucaagacccgcaccaacgauugggacuuuguggucacaaccgauauuucugagaugggcgcuaauuucaaggccgagcggguuaucgaccccagacgcugcaugaaaccugugauucucacagauggggaggaacgggugauccuggcgggccccaugccggucacccauagcuccgcugcccagagacgcggacggaucggcagaaacccuaagaaugaaaacgaccaguacauuuacaugggggagccccuggaaaaugaugaggacugugcccacuggaaagaggcuaagaugcuccuugacaacaucaacacgccugaaggaauuauccccucuauguuugagccugaacgcgagaaaguggaugccauugacggcgaauauagacugagaggggaagcgcgcaagacauucguugaucugaugagacggggagaccuccccguguggcuggccuaccgcgucgcugccgagggcaucaauuaugcugauagacgguggugcuuugacgggaucaaaaacaaucaaauucuugaagagaacguggaaguugagaucuggaccaaggaaggcgagaagaaaaagcugaaaccgagauggcucgaugcccgcauuuacagcgacccucuggcucugaaggaguucaaagaauuugccgcgggacggaagucccucacacuuaaucugaucaccgagaugggcagacugcccacguucaugacccagaaggcccgcaacgcucucgauaaucuggccgugcuucauacagcugaagccgggggacgggccuauaaccacgcucugagcgagcuccccgagacccuggaaacacugcuccuucugacccugcucgcgacagucaccggcgggauuuuucuguuccuuaugucuggaaaaggcaucggcaagaugacgcuggggaugugcuguauuaucacagccuccauccuccugugguacgcucagauucagccucacuggaucgccgccagcauuauccuggaguuuuuccucauugugcuucugaucccggaacccgagaaacaaagaaccccucaggacaaucagcugaccuaugucgugaucgcuauucucacagccguugcggccaccauggcuaacgaaaugggauuccuggagaagaccaagaaggauuuuggccuuggguccaucgccacgcagcccccugagucuaauauucuggacaucgaucuccggcccgcuagcgccuggacccuguacgcgguggccacaaccuucauuacauccaugcugcgccauucuaucgaaaacagcuccgugaaugucagccucaccgcuaucgccaaccaagcuacgguucuuaugggacugggcaagggguggccucugucuaaaauggacauuggagugccgcuccuggccaucggcugcuacucccaggugaaucccauuacccuuacagcugcccugcuccugcuggucgcgcacuaugccaucauuggcccugggcuccaggcuaaggccaccagagaggcucagaaacgggccgccgcgggaaucaugaagaaccccacaguggacggcauuaccguuaucgaucuugacccuauccccuacgauccgaaauuugaaaagcaacugggacaggugaugcugcucguccugugugugacgcagguccuuaugaugcgcacaaccugggcucugugcgaggcccucacacuggcuaccggaccuauuagcacccugugggaaggcaaucccgggagauucuggaacacaacgaucgccgugucuauggccaacauuuuucggggauccuaucucgcuggcgccggccuucuguucagcaucaugaagaauaccacaaacacccgcagagggacaggaaauaccggcgagacgcugggggagaaauggaagaaccggcucaaugcgcugggaaaaucugaauuucaaauuuacaagaaaagcggcauccaggagguugaccgcacacuugccaaggaagggaucaaaagaggagagaccgaucaucacgcugugucccggggcucugccaagcugagaugguucgucgaacgcaaccucgugacccccgagggcaagguuguggaccugggguguggacggggcggguggagcuauuacugcggaggccugaaaaaugucagagaggugaaggggcucacaaaaggaggcccuggccaugaggagcccauuccuauguccaccuauggguggaaccuugugcgccugcagagcggaguugaugucuuuuucacaccgcccgaaaagugugacacgcugcucugcgauaucggcgaguccucuccuaaucccaccguggaggcugggcggacacugagagugcuuaaccuggucgaaaauuggcucaacaauaacacccaguuuuguguuaaagugcugaauccuuacaugcccagcgugauugagaagauggaaacacugcaacgcaaguacggaggcgcccucguccggaacccgcuuuccagaaacucuacccacgagauguauugggugagcaaugcguccgggaacaucguuucuagcgugaauaugauuucccgcaugcugaucaaccgguucacgaugagacacaaaaaggccaccuacgaaccugacgucgaucugggaagcggcacacgcaauaucggcauugagucugagacccccaaccucgacaucauugggaaacggaucgaaaagauuaaacaggagcaugaaacauccuggcacuaugaucaggaccauccuuacaagaccugggcuuaucacggaagcuacgagacaaagcagaccggcucugccuccagcauggugaaugggguugugagacugcuuacgaaacccugggacgucaucccuauggugacacaaauggcuaugaccgauaccacacccuuuggacagcagcgcguguucaaggaaaaaucugacacgagaacccaggagccgaaggagggcaccaaaaagcugaugaagaucaccccuaaauggcucuggaaggaacuggggaaaaagaaaacaccccggaugugcacccgcgaggaguucacaagaaagguccgguccaacgccgcucugggagccauuuuuaccgaugagaauaaauggaaaagcgcgagagaagccguugaggacucccgguucugggagcucguggauaaggaacgcaaccugcaccuugagggcaaaugugaaacgugcguguauaauaugaugggcaagagagagaaaaagcugggggaguuuggaaaagcuaagggcagccgggccaucugguacauguggcucggggcucgcuuccuggaauuugaggcccuuggauuccugaacgaagaccauugguuuucuagagagaauagccucuccggcgucgaaggggagggccugcacaagcugggauacauucuccgggaugugucuaaaaaggagggcggggccauguaugcggacgauaccgcuggaugggacacacgcaucacccuggaagaucuuaaaaacgaggaaaugggcgccaaucaucuggagggggaacccaagaaacucuacgaggccauuuucaagcugacauaucaaaacaagggaguuagagugcagcggccuaccccgcgcggcccccuuauggacaucauucugagacgggaccaagggggaagcggacaggucggcacguacgggcucaacacauuuaccaauaugggagcucagcugauccgccagauggagggcgaagggguguucaaaggaauccagcaccugauugccacagaggaaaucgcuguucaagauuggcucgccagagugggccgggagcgcuuuuccagaauggcgauuucuggggacgauugcgucgugaagccucuggacgaucgguucgccagcgcucuuaccgcccugaacgacaugggcaaagaaagaaagguucuccagcagugggagcccucccgcgaguggaaugauuggacacaggugccuuuuuguucucaucacuuccacgaacugaucaugaaagacggacggguccuugugguccccugcagaaaccaagaugagcugauuggccgcgcucggaucagccagggggccggauggucccucagagaaaccgcgugucugggcaagagcuaugcccagauguggucucagauguacuuccaucgccgggaccugagacucgcugccaaugcuaucugcuccgccgugccuagccacuggguucccacaucucgcaccacaugguccauucaugcucggcacgaguggaugaccacagaggauaugcugaccguguggaacagagucuggauccaagaaaauccguggauggaggacaagacgccuguggaaagcugggaggaaauucccuaucuugggaaacgcgaggaucagugguguggaucccugaucggccucacaucucgggccaccugggcgaagaacauucagaccgccaucaaucaggugagaagccugaucgggaacgaggaauacacagacuacaugccuuccaugaaacgguuuagacgcgaggaagaggaagcuggcguucuuugguga

SEQ ID NO: 19673 - RNA, 9876 nt, Artificial Sequence
  derived and/or modified CDS sequence (opt5) from DENV-2__JQ922550__SS-prME
accgugggaaugaucauuaugcugauccccaccgucauggccagccaccucacgacccggaacgggggaccucauaugauuguuaucggccagcaaaagcggaagacguccuucuuuaagaccaaaaaggggcacgacaugugcacacugauggcuauggccuucggagaguuuugugaaaauaccauuacauacaaaugcccguuccuuaagcagaacgagcccgaagauaucgacuguuggugcaauucuaccagcacgugggugaccuauggcacauguaccacaaccggggagcaucgcagagaaaagcgguccguggcgcuggucccucacgugggaaugggccucgagacgcgcacagagaccuggaugucuagcgaaggcgcuuggaaacaugcccagagaaucgagacauggauucugcggcaccccggguuuaccaucauggccgcuauucuugccuacaccaucggaacaacgcacuuccagcgcguucugauuuuuauccuccugaccgcuauugccccuuccaugacaaugagaugcaucggcaucucuaaccgggauuucguggaaggggucagcggaggcuccuggguggacauuguucuggagcaugggagcugugugaccacaauggcgaagaauaaacccacccucgauuuugagcugaucaagacggaagccaaacaaccugcuacacuucgcaaguauugcauugaggccaagcugaccaacaccacaaccgacucuagauguccgacacagggagaacccacgcucaaugaggaacaggauaaacgguucgucugcaagcacuccaugguggaccgcggcuggggcaacggguguggacuguuuggcaaagggggaaucgugaccugcgcuauguucacaugcaagaaaaauaugaagggcaaaauuguccagccugagaaccuugaguacaccguugugaucacaccccauagcggggaagaacacgccgugggaaaugauaccggcaagcacggcaaggaagucaaaaucacgccucaaucuuccauuaccgaggcggaacugacaggguauggaaccgugacaauggaguguagccccagaaccggccucgacuuuaacgagaugguucugcugcagauggaagauaaggccuggcucgugcaucggcagugguuccuggaccuuccgcugccuuggcuccccggggcugauacgcagggaucuaauuggauccaaaaagagacacuggucaccuucaagaacccucacgccaaaaagcaggacgugguugugcuuggcucccaggaaggggcuaugcauacagcccugaccggcgccaccgagauucaaaugagcuccggaaaucuccuguuuacaggccaccugaagugccgccucagaauggacaaacugcagcuuaaggggaugucuuacagcauguguacgggaaaauucaaggucgugaaagaaaucgcugagacccagcauggcacaauugucauccgggugcaguaugagggggauggaucccccugcaagauccccuuugaaauuaaggaccuggagaaaagacacguucucggccgccugaucaccgugaacccuauugucacagaaaaggauagcccggugaacaucgaggcggagcccccucuuggggacucuuacauuaucauuggcguugaacccggacaacugaaacucgauugguucaagaaaggcuccagcaucgggcagauguuugagaauaccaugcggggagccaagagaauggcuauccugggcgacacggccugggauuucgggucucugggaggcguguuuacaagcauugggaaggcccuccaccaggucuucggcgcuaucuacggagccgcguuuuccggcgugucuuggaccaugaaaauucugaucggggugauuaucaccuggaucggaaugaacagccgcuccacaagccuuucuguuucccugguccucgugggcauugugacccuguaucugggggucauggugcaggcugacagcggauguggcgggugcgaacggaagacaaaaacgaaguguggcucuggaaucuucguuaccgauaaugugcauacauggaccgagcaauacaaauuucagccugaaucccccagcaaacuugccuccgccauucagaaagcucacgaggagggcaucugcgggauuagaucugucacacgccucgaaaaccugauguggaagcagaucaccccggagcugaaucauauccucagcgaaaacgaggugaagcugacgauuaugaccggagacaucaaaggcauuaugcaagccgggaagcggucccuuagaccucagcccacagaacugcgcuauucuuggaaaaccuggggaaaggcuaaaaugcucagcacagagcugcacaaucagaccuuccugaucgauggcccugagacagccgaaugucccaacaccaaucgggcguggaacucccuugagguugaagacuacggcuuugggguguucacgacaaauauuuggcucagacugcgcgagaagcaggacgucuucugcgauagcaagcugaugucugccgcuaucaaagacaaccgggccgugcacgcugauaugggauauuggaucgaauccgcccucaaugacaccuggaagauugagaaagcgagcuuuaucgagguuaagucuugucauuggccuaaaucccacacccuguggggcaacggggugcuugaaagcgagauggucauucccaagaauuucgccggaccggugucucaacauaacaacagaccuggcuacuauacacagaccgcugggcccuggcaccugggaaagcucgaaauggauuuugacuucugcgagggcacgacaguggucguuaccgaggauugcggcaaucgggggcccagccugcgcacaaccacagccuccggaaaacugaucaccgaaugguguugcagaagcuguacgcuuccuccgcccaaguaccggggcgaggacgggugcugguacggaauggaaauuagaccucucaaagagaaggaagagaaccuggugucuucccuggugaccgcuggccaugggcagaucgauaauuuuagccucggcauucugggcauggcccuuuuccuggaggaaaugcuccgcacacgggucggcaccaaacacgccauccugcugguggcuguuuccuuugugacacuuaucaccgggaacaugucuuucagagaccucggacgcgucauggugaugguuggcgcgacgaugacagaugacauugggaugggagugaccuaucuggcccugcucgcugccuuuaaggucagacccacauucgccgcuggccugcuucugcggaagcucaccagcaaagagcugaugaugaccacaaucgggauugugcuguccucucaaagcuccaucccugaaacgauucuugagcugaccgaugcccucgcgcugggaaugaugguucucaagauggugcgcaauauggaaaaauaccagcuggcugucacaaucauggccauccuuugugugcccaacgccgugauucugcagaaugcuuggaaggucucuugcaccauccucgccguugugagcguguccccucugcugcuuacaagcucucagcaaaaagcggacuggauuccccuggcucucaccaucaagggccugaacccgacggccauuuuucucacaacccuguccggcaccagcaaaagacggucuuggccucuuaaugaggccaucauggcugucgggaugguguccauccuggccagcucucuccugaagaacgacauucccaugacaggaccucugguugcuggcgggcuucugaccguguguuauguccucacaggacgcuccgccgaucuggagcucgaaagagcgacggacgugaagugggaugaccaggccgagaucagcggcuccagccccauucugucuaucaccauuagcgaagauggguccaugucuaucaaaaaugaggaagaggagcagacacuuaccauucugauccggacaggacugcucguuaucagcggccuguucccgguguccauuccuaucaccgcugccgcuugguaccuuugggaagucaagaaacagcgcgccggcgugcugugggacguccccucuccuccccucguggggaaggccgagcuggaagauggagcuuauagaauuaaacaaaagggcauccucggguacagccagauuggagcgggcguuuauaaggaggggacguuucacaccauguggcaugugacacggggagccguccugaugcacaaaggcaagcgcaucgagcccuccugggcugacgugaaaaaggaucuuaucucuuacggcgggggauggaaacuggaaggcgaguggaaggaaggggaggaaguucaggugcuggcccucgagccuggaaagaacccgagagccguccagaccaaacccggccuguuccggacaaauaccgggacaauuggagcugugagccuugacuucuccccuggcacgagcggcucucccaucguggauaagaaagggaagguugucggacuguacggcaacgggguggugaccagauccggagccuaugucagcgcgauugcucaaacagagaaaucuaucgaagacaauccugagauugaagaugacaucuuucgcaagcggagacucaccaucauggaccugcaucccggcgccgggaagaccaaacgcuaccucccugccauugugcgggaggcuaucaagagaggccugcgcacacuuauucuggccccgacgcggguuguggcggcugaaauggaggaggcccugagaggacuccccauccgcuaucagaccccugccauucgggcugaacacacaggcagagagaucgucgaucugaugugccaugccaccuucacaaugcggcuucugucccccauucgcgugccuaacuacaaccucaucaucauggacgaagcucacuuuaccgaucccgccagcauugcggccagaggguauaucuccacgcggguugagaugggagaagcugccggcauuuucaugacagcuaccccgccugggucucgcgaccccuuuccccagagcaaugccccuaucauggaugaggagagagaaauucccgagcgguccuggaacagcggacacgaaugggugaccgacuucaaaggcaagacagucugguuugugccuucuaucaaaaccgggaaugauaucgccgcuugucugagaaagaacggcaagcgcguuauucaacucucccggaaaacauucgacagcgaguacgugaagaccagaacgaaugauugggacuuugucgugacaaccgauaucucugagaugggagcgaacuucaaagccgaacgcgugauugacccgcggagaugcaugaagcccgucauccugacagacggcgaggaacgcguuauucuugcugggccuaugcccgugacccauagcuccgccgcccagcggagaggacgcaucggcagaaauccuaaaaacgagaaugaucaguauaucuacaugggggaaccccuggagaacgacgaggauugugcucacuggaaggaagccaaaaugcugcucgacaauauuaacacgccggagggaaucauuccuucuauguuugaacccgagcgggaaaagguggaugcgaucgacggcgaguaccgccugagaggggaggcucggaagacccuucuggaacucauucgcggcggaccuauccccgucuaucugggcuacaaauggccuggggagggaauuaauuaugccgauagcagacugugcgugggccggacacagaacaaucaaauccucgaagagaacguugaaguggagaucuggaccaaggaggggaaaggaaagaaacuuaagcccagauggcuggacgcccgcauuuacuccgauccgcuggcucucaaggaguucaaagaguucgccgcgggccggaagucucugacacuuaaccugaucaccgaaaugggcagacucccuacauuuaugacccagaaagcccgcgacgcucuggauaaucuggccguccuccauacggcugaggccgggggaaaggcuuauaaccacgcccuuagcgagcugcccgaaacacuggagacccuccugcuucugacccuccuggcgacagugaccggcgggauuuuccuguuucucauguccggacggggcaucgggaaaaugacacuuggaaugugcuguauuaucacggccagcauccugcugugguacgcucagauucagccccacuggaucgccgcuucuauuauccucgaguucuuucugauuguucuucugaucccugagccggaaaagcaaagaacaccccaggacaaucagcucacauaugugaucauugccauccugaccgucguggccgcuacaauggcgaacgagaugggcuuccuggagaagaccaaaaaggaucucggccuugggaauauugccacgcagcaaccugaauccaacauccuggacauugaccugcggcccgcuagcgccuggacccucuacgccgucgcuacaaccuuuaucacaccuaugcugcgccauuccauugaaaauucuagcgugaacguuucccuuaccgccaucgcgaaucaggccacggugcugaugggacucggcaaaggguggccccugucuaagauggauaucggagugccucugcucgcuauuggcugcuacagccaggucaacccgaucacacuuaccgccgcucugcugcuccugguugcccacuaugcgauuaucgggcccggacuucaggccaaagcuacaagagaagcccaaaagcgggcugccgcuggcauuaugaagaauccuaccguggacggcaucaccgugaucgaucuggaccccauuccuuacgaucccaaauucgagaagcagcucgggcaggucaugcugcuggugcucuguguuacacaagugcuuaugaugcgcacgaccugggcccugugcgaagcgcugacacucgccaccggaccggucuccacacugugggagggcaacccugggagauuuuggaauaccacgauccuuauucagauggcuaacauccugcggggaagcuaucucgccggcgcugggccccuguucucuauuauggagaauacaaccggaccccgcagacggaccggccagcugggccgcgaacuccuuagacgguggaaauccagacugaacgcccugggaaagagcgaguuucagaucuacaaaaagucuggaauccaagaaguggaccgcacacucgccaaagagggcauuaagagaggggaaaccgaucaucacgcggucuccagaggaagcgcuaagcugcgcugguucguggagcggaaucuuguuacaccugagggcaaaguggucgaccugggguguggaagaggcggcuggucuuauuacugcgggggacucaagaacgugcgcgaaguuaaaggccugacgaaaggcgggcccgggcaugaggaaccuaucccgaugagcaccuauggguggaaccuggugcggcuccaguccggagucgauguguuuuucauucccccugagagaugugacacacuucugugcgauaucggcgagucuagccccaauccuaccguggaagccggccgcacacugcggguucucaaccuggucgagaauuggcuuaacaauaacacccaguucuguauuaaagugcugaaucccuacaugccguccgugaucgaaaagauggagacgcuccagagaaaguacgggggagcucugguccgcaacccucugagcagaaauuccacccacgaaauguauuggguuucuaacgccagcggcaauaucguguccucugugaacaugauuagcagaaugcucaucaaucgcuuuacaaugagacacaaaaaggccaccuacgagcccgacgucgaucuuggguccggaacacggaacauuggcaucgagucugaaauuccuaaucuggacaucauugggaaacgcaucgagaagaucaaacaagaacaugagaccagcuggcacuaugaccaggaucaucccuacaagacaugggcuuaucacggauccuacgaaaccaagcagacgggcagcgccucuuccauggugaacggcguugugagacugcucacaaaaccuugggacgucgugcccaugguuacccagauggcgaugaccgauacaacgccguucgggcaacagcggguguuuaaggagaaagucgacacccggauucaggagccuaaggaaggaaccaagaagcugaugaagaucauggccgaguggcuuuggaaagaacugggcaagaaaaagacaccccggaugugcacacgcgaggaguucaccaaaaaggugagaagcaacgcugcccucggggcuauuuuuacagaugagaauaaauggaagucugcccgggaggcgguggaagacggacgcuucugggagcuggucgauagagaacggaaccugcaccucgagggcaagugugagaccugcguuuauaauaugauggggaaacgcgaaaagaaacugggcgaguuuggaaaggccaaaggcuccagagcuaucugguacauguggcuuggggcccgguuccuggaauuugaggcucucggauuccugaacgaagaccauugguuuagccgcgaaaauucucuuuccggcguggagggggaaggacugcacaagcucggcuacauucugagagaggugagcaagaaagaagggggcgccauguaugcugaugacacggccggaugggauacccggaucacacugggcgcgcucaagaacgagcgcaaaugcaccgaacauauggagggggagcccagaaagccuggacggggccacuucaaauggcgcaaucaaaacagagucguggggguucagggaccgacacccggcgggaccgugauggacaucauuucccggaagaaucagagaggcagcggacaggucggcacguacgggcugaacacauuuaccaauauggaagcccaacuuauccgccagauggagggagaaggcuucuucauugagcaucagcaccugacagcuucugaagagaacgccgugcaggacuggcucgcucggguugggagagagaaggugagccgcaugccuaucuccggagaugacugugucgugaaaccccuggaugaccgguuugccagagcccuuaccgcgcugaaugauaugggcaagguucgcaaagacauucaacagugggaaccuucucggggguggaacgauuggacacaggugcccuucugcagccaccauuuucacgagcucaucaugaaggacggcagaacccuggucgugccuugucgcaaucaggaugaacugaucggacgggcuagaauuucccaaggcgccggguggucuuucggagagacagccugccucggcaaaagcuaugcucagauguggucccugaucaacuuucgcauucccgaccuucggcuggccgcuaacgucaucuguucugugguuccgagccauugggugccuaccuccagaacaaccuggagcauucacgccaaucacgaguggaugacaaccgaagauaugcucacggucuggaaccggguguggauccuggagaaucccuggauggaagacaagacaccuguggagucuugggaagagauucccuaccuugagaagagagaagaucaguggugcgggucccugaucggacucaccccgcagccucccugggcgaaaaacaucgagaccgccauuaaucaaguucgcagccugaucggcaacgaagaguauauugacuaccugcccucuaugaagcgguucagaaucgaagaggaggaauccggcuuucucugguga

SEQ ID NO: 19674 - RNA, 9876 nt, Artificial Sequence
  derived and/or modified CDS sequence (opt5) from DENV-2__JQ922553__SS-prME
accgccggcaugaucauuaugcugauccccaccgugauggcuuuccaccucacgacccggaauguggagccuccgaugauuuuuagccggcaggaaaaggggaaaucuuuccuguuuaagacaaaagacggacaugauaugugcaccuucauggccauggaccuuggcgagcugugugaagauacaaucaccuacaagugccccuuucucaaacaaaaugagccugaagacauugauuguuggugcaacagcacaagcaccuggguuacguaugggaccuguacaaccacaggggagcaccgccgggagaagcgguccguggcgcuggugccccaugucggcauggggcuugaaacccgcacggagacauggaugucuagcgaaggagcuuggaagcacgugcagagaaucgagaccuggauccugcggcauccuggcuucacaauuauggccgccauccucgcuuacaccauuggcaccacacacuuucagcgcguucugaucuucauucugcucacggggguggcccccuccaugagaaugcggugcaucggaauuucuaaucgcgacuuugucgagggcgugagcgggggauccuggguugauaucgugcuggaacacggcagcugugucaccacaauggcuaaaaacaagccuacccuugaccuggagcucaucaaaacagaagccaagcagccggccacccugagaaaauauugcauugaggccaaacuuacgaauacaaccaccgauucucggugucccacacaaggggaaccuacccugaacgaggagcaggacaagcgcuucgugugcaaacauuccaugguggauagaggauggggcaauggcugugggcucuuuggaaagggcgcuaucgucacaugcgccauguucacgugcaaaaagagcaugaaagggaagauuguucagcccgaaaaccuggaguacaccguggugaucacaccucacucuggagaagaguaugcugucggcaaugacaccgggaaacauggaaaggaagugaagauuacaccccaguccagcaucaccgaggccgagcugacgggcuacggcaccguuacaauggaauguucuccgcggaccgggcucgauuuuaacgagauggugcugcuucaaauggaagacaaagcguggcugguccaccgccagugguuccucgaccugccucuucccuggcugccuggagccgauacacagggcuccaauuggauccagaaggagacccucgugacguucaaaaacccccacgcuaagaaacaagacguugugguccuggggagccaggaaggagccaugcauacagcucugaccggcgccacagagauucagauguccucugggaaucuccuguuuaccggccaccuuaagugcagacugcggauggauaagcuccaacugaaaggaaugagcuauuccauguguaccggcaaguucaaaguggucaaggagaucgccgaaacacagcaugggacgauugugaucagaguucaguacgagggagacggcagccccugcaaaauuccuuuugaaaucauggaucuugagaagcgccacgugcuggggcggcucaucaccgucaacccgauugugacagagaaggacucucccguuaauaucgaagcugagccucccuucggagauuccuacauuaucauuggcguggaaccugggcagcugaaacuggacugguuuaagaaaggcagcucuaucggacaaaugcucgagaccacaaugagaggcgcgaagcgcauggccauucugggggauaccgcuugggacuucggaagccuuggcggggucuuuacguccaucggaaaagcccugcaucagguguucggcgccaucuauggggcugccuuuucuggcgugagcuggacaaugaagauucucaucggaguuauuaucaccuggauuggcaugaacucccggagcaccucucuguccgucagccuggugcuuguggggaucgucacacucuaccugggagugaugguucaggcggauucuggcuguguggucuccuggaagaacaaagaacugaagugcgggagcggaaucuucgugaccgacaauguucacacauggacggagcaguauaaauuucaacccgaguccccgucuaagcucgcuagcgccauucagaaagcccacgaagagggcaucugugggauuagauccgugacccgccuggaaaaccuuauguggaagcagaucacacuggagcucaaucauauucugucugaaaacgaggucaaacugaccaucaugacaggcgacaucaagggaauuaugcaagugggcaagcggagccuuagaccucaacccaccgagcuccgcuacuccuggaaaacgugggggaaggcuaaaaugcugagcaccgaacugcacaaucagacauuccucaucgauggaccugagaccgccgaaugccccaacgcuaaucgggccuggaacucucuggagguugaagacuauggcuuuagaaaguacaaaacaaagauuuggccuacccuuaaggaguggcgcaaaguguucugugauuccaagcugaugagcgcggccaucaaagacaaucgggcuguccaugccgauaugggguauuggauugagucugcucucaacgacacauggaagaucgaaaaagccuccuucaucgaggugaagucuugccacuggcccaagucucacacccuguggggaaauggcgugcaggaaagcgagauggucauuccgaaaaacuuugcgggcccuguuucccagcauaauaacagacccggguacuacacgcaaacagccggacccuggcaccugggcaaacuugagauggauuucgacuuuugugaagggaccaccgugguggucacagaggauugcggaaaucggggcccuagccuccgcaccacgacagcuucugggaaacugaucaccgaauggugcuguagauccugcacacugccgccccuccgguauagaggagaggccggcuguugguacuggauggacauucgcccucugaaggaaaaagagaagaaccuugugagcucccugguuaccgcuggccaugggcagaucgauaacuucucucuccggauucugggaauggcccuguuucuugagaagaugcucaugacaagacugggcaccaaacacgccauccugcucguggcugucagcuucgugacgcugauuacccgcaauauguccuuuaaggaccuugggagaguuauggugauggucggagcgacaaugaccgaugacaugcggaugggcgugacauaucuggcccuccugcccgcuuucaaaguucgcccuaccuuugccacggggcugcuucugagaaagcucacaucuaaagaacugaugaugaccacaaucggaaucguccucuucagccaguccucuauucccgagaccauccuggaacuuaccgacgcccuggcucucggcaugaugguccugaagauggugcggaacauggagaaauaccaacuggccgugacaauuauggcgauccuuugcgucccuaaugcuguuauucugcagaacgccuggcgcgugagcuguacgauccucgccguggucuccgugagcccccuguuucucaccucuuccagacagaaggcugauuggaucccgcuggcccuuacaauuaagggccugaauccuaccgcgaucuuccucacaacccugagccggacgucuaaaaagcgcuccuggccccugaacgaagcuauuauggccguugggauggugagcauccuugccucuucccugcucaaaaaugacauuccuaugacaggaccccuggucgcuggcgggcuccugaccgugugcuauguucuuaccggaagaagcgccgaucuggagcuggagcgggcugccgacgugaagugggaugaccaggcggaaaucuccggcagcucuccgauccucagcauuacaaucuccgaggaugggucuaugagcauuaaaaacgaagaggaagaacagacccugacaauccuuauucgcacgggacugcucgucaucuccggccuguuuccugugucuauucccaucaccgccgcugccugguaccucugggaggucaagaagcagagagcuggcgugcugugggacguuccuuccccgcccccuguggggaaagccgaacuugaggauggagccuaucggauccagcagaagggcauuuucggguacucccaaaucggagcuggcgucuacaaagaagggacauucccgaccauguggcaugugacaagaggagcgguucugaugcacaagggcaaacgcauugagcccucuugggccgacgugaagaaggaucugaucagcuauggcgggggauggaaacucgagggcgaauggaaggagggggaagagguccaggugcuggcucuugaaccuggcaagaauccccgggccgugcagaccaagccuggccuguuuaaaacgaacaccgggacaauuggagccguuucccucgacuucagccccggcaccucuggcuccccuaucgucgauaagaaggggaaaguggugggacuguacggcaauggggucgugacaagaagcggagcuuauguuucugccaucgcgcagaccgagaaguccauugaggacuacccggaaguggagauggacaucuuucgcaaaaagcggcucacaauuauggauuuccaccccggcgcugggagacaaaaacgcuauuuuccugccaucguccgggaagccauuaagagaggacugcgcacgcuuauccuggcucccacccgggugguugccgcggagauggaagaggcucugagaggccucccuauccgguaccagacacccgccauucgcgccgagcauaccggcagagaaaucguggaccugaugugucacgcuaccuucacaaugcggcuucugagcccgauucgcgucccuaacuauaaucucaucauuauggaugaggcccauuuuacggaccccgcuuccaucgccgcgagaggguacauuucuacccggguggaaaugggagaggccgcuggcaucuucaugacagccacacccccugggagcagagaucccuuuccucaguccaacgcuccgaucauggacgaagaacgcgagauucccgaacggagcuggaacucuggacacgaguggguuacagauuucaagggcaaaaucgugugguuugucccuucccugaagaccgggaaauacauugccgccugccucagaaagaacggcaaacgcgugauccaacugagccggaagacguucgacucugaauaugugaaaacaagaaccaacgauugggacuucgucguuaccacagauauuagcgagaugggagcuaauuuuaaggcggagcgcgugaucgacccccggagauguaugaagccugugauccuuaccgacggcgaagaacgcgucauucuggccgggcccaugccggugacacauuccucugcugcccagagacggggacgcaucggcagaaacccuaaaaaugaaaacgaucaguacauuuauaugggggagccccuggaaaaugacgaggauugcgcccacuggaaggaggcuaaaaugcuccuggacaacaucaauaccccugaaggaauuauccccagcauguucgagccugaacgggagaagguugaugccaucgacggcgaauaccgccuuagaggggaggcgcggaaaacgcugcucgagcugauuagaggcggacccaucccgguguaucugggcuacaaguggccuggggaaggaauuaacuaugcugauucccgccucuguuuugacggcaucaagaauaaccagauucuugaggaaaaugucgagguggaaaucuggacaaaagagggggagcggaaggaacugaaacccagauggcuggaugcccgcauuuacucugacccccucgcccugaaggaguucaaagaauuugcugccggaagaaagagccuuacccugaaccucaucacagagaugggcagacugccuaccuucaugacgcaaaaggcgagaggggcccuggcuucccucaugguucuucacaccgccgaggcuggcggacgcgccuacaaucaugcucugagcgaacugccggagacacucgaaacccugcuucugcucacacugcuggccaccgugacaggcgggaucuuucucuuccuuaugucuggaagaggcauugggaaaaugacccugggaaugugcugcaucauuacggcguccauccugcucugguaugcccagauucagccccacuggaucgcugccagcaucauucuggaguuuuuccuuacaguccugcucaucccugaacccgagaagcagcggaccccucaagauaaccagcugaccuacgugauuaucgcuauucugacagucguggccgccaccauggcuaaugagaugggcuuucucgagaagaccaagaaagaccuuggccuggggaacaucgcgacgcagcaguccuguaagaagauccuggauauuuaucucggacccgcccugccuuggaaacuuuacgcuggcgggaccacauucaucaccccgaugcugcgccauucuauugagaacagcuccguuaaugugucucucacagccaucgccaaccaagcuaccgugcugaugggacugggcaagggguggccccucagcaaaauggacauuggagucccucuucuggccaucggcugcuauucccagguuaaucccauuacgcugaccgcggcccucuuucugcuuguggcucacuacgccaucaucggcccugggcugcaggcuaagcccacaagagaagcccagaaacgggcggccgcuggaauuaugaagaacccgaccguggacggcaucacagucauugaucucgacccuauccccuaugaucccaaauucgagaagcaacugggacaggugaugcugcucguucuuugugugacccagguccugaugaugcgcacgacaugggcccugugcgaagcucucacccuggccacagggccugugagcacccuuugggagggcaaucccgggagauucuggaacaccacaauugcugucucuauggccaauaucuuucggggauccuaccuggcgggcgccggccuccuguucagcaucaugaagaacacgaccucuacacgcagagggaccggaaauauuggcgagacacugggggaaaaauggaagucccggcucaacgcucuuggaaaaagcgaguuucaaaucuacaagaaaucuggcauucaggaaguggacagaacccuggccaaggaggggaucaagcgcggagaaacggaucaccaugcuguuagccggggcuccgccaaacugagaugguucgacgagcgcaaucucgugacaccugagggcaaggucguggaucugggguguggacggggcggguggagcuuuuucugcggaggccuuaaaaacguuagagaagugaaggcccugaccauugggggaccgggccacgaggaacccauccucaugagcaccuauggccgcaaucugguccggucccagagcgggguggugguuuuucauacaccucccgagaaaugugacaccucccugagagauaucggagagucuagcccuaaccccacagucgaagcgggccgcacgcuccgggugcuuaaucugguggagaacuggcugaauaacaacacccaguucugcauuaagguccucaauccguacaugccuuccguuaucgaaaagauggaggcucugcaaagaaaauaugggggagcccuugugcgcaacccccugucucggaauagcacacacgaaauguacuggguguccaacgcuucuggcaauauugucagcuccgugaacaugaucagcagaaugcucauuaaucgcuuuaccaugagacauaagaaagccacauaugagccugacguugaucuggggucuggaacccggaacaucggcaucgaguccgaaacgcccaaucuggacauuaucggcaagcgcauugagaaaaucaagcaggaacacgagaccagcuggcacuacgaucaggaccauccuuauaagacaugggggucucacggauccuacgaaaccaaacagacaggcagcgccucuuccauggugaacggggucgugagacuccuuaccaagcccugggacguugugccgauggucacacaaauggcuaugaccgauacgacaccuuucggacagcagcggguguuuaaagagaagguggacaccagaacccaggagcccaaagaaggcacaaagaaacugaugaagauuacggccgaguggcuguggaaggaacucgggaaaaagaaaacaccccggauguguacacgcgaggaguucaucaagaaagucagaagcaaugcggcccugggagcuauuuuuaccgaugagaacaaguggaaguccgcccgggaggcuguugaagacggccgcuucugggagcuuguggauaaagaaagaaaucugcaucucgagggcaagugcgagacauguguguacaacaugauggggaaacgggaaaagaaacugggagaguucggcaaggccaaggggagccgcgcgaucugguauauguggcugggagccagauuucucgaguucgaggcucugggcuuucuuaaugaagaccacugguucucucgggagaacagccuguccggggucgagggcgaaggacuccacaaacugggcuacauccuucgcgaggugucuaagaaagaagggggagccauguaugcugaugacaccgccggcugggauacaagaauuacccuggaggaccucaagaacgaggaacggaaaacgaaucauaugggaggggagcaccgcaagcuggcuagaggcaucuuuaagaugaaccugaccaauaaaguugugcggguccaacgcccuacacccgggggaacccucauggauauuaucagcagaaagacacagcggggauccgaacaggugggcaccuacgggcugacgacacuuaccaaccuggaggcgcccccuauuagacaaauggaaggaaaaggcguuuucaaggggcaucagcaccgcacagcgucugaggaaaaugccgugcaggacuggcucgcucgggucggaggcgagagacugagccgccuugccaucuccggggacgauugcgugguuaaaccccuggacgaucgguuugcuagagcccucaccgcccugaacgacaugggcaaggugcgcaaggauauccagcaaugggagccuucucggggauggaaugacuggacgcagguccccuucugcagccaucacuuucacgaacugauuaugaaagauggcagaacccucguggucccuugucgcaaccaggacgagcugaucgggcgggcgagaauuucccagggagcuggcuggagccuucgcgaaacagccugccuggggaaguucuaugcccaacgguggucucucauguacuuucauagacgggaucugagacuugcucccaaugccaucuguuccgcugugcgcacccacuggguuccgacaagccggaaaaccuggccuauucaugccucucacgacuggaugacaaccgaggugaugcugacggucuggaacaagcucugguuccaggagaaucccuggauggaagauaaaacaccugugggauuuugggaggaaauccccuuccuggagaagggcaaagaccaguggggaggcucccugaucggacucaccagcagaccgccuugggcgaagaacuuccagcccgccauuaaucaagugcgcucccugcuuugcaacgaagagucugcugauuuuaugcccagcaugaagagauuccggcgcgaggaagaggaagccggcguucugugguga

SEQ ID NO: 19675 - RNA, 9876 nt, Artificial Sequence
  derived and/or modified CDS sequence (opt5) from DENV-2__JQ922549__SS-prME
accgccggcgugaucauuaugcugauccccacagcuauggccuuccaccucacgaccagaaacggggagccucauaugauugucagccggcaggaaaagggaaaaucccugcuuuuuaagacagaggacggcguuaauaugugcacccugauggcgauggaucucggggaacugugugaggacacaaucaccuacaacugcccgcuucugcgccaaaaugaacccgaggauauugacuguuggugcaacucuacaagcaccugggugacguauggaaccuguacagcuccuggcgaucacagacgggagaaacgcuccguggcccucgucccccauguggggaugggacuggaaaccagaacagagaccuggaugucuagcgaaggcgccuggaagcacgcucagcggaucgagacguggauccugcgccauccuggcuucacaauuauggccgcuauccucgccuacaccauugggacaaccuauuuucagagaguucugauccuuauucugcucaccgcgguggcccccuccaugacaaugcggugcaucggaauuucuaaucgcgacuucgucgagggcgugagcgggggauccuggguugauaucgugcuggaacacggcagcugugucacgaccauggcuaaaaacaagccuacacuugacuuugagcugaucaagaccgaagccaaacagccggcuacacucaccaaguacugcauugaggccaaacugacgaauacaaccaccgcgucuagaugucccacacaaggggaaccuucccugaacgaggagcagcacaagcgguucgugugcaaacauagcaugguggaucgcggauggggcaauggcugugggcucuuuggaaagggcgggaucgucaccugcgccauguucacaugcaagaaaaacaugaagggaaaaauuguucagcccgaaaaucuggaguauacgaucguggugaccccucacucuggcgaagagaacgcugucgggaaugacacaggaaagcauggcaaagaaauuaaggugagaccccaguccagcaucaccgaggccgagcuuacaggcuacgggaccguuacgauggaauguucuccgcggaccggauuugcuuucaacgagauggugcugcuccaaauggaaaauaaagccuggcugguccaccgccagugguuucuugaucugccucuccccuggcugccuggcgccgacacacagggguccaacuggauccagaaggagacccuggugacauucaagaacccccacgcuaaaaagcaagauguugugguccucggaagccaggaaggcgcgaugcauaccgcccugacgggggcuacagagauucagauguccucuggcaaucuucuguuuaccggacaccucaaaugcagacugcggauggacaagcuucaacugaaaggcaugagcuauuccauguguacagggaaguucaagguggucaaagagaucgccgaaacccagcauggaaccauugugaucagaguucaguacgagggcgacgggagccccugcaagauuccuuucgaaaucauggaucucgagaaacgccuggugcugggacggcucaucacagucaacccgauugugacggagaaggacucucccguuaauaucgaagccgagccucccuuuggcgauuccuacauuaucauugggguggaaccuggccagcugaaacccagcugguucaagaagggaucuagcaucagacaaauguuugagaccacaaugcgcggcgcuaaacggauggccauucuuggggacaccgcgugggauuucggaucccugggcggggucuuuacaucuaucggaaaggcucuccaccagguguucggcgccaucuauggggccgcuuuuagcggcguguccuggaccaugaaaauucugaucggaguugucauuacguggaucggcacaaacagcagaucuaccucccugagcgugucucuugugcucgucggggugguuacccuguaccugggagugaugguccaggccgacuccggcugugugguuagcuggaagaauaaagaacucaagugcggguccggaauuuucaucacagauaacgugcauaccuggacagagcaguauaaguuucaaccggagucuccuagcaaacuggcuuccgccauccagaaggcgcacgaagagggcauuugugggauccgcucugucacgcggcuugaaaaucugauguggaaacagauuacccccgagcucaaccacauccugagcgaaaaugaggugaagcugacaauuaugaccggcgacaucaaaggaaucaugcaggccggcaagagaucccuucgcccucaacccacagagcucaaauacagcuggaagaccugggggaaggcuaaaaugcugucuacggaaccucauaaccagaccuuccugauuggaggccccgagacagccgaaugcccgaauaccaaccgggcuuggaauucccucgagguugaagauuauggguuuggaguguucacaaccaacaucuggcugaagcuuaaagagagacaggacgucuuuugugauagcaagcugaugucugccgcgauuaaagacaaucgcgccgugcacgcugacaugggcuacuggaucgaguccgcccucaacgauacauggaagauugaaaaggcuagcuucaucgaggugaaaucuugccauuggccuaagagccacacccugugguccaacggcguccuggaaagcgagaugaucauucccaaaaauuucgccgggcccguuucucagcacaacuaucggccuggauaccauacgcaaacagccggcccguggcaccuugggaagcucgagauggacuuucauuucugugaaggaaccaccgugguggucacagaggauugcggcaauagagggcccucccugcggaccacgacagcuagcggaaaacugaucaccgaauggugcugucgcuccugcacacucccuccccugagauaccggggcgaggacggcuguugguaugggauggaaauuagaccucuugagggagaggaaggcgaucuggugcacucucucguuaccgcggggcauggacagaucgacaacuuuagccugggcgugcuggggauggcccuuuuccucgaggaaaugcugcgcacacgggucggaaccaagcacgcugugcugcucguugccguguccuuuaugacgcugauuaccggcaauaugucuuucagagaucuuggccgcgucauggugaugguuggggccgcuaugacagacgauaucggaaugggcgugaccuaccuggcccuccuggcggcuuuuaaggucagacccacauucgccgccgggcugcuucugcggaaacucaccagcaaggagcugaugaugacgacaauuggaaucgugcuccugucccagucuaccaucccugaaacaauucuugagcugaccgacgcucucgcccugggccgcaugauccugaaaauugugagaaacauggagaaguaucaacuugcggucaccaucauggcuauucugugcguucccaaugccgugauccuccagaacgccuggaaagugagcuguacaauccuggcugucguguccguuagcccgcuccugcuuacgucuucccagcagaaggccgauuggauuccucuggcucucaccaucaaggggcugaaucccacagccauuuuucugaccacacuuagccggaccaacaaaaagcgcucuuggccucugaaugaagcgaucauggccgugggaauggucuccauucucgcuagcucucugcucgagaacgacauccccaugacgggcccgcugguggccggcgggcuucugacaguuugcuacgugcugaccggaagauccgcugaucucgaacuggagcgggccgccgacguccgcugggaagaccaagcugagaucagcggcuccagcccuauucuuucuaucaccauuagcgaggauggguccaugucuaucaaauaugaagaggaagagcccacacugaccauucucaucagaacaggacugcucgugauuagcggccuguucccugucuccauccccaucacggcggccgcuugguaccuuugggaggugaagaaacagcgggccgggguucugugggacgugcccucuccuccgcccgucggaaaggccgaacuggaggauggcgcuuaucgcauuaaacagaagggcauccucgggagcucccagauuggagccagaguguacaaggaaggcaccuuucacacaauguggcauguuacccggggggcggugcugaugcacaaaggaaagagaaucgagccuucuugggcugacguccgcaaagaucuuauuagcuacggcgggggauggaagcuggaaggcgaguggaaagagggcgaagaggugcaagugcucgcccuggaacccgggaagaauccucgggccguucagacaaagcccggacucuucaaaaccaacacgggcaccaucgggacagucucccuggacuuuagcccuggaaccucugaguccccgaucguggauaagaaaggcaagguggucgggcuuuauggaaauggcgugguuacaagaagcggcaccuacgugucugcuauugcccagacagaaaaauccaucgaggacaaccccgagauugaagaugacaucuuccgcaagaagcggcugacgauuauggaucugcauccuggggcgggaaaaaccaagagauaucuccccgcuaucguccgcgaggccaucaaacggggccugagaacacuuauucuggccccuacccgcgugguugcugccgaaauggaggaagcucuccgggggcugcccaucagauaccagaccccggccauucgggcggagcacacaggacgcgagaucguggaccucaugugucaugccacguucaccaugagacugcuuagcccuguccgggugcccaacuauaaucugauuaucauggaugaagcucacuuuacagaccccgccuccauugcugcccgcggcuacaucucuaccagaguugagaugggggaagccgcuggcaucuucaugacagcgaccccucccggaagccgggacccuuuuccgcaauccaacgcccccauuauggaugaggagagagaaaucccugagcgcagcuggaauucuggccacgaaugggugacggacuucaaggggaaaacagucugguuugugcccuccauuaaggcuggaaacgauaucgccgccugccugcggaagaauggcaaaaaggugauucagcucagcagaaaaaccuucgacucugaguauaucaagacccgcacaaacgauugggacuuugucguuaccacagauaucagcgaaaugggggcuaauuucaaagccgagcgggugauugacccuagacgcuguaugaagcccgugauccugaccgauggagaggaacgggucauucuugcgggcccgaugccugugacgcauuccucugcugcccagagacgcgggagaaucggccggaaccccaagaaugagaacgaccaauacauuuacaugggagaaccucuggagaaugaugaagacugcgcccacuggaaagaggcuaagaugcuccuggacaacaucaauacacccgagggcaucauuccuagcauguuugaacccgagcgcgaaaaaguugaugccaucgacggggaguauagacugcggggagaagcgcgcaagaccuucguggaucucaugagacggggcgaccuuccggucuggcuggccuacagaguggcugccgaggggauuaacuaugcugaucgccggugguguuuugacggaaucaaaaauaaccagauucuggaggaaaacguugagguggaaaucuggacaaaggagggcgagagaaaaaagcucaagccucgcuggcuggaugcccggauuuacuccgacccccuugcucugaaagaauucaaggaguucgccgcggggagaaaaucucucacccugaaucugaucacggaaaugggccggcuccccaccuuuaugacacagaaggcccgcaacgcucuugauaaucuggccguccugcauaccgcugaggccggaggcagagccuauaaccacgcucucagcgaacugccugagacacuugagacccugcuccugcugacacuccuugcgaccgugacggggggaaucuuccuguuucugauguccggcaaagggauuggaaagaugacacucggcaugugcugcaucauuaccgccagcauccugcuuugguacgcucagauucaaccgcacuggaucgccgccucuaucauucuggaauucuuucucaucguccugcugauucccgagccugaaaagcagcggaccccccaggacaaucagcucacauaugugguuaucgcuauucuuaccgugguggccgcgacaauggccaacgagaugggcuuccuggaaaaaacgaagaaagauuuugggcugggauccaucgcuacccaacagccugagagcaauauccucgacauugaucugcgccccgccuccgcuuggacacuuuacgccgucgcgaccacauucaucaccccuaugcugagacauucuauugagaacagcccgguuaaugugucccucacggccaucgcuaaccaggccaccgugcugaugggccuggggaagggauggccccucucuaaaauggacauuggcgucccuccccuugcuaucggguguuacagccaggugaauccuauuacacugaccgccgcucugcuccugcuuguugcccacuaugcgaucaucggacccggccugcaagugaaggccacacgggaagcucagaagcgcgccgcugccggcauuaugaaaaacccgaccgucgacgggaucacggugauugaucucgacccuauccccuacgaucccaaguuugagaaacagcugggacagauuaugcugagaguccucugcgugacacaaguucuuaugaugcggaccacaugggcccugugugaagcgcugacccucgcuaccggcccuaucuccacacugugggaggggaaucccggacgccuuggcaacacgaccaucgccgugagcauggcuaauauuuucagagggucuuaucuggccggagccggccuccuguuuuccaucaugaagaacacaaccaauacacggagaggcaccagcaaccugggggaaacgcucggagagaaauggaagaaccgccuuaauucucugggcaaguccgaguuccagauuuacaaaaagagcgggauccaggaagucgaccggacacuggcuaaagagggaauuaagaaaggcgaaaccgaucaucacgccgugucuagagggagcgcgaagcuccgcugguuuguugagcggaaccuggugaccccugagggaaaagucguggaccuuggcugcggcagagggggaugguccuauuacuguggcgggcugaagaaugugcgcgaaguuaagggacucacaaaaggcgggccgggacaugaggaacccaucccuaugucuaccuauggcuggaaccugguccggcugcaaagcggcgaggauguguucuucacacccccugaaaagugcgacacgcuccuuugugauaucggggaguccagccccaauccgaccguggaggccggaagaacacugcgcguccugaacaugguugaaaauuggcucaacaauaacacccaguuuugcauuaaagugcugaauccuuacaugcccuccgugaucgagaagauggaagcucuucagcggaaauacggcggggcccuggucagaaacccucucucucgcaauagcacacacgagauguauuggguguccaacgcuucuggaaauauuguuagcuccgugaacaugaucucucggaugcugauuaacagauucaccaugcgccacaagaaggccacguacgaacccgacgucgaucugggcagcgggaccagaaauaucggaaucgaguccgagacaccuaaccucgacauuaucggcaaacggauugaaaagaucaaacaggagcaugaaaccagcuggcacuaugaucaagaccaucccuacaagacaugggcguaucacggcucuuacgagaccaaacagacaggguccgccagcucucuugugaauggaguugugcgccugcugaccaagccgugggacgucauuccuauggugacgcagauggcuaugacagauaccacccccuuuggccagcaaagaguguucaaggaaaaagucgacacacggacgcaggagcccaaggaggggaccaaaaagcucaugaaaaucacagccgaauggcuguggaaggagcuuggaaagaaaaagaccccuagaauguguacacgggaagaguuuucccgcaaaguuagaagcaacgcugcccugggcgcuauuuucaccgaugagaauaaguggaaaucugcccgggaagcgguggaggacgggcgcuuuugggaacucguggauaaggagagaauccugcaccuggaaggaaaaugcgagacaugugucuauaacaugaugggcaagcgggagaagaaaaucggcgaauucgggaaggccaaaggaucccgcgcuauuugguacauguggcucggcgccagauuucuggaguucgaagcucuuggguuucugaaugaggaccauugguucagccgggaaaacucccucagcggaguggagggcgaggggcugcacaagcuuggcuacauccugcgcgaaguuucuaaaaaggagggaggcgccauguaugccgaugacaccgcggggugggauacgagaauuacccucgaagaccugaagaaugaggaaauggugacaaaccauauggagggagagcacaaaaagcuggcugaagccaucuuuaaacucaccuaccagaauaaggucgugcggguucagcgcccgacacccagaggcaccgugauggauauuaucagccggcgcgaccaaagaggguccggacaggucggcacguaugggcugaacacauucaccaauaugggcgcccagcuuauccggcaaauggagggagaaggcguguucaaagggauucagcaucugacagcuaccgaggagaucgccguucaggacuggcucgcuagagugggacgcgaacggcugucuagaauggccauuagcggcgaugacugcgucgugaagccucuugaugaccgcuuugcguccgcccugacggcucucaacgauauggggaagguccggaaagacauccagcaaugggagcccucuagaggauggaaugauuggacccaggugccuuucugcagccaccacuuucaugaacugauuaugaaggacggccgcguucuggugguccccugucggaaccaggaugagcucaucgggagagcccgcaucucccagggcgcuggauggucucugcgggaaacagccugccuuggcaaaagcuacgcgcaaauguggucccugauguauuuccacagacgcgaccuccggcuggccgcuaacgccauuuguagcgcugugccuucucauugggugcccaccuccagaacaacccggagcauccacgccagacaggaguggaugacaaccgagguuaugcuuacgguguggaaucgcgucuggauucaggaaaacccguggauggaggauaagacaccuguggaaucuugggaggaaauccccuaccuggggaaacgggaggaccaguggugcggaucccucauuggccugaccagcagagcuaccugggccaagaauauccaaacagcgauuaaccagguucgcucccugaucgggucugaggaauauaccgauuacaugccuagcaugaagagauuucggcgcgaggaagaggaagccggagugcucugguga

SEQ ID NO: 19676 - RNA, 9876 nt, Artificial Sequence
  derived and/or modified CDS sequence (opt5) from DENV-2__JQ922552__SS-prME
accgccggcaugaucauuaugcugauccccacagugauggcuuuccaccucacgaccagaaacggggagccuccgaugauugucagccggcaggaaaagggaaaaucccugcuuuuuaagacagaggacggcguuaauaugugcgcccugauggcgauggaucucggggaacgcugugaggacaccaucacauacaacugcccccugcuuaaucaaaacgaaccugaggauauugacuguuggugcaauucuaccagcacaugggugaccuauggaacguguaccacaaccggcgagcugagacgggaaaaaaucuccguggcucucgucccccauguggggaugggacuggagacacgcaccgaaacguggaugucuagcgagggcgccuggaagcacgcccagagaaucgagauuuggauccugcggcauccuggcuucacaauuauggcugccauccucgcuuacaccauugggacaucccacuuucagcgcguucugaucuucauucuucugaccgccaucgcgcccucuaugaccaugagaugcaucggaauuagcaaccgggauuuuguggaaggcgucuccgggggaagcuggguggacaucguucucgagcauggcucuugugugacaacgauggccaaaaauaagccuacccuggauuucgaacuuauuaagacagaggcuaaacagccggccacccugcgcaaguauugcaucgaagcuaaacucacaaacaccacgacagacuccagaugucccacccaaggggagccuacccugaaugaggaacaggauaagcgguuugucugcaaacacagcaugguggaccgcggauggggcaacggcugugggcuguucggaaagggcgggauugugacaugcgccauguuuaccugcaagaaaaucaugaagggaaaaaucguccagcccgagaaucucgaauacacaguugugauuacgccucacucuggcgaggaacaugcgguggggaacgauaccggaaagcacggcaaagaggucaagaucacaccccaguccagcauuaccgaggccgaacugacaggcuaugggaccgugacgauggaguguucuccgagaaccggacuugacuucaaugaaaugguucugcuccaaauggaggauaaagcuuggcuggugcaucggcagugguuucuugaccugccucuccccuggcugccuggcgccgacacacagggguccaacuggauccagaaggaaacccuggucacauucaagaauccccacgcuaaaaagcaagaugugguugugcucggaagccaggagggcgccaugcacaccgcccugacgggggcuacagagauucagauguccucuggcaaccuucuguuuaccggacaucucaaaugccgccugagaauggacaagcuucaacugaaaggcaugagcuacuccauguguacagggaaguucaaggucgugaaagaaaucgcggagacccagcacggaaccaucgucauucgggugcaguaugaaggcgaugggagccccugcaagaucccuuucgagauuauggaccucgagaaaagacauguucugggacgccugaucacagugaacccgauugucacggaaaaggauucucccgugaauaucgaggccgaaccucccuuuggcgacuccuacauuaucaucgggguugagccuggccagcucaaacugaacugguucaagaagggaagcucuauuggccaaaugcuugaaaccacaaugcggggggcuaaaagaauggccauccugggagauaccgccugggacuuuggcagccucgggggaguguucacauccauuggcaaggcucugcaccaggucuuuggggccaucuacggcgcggcuuucucuggagugagcuggaccaugaaaauucugacgggcgugaucaucacauggauugggaugaauucccgcagcaccucucuuuccguuagccucguccuggugggaaucgugacccuguaucucggcgucauggugcaggccgauucuggguguguuguguccuggaagaacaaagagcugaagugcggaagcggcauuuuugucacagacaaugugcauaccuggacagagcaguacauguuccaacccgaauccccgucuaagcuugccagcgcuauccagaaagcccacgaggaagggauuuguggcauccgguccguuacgagacuggagaaccucauguggaagcagaucaccccugaacugaaucacauucugucugagaacgaggugaaacuuacaaucaugaccggagauauuaagggcaucaugcaggucgggaaacgcagccuccggccccaaccuacagaacugagauauuccuggaagaccuggggacagcccaaaaugcugagcccugagcuccaucaccagacguuucugauugacggccccgaaaccgcugagugcccgaauacaaaccgcaccugggacucucuugaaguggaggauuacggguucggaguuuuuacaaccaagaucuggcugcggcucagagagaagcaggacguguucugugauuccaaacugaugagcgccgcgaucaaggacaaucgcgccguccaugcugauaugggcuauuggauugaaucugcccugaacgacacauggaaaaucgagaaggcuuccuuuauugaagugaaaagcugccacuggccuaagucucacacccuuuggagcaugggcgugcucgaguccgagauggucauccccaagaauuucgccgggcccguuagccaacauaaccaccggccuggaauuccgacgcagacagcgggccccuggcaucuggggaaacuggaaauggauuucgacuuuugugagggaaccaccgugguggucacagaagauugcggcaauagagggccuucucuccggaccuccacggccagcggaaagcugaucacagaguggugcugucgcuccugcacccuucccccucugagauaccggggcgaagacggcuguugguaugggauggagauuagaccccucaaagagaaggaagagaaccuggugucuagccugguuacagcuggacacggccagaucgauaacuucucccuugggauccucggaauggcccuguuucuggaagagaugcuccgcacccgggugggcacaaaacaugcuauucugcuugucgccgugucuuucguuacccugaucacggggaauaugagcggaagagaccucggccgcgugauggucauggugggcgccaccaugacagaugacauugggaugggaguuaccuaccuggcucugcuugcggccuuuaaggugagaccuacauucgcugccggccugcuccugcggaagcucaccuccaaagaacugaugaugacgacaaucgggauuguccuucugucucaaagcuccauccccgagaccauccucgagcugacagacgcccuggcucuuggaaugauggugcugaagauggugcgcaacauggaaaaauaccagcucgccgucaccauuauggcgauccugugcguuccgaaugcugugauucuccagaacgccuggaaggugagcuguaccauccuggcccuugucucuguguccccucuguuucucacaagcucucagcaaaaagcugauuggauuccccuggcccugacgaucaagggccuuaauccuaccgcgaucuuccugacaacccucuccagaacaagcaagaaacggucuuggccccugaacgaggcuauuauggccguugggaugguguccauccucgccagcucccugcuuaagaaugacauuccgaugaccggaccucuggucgcuggcggccugcucacggugugcuauguucugacagggcgcagcgccgaucuugaacuggagagagcugccgacgugaaaugggaugaccaggcggaaaucucuggaagcucccccauucucucuaucaccauuagcgaggauggcuccaugucuaucaagaacgaggaagaggaacagacccugacaauccucauucggaccgagcugcuugucaucagcgggcuguuuccuauuuccauccccauuacagccgcugccugguaccugugggaggugaaaaagcagcgcgcuggaguccucugggacgugcccucuccuccgcccguuggcaaagccgaacuggaggauggggccuauagaaucaagcaaaagggaauccuuggcuacagccagauuggcgcugggguguauaaagaaggaacguuccacaccauguggcacgucacacggggcgcggugcugaugcauaaggggaaacgcaucgagccuuccugggccgacguuaagaaagaucucauuagcuacggaggcggguggaagcuggaaggagaguggaaggagggcgaagaggugcagguccucgcucuggaacccggcaaaaauccuagagccgugcagaccaagcccgggcuuuuuaaaacaaacaccggaacgaucggcgccgugucucuggacuucuccccugggaccagcggaucuccgauuguugauaagaaaggcaaggucguggggcuguauggaaauggcguggucacacgguccggcgcuuacgugagcgccaucgcgcaaaccgagaaguccaucgaagacaaccccgagauugaggacgauaucuuuagacgcaaaaagcucacaauuauggaccugcacccuggggcuggaaaaaccaagcgguaccuucccgccaucguuagagaagccauuaaacgcggccugcggacacucauccuggcuccuacgagaguggucgccgcggagauggaagaggcucuccgcgggcugcccauucgguaucagaccccggccaucagagccgaacauacaggacgcgagaucguggaucuuaugugucacgcuaccuucaccaugcggcugcugucuccuauuagaguucccaauuacaaccucaucauuauggacgaggcccauuucacagaucccgcuagcaucgccgcgcggggcuauauuuccacgcgcguggaaaugggggaggccgcuggcaucuuuaugaccgccacaccucccggaagcagagacccuuucccgcagucuaaugcucccaucauggaugaagagcgggagauuccugaacgcuccuggaacagcggccacgagugggucaccgacuuuaaggggaagacagugugguucguucccucuaucaaaaccggaaacgauauugccgccugccugagaaagaauggcaaacgggugauccaacuuagcagaaagacguuugacuccgaauacgucaaaacacgcaccaacgauugggacuucguggugaccacagacauuucugagaugggggcuaauuuuaaggcggaacgggucaucgauccuagacgcuguaugaagcccguuauccugaccgacggagaggagcgggugauucucgccggcccgaugccugugacacacagcuccgcugcccagagacgcgggcggaucggcagaaaccccaaaaaugaaaacgaucaguauauuuacaugggagagccucuggaaaaugacgaggauugcgcccauuggaaggaagcuaaaaugcugcucgacaacaucaauacccccgagggcauuaucccuucuauguucgagcccgaacgcgagaaggucgaugccauugacggggaauauagacuucggggagaggcgcgcaaaacguuuguggaucugaugagacggggcgaccugccgguuuggcucgcuuaccgcgggccugccgaaggaaucaacuacgccgauagacggugguguuucgacggcaucaagaauagccaguuucuggaggagaacguggaagucgagauuuggcccuccgggggcgaaagaaaagagcuuaagccccgcuggcuggaugcucggaucuauagcgacccucucgcccugaaggaguucaaagaauucgcggccggaagaaagucucugacacucaaucuuauuaccgagaugggccgccugccgacauuuaugacccaaaaagcucggaacgcccuggacaaucucgcugugcugcacacggccgaagcugggggaagagccuacaaccaugcgcuuuccgagcugcccgaaacccucgagacacugcugcuccuuacccugcuggccacaguuaccggcgggaucuuccucuuucugaugagcggacggggcauuggcaagaugacacuugggaugugcugcaucaucaccgcuuccauucugcucugguaugcccagauccagccucacuggauugcugccucuaucauucuggaguucuuucugaucgugcuccuuauccccgaaccugagaaacagcgcacgccccaagauaaccagcugacauacgucauuaucgccauucugaccguggucgcugcgaccauggccaaugaaaugggauuccucgagaagacaaagaaagaccugggccuugggaacaucgugacccagcagccugaaagcaauauucuggauaucgaccucagaccggcuuccgccuggacacuguaugccgcugccacgaccuuuauuacacccaugcugcggcacucuaucgagaacagcuccguuaauaugagccucaccgcgaucgccaaccaagcuacagugcuuaugggacugggcaagggguggccucugucuaaaauggauauuggagugccccuccuggccaucggcuguuacucccaggucaauccuauuacccuuacggcugcccuguuccuccugguugcgcauuaugccaucaagggccccgggcugcaggcuaaagccacccgcgaggcucagaagagagccgcugccggaauuaugaagaacccgacaguggacggcaucaccgugaucgaucucgacccuauucccuacgaucccaaauuugaaaagcaacuugggcaggucaugcugcuggugcucugcguuacacaggugcugaugaugcggaccacgugggcgcuuugugaggcccugacacucgcuaccggaccugucagcacacugugggaaggcaaucccgggcgcuucuggaacaccaccaucgccgugucuauggcuaauauuuuuagaggauccuaccuggccggcagcucucaagucuggccuagcaucaacaaucucaaaggcgggcggcgcggaacaggcgcccagggggagacgcuuggagaaaaguggaaaagacagcugaaccagcuguccaagucugaguucaauaccuauaagcggagcggcauuauggagguggacagauccgaagcgaaagaggggcucaagcgcggagaaacaaccaaacacgcuguuagccggggcacagccaagcugagaugguuuguggagcgcaaccuugucaaaccggagggcaaggugaucgaucuggggugcggacggggcgggugguccuacuauugugcuggacucaaaaagguuaccgaagugaagggcuacacgaaagggggacccggccaugaggaaccuauccccauggccacauauggcuggaaucuggucaagcugcacucugggaaagacguguucuucaccccucccgagaagugcgauacccuccuuugugacauuggagaaagcuccccgaacccuacaguggaggccggcagaacccugcgcguucugaaccucgucgagaauuggcugaacaauaacacacaauuuugcaucaaagugcuuaaucccuacaugccuucugugauugaaaagauggagacgcugcagcggaaguaugggggagcucucgucagaaacccccugagccgcaauuccacccaugaaauguacuggguuucuaacgccagcggcaauaucguguccagcgugaacaugauuucucggaugcugaucaauagauucacaaugcgccacaaaaaggcgaccuacgagccugacgucgaucucggguccggaacacggaacaucggcauugaaagcgagacccccaaucuugacaucauuggcaaaagaaucgagaagauuaaacaggaacacgagacgucuuggcauuaugaucaggaccacccguacaagaccugggccuaucauggguccuacgaaacaaagcaaaccggaagcgcuucuuccauggugaacggcguugugcgccugcugacaaaaccuugggaugucgugcccaugguuacccagauggccaugacagacaccacgcccuuugggcagcagagaguguucaaggagaaagucgauacacggacccaagaaccuaaggagggaaccaaaaagcucaugaagaucacagcugaguggcuguggaaagaacuuggcaagaaaaagacgccgcgcaugugucccagagaggaauuuaccaaaaaggugcggagcaaugccgcgcugggggccauuuucacagacgcuaccaaauggaaguccgccagagaggcuguggaggauggacgguuuugggaacucgucgacaaggagcgcaaccugcaccuggaaggcaaaugcgagacauguguuuauaacaugaugggcaagagagaaaaaaagcucggggaguucggaaaagccaagggcagccgggcuaucugguacauguggcugggggcccgcuuucuugaguucgaagcgcugggauuucucaaugaggaucacugguucucuagagaaaacagccuguccggcguggagggggaaggccuucauaagcugggauauauccuccgggaggugcgcaaaaaggagggcggggccauguacgcugacgacucugccggaugggauaccagaauuacacuggaagaccugaaaaaugaggaacggaucaccaaccacauggaggucgaacauaagaaacucgcugugggccacuuuauucugacguacccuaauaagguugugcgcguccagagacccaccccuguggggacaguuauggauaucauuagccggaagucccagcgcggaucuggccaaguggggaccuauggccuuaacacauucaccaaucuggagggacccagaauccggcagauggagggcgaagagagcuucaaaucccaucagcuccagacggccacagaacgcaacgccguccaagacuggcuggcgagaguggggcgggagagacuuucucgcauggcuaucagcggagaugacugcguugugaagccucuggaugaccgguuugccagagcccucaccgcucugaaugauaugggcaaaguccgcaaggacauucagcagugggagcccucccggggguggaacgauuggacacaggugccguucugcagccaccacuuucaugaacugaucaugaaagacggaagaacccucgucgugccuugucgcaaucaagaugagcugauuggccgggccagaaucucucagggggcuggcuggucccuucgcgaaacggccugccugggaaagagcuacgcgcagauguggucucucauguauuuccaccggagagaccugcgccuugccgcuaacgccauuuguuccgcuguucccagccauugggugccuaccucccggacaaccuggucuauccacgccagccacgagugggucgcgacagaagacaugcugaccguguggaauagaguguggauccaggagaaccccuggauggaggauaagacaccgguugaauccugggaggaaauuccuuaccucggcaaacgggaggaccaauggugcgggagccugaucggacugaccucuagagccacgugggcuaagaauauucagacagccaucaaccaggugcgcucccucauuggcaacgaagaguauaccgauuacaugcccagcaugaaacgguuuagacgcgaggaagaggaagcugggguccugugguga

SEQ ID NO: 19677 - RNA, 9876 nt, Artificial Sequence
  derived and/or modified CDS sequence (opt5) from DENV-2__GU131896__SS-prME
agcgccggaaugaucauuaugcugauccccaccgugauggcuuuccaccucacaacgagaaacggggagccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcagggauccaauuggauucagaaagagacccuggucacauucaagaacccucaugcuaaaaagcaagacgugguugugcucggcagccaggaaggggccaugcacaccgcccugacgggcgcuacagagauccagauguccucuggaaaucuucuguuuaccggccaucucaaaugccgccugagaauggacaaacuucaacugaaggggaugagcuacuccauguguacaggaaaauucaaggucgugaaagaaauugcggagacccagcacggcaccaucgucauucggcuccaguaugagggggauggaagccccugcaagauccccuucgaaaucauggaccuggagaaaagauacgugcugggccgccucauuacaguuaacccuaucgugacggaaaaggauucuccggucaacauugaggccgaacccccuuuuggggacuccuacaucauuaucggcguggagcccggacagcugaaacuuaauugguucaaaaagggcagcucuauugggcaaauguuugagaccacaaugcggggagcuaaaagaauggccauccugggcgauaccgccugggacuucgggagccucggaggcguuuuuacauccguggggaaggcucugcaucagaucuucggcgccauuuauggagcggcuuuuucuggcgucagcuggaccaugaaaauccugauuggggugaucauuacguggaucggaaugaacucccgcagcacaucucuuuccgugagccucguucuggucggcaucgugacccuguaccucggggugaugguccaggccgauucuggaugugugguuuccuggaagaauaaggaacugaaaugcggcagcgggauuuucaucaccgacaacgugcacacauggaccgagcaguauaaguuucaaccugaaucccccucuaaacuugccagcgcuauucagaaggcccaggaggaaggcaucuguggcauucgguccgucacaagacuggagaaucucauguggaaacagaucacgccggagcugaaccacauccuggcugaaaaugaggugaaacuuaccauuaugacaggcgauaucaaagggauuaugcaagccggaaagcgcucucuccggccucagcccaccgaacugaaguacagcuggaaaacauggggcaaggcgaaaaugcuguccaccgagagccauaaccagacguuccucaucgacgggccugaaaccgccgagugccccaauacaaacagagcuuggaacucucuggagguugaagauuauggauuuggcguguucaccacaaacauuuggcuuaagcugaaagagaagcaggacgccuuuugugacuccaagcucaugagcgcugccaucaaagauaaucgcgcgguccacgccgacaugggcuacuggaucgaaucugcucugaacgauaccuggaagauugagaaagccuccuucaucgaggugaagaauugccauuggccuaaaagccacacacuguggucuaacgggguucuugaaagcgagaugauuauccccaagaaccucgcuggaccggugucccaacacaauuaucggccuggcuaccauacccagacggccgggcccuggcaccugggaaagcuggaaauggacuucgauuuuugugacggcacaaccgucauugugaccgaggauugcgggaacagaggacccagccuccgcacaaccacggccucuggcaaacugaucacagaauggugcugucgguccugcacccuuccuccgcugagauaccggggcgaggacggguguugguauggaauggagauucgcccccucaaggaaaaagaggaaaaucuggugaacagccuggucacagcuggccaugggcagguugauaauuucucccuuggagugcucggcauggcgcuguuucuggaggaaaugcucagaacccggguggggacaaagcacgccauccugcuugucgcugugucuuucguuacccugaucacgggaaacaugagcuuuaaagaccucggcagaguggucgugaugguuggcgccaccaugacagaugacauugggaugggagugaccuaccuggcccugcuugcugccuucaagguccgcccuacauuugcggcuggccugcuccugcggaagcucaccuccaaagagcugaugaugacgacaaucgggauugugcuucugucucaaagcaccauccccgagacaauucucgaacugaccgaugcccuggcccuuggaaugaugguucugaagaucgugagagacauggagaaauaucagcucgcugucaccaucauggccauucugugcgugccuaaugcggugauccuccagaacgcuuggaaggucuccuguacaauucuggccguugugucugugagcccccuucugcucacguccagccagcagaagaccgacuggaucccucuggcccugacaauuaagggccuuaaucccaccgcuaucuuccugacaacccucucucgcacgaacaaaaagagauccuggccgcugaaugaagccaucauggcugucgggauggugagcauucucgccucuucccugcuuaagaacgauaucccuaugacaggaccccugguugcgggcggccugcucaccgugugcuacguccugaccgggcggagcgccgaccuugagcuggaacgcgcuacagaugugaaaugggaggaccaggccgagauuucuggauccagcccuauccucuccauuaccaucagcgaagauggcucuaugagcauuaagaaugaggaagaggagcagacacugacgauccucaucagaaccgggcugcuuguuauuuccggacuguuucccgugucuaucccgauuacagcugccgccugguaucugugggaagucaaaaagcagcgggcuggcgugcucugggacgucccuucucccccucccauggggaaagcggagcuggaagauggagccuaccgcaucaagcaaaagggcauucuuggcuauucccagaucggggcuggaguguacaaagagggcaccuuccauacaauguggcacguuaccagaggggccgugcugaugcacaagggaaaacggaucgaacccuccugggccgacgucaagaaagaucucauuagcuacggcgggggauggaagcuggagggcgaguggaaggaaggcgaggaagugcagguucucgcucuggagccugggaaaaacccgcgcgccgugcagacgaagcccggacuuuuuaaaaccaauacaggcaccaucggggcggucucccuggacuucucuccuggaacaagcggcucccccauuaucgauaagaaagggaagguggugggacuguauggcaacggcguugucaccagaagcggggcuuacgugucugccauugcccaaacagaaaaguccaucgaggacaacccugagaucgaagaugacauuuuucggaaacgcagacucacgaucauggaccugcaucccggagcuggcaagaccaaacgguaucuuccugccauugugagagaggcgaucaagcgcgggcugcggacacucauucuggcuccgaccagagucguggccgccgaaauggaggaagcucuccgcggacugcccauccgguaccagaccccugccauuagagcugagcacacaggccgcgagaucguugaucuuaugugucaugccacguucaccaugcggcugcugagccccgugagagucccuaauuauaaccucaucauuauggacgaagcgcacuucacagaucccgccucuaucgcugcccgcggguacauuuccacccggguggagaugggcgaagcugccggaaucuuuaugacagccaccccgccuggcagcagagaccccuucccccaguccaaugcuccuauuaucgaugaggagcgggaaauccccgagcgcucuuggaacagcgggcaugaauggguuacggacuuuaaaggaaagacagugugguucgucccuuccauuaaggcgggcaaugauaucgccgcuugccugcgcaagaaugggaagaaagugauucaacuuagccggaagaccuuugacucugaguauguuaaaacccgcacaaaugauugggacuucguggucaccacagauaucuccgaaaugggagccaacuuuaaggccgacagagugauugacccgcggagauguaugaaacccgugauccugaccgauggcgaggagcgcgucauccucgcugggccuaugcccguuacgcacagcucugccgcgcagcggagaggccgcauuggacggaauccuaagaacgaaaaugaccaguacaucuacaugggcgagccccuggaaaacgaugaggacugcgcucacuggaaggaagccaaaaugcugcucgauaauauuaacacaccggaggggaucauuccuagcauguucgagcccgaaagagagaagguggacgccaucgauggagaauaucgccuucggggcgaggcuagaaaaaccuuuguggaccugaugcgcagaggggaucugccugucuggcucgccuacaagguggcggccgaaggaauuaauuaugcugaccggcgcugguguuucgauggcaucaaaaacaaccagauccuggaggagaauguugaaguggagauuuggacaaaggaaggggagagaaagaaacuuaagccccgguggcuggacgcccgcaucuacuccgauccucucgcucugaaagaguuuaaggaguucgccgcuggcagaaaaucucugacccucaaccuuauuacggagaugggacggcugcccaccuucaugacacaaaagaccagagacgcccuggacaaucucgcgguccugcauacagccgaagcuggcgggcgcgccuauaaccacgcucuuagcgagcugccggaaacccucgagacacugcugcuccuuacccugcuggccacggugacaggaggcaucuuucucuuccugauguccgggcggggaauuggcaagaugacccuuggcaugugcugcaucaucaccgccucuauucugcucugguacgcucagauccagccucauuggauugcggccagcaucauucuggaguuuuuccugaucguucuccuuauccccgaacccgagaaacagagaacaccucaagauaaucagcugaccuauguggucauugcuauccugacaguggucgccgccacgauggcuaacgaaaugggguuucucgagaagaccaaaaaggaccugggacuuggcuccauugccacacagcagccggaaagcaauauccuggauauugaccuccgccccgcgucugccuggacccuguacgcuguggccacaaccuucguuacgccuaugcugcggcacuccaucgagaacagcuccgugaaugugucucucaccgcuauugccaaccaagcgacaguccuuauggggcugggaaaaggcuggccccugagcaagauggauaucgggguuccucuccuggccaucggauguuacucccaggugaaucccauuacccuuacagcugcccugcuccugcugguggcucacuaugccaucauuggcccuggccuccaggcuaaggccaccagagaggcgcagaaacgggccgcugccgggaucaugaagaacccgacggucgacggaauuacagugaucgaucuugaccccaucccuuacgaucccaaauuugaaaagcaacugggccagguuaugcugcucauucugugcgugacccagguccuuaugaugcgcacaaccugggcucugugugaggcccucacccuggccacagggccuaucucuacgcugugggaaggaaaucccggcagauucuggaacaccacaauugcggugagcauggcuaauaucuuucggggguccuaucucgccggagcuggccuucuguucagcauuaugaaaaacaccacaaauacccgcagaggcacggggaacaucggagagacacugggcgaaaaguggaaaucucggcucaacgcccuggggaaguccgaguuucaaaccuacaagaaaagcggaauccaggaggucgaccgcacccuugccaaggaaggcauuaaaagaggggagacagaucaucacgcugugucucggggauccgccaagcugcgcugguucguugaaagaaauauggugaccccggagggcaaagucguggaccucggcugcgggcggggaggcuggagcuauuacugugggggacugaagaacguuagagaggugaagggccugacaaaagggggaccuggccaugaggaacccauccccaugucuacguauggcuggaaucucguccgccuucagagcgggguggauguguuuuucauuccucccgaaaagugcgacacccugcugugugacaucggagaguccucuccuaacccgacaguugaagcgggccggacccucagaguccugaaucuuguggagaacuggcugaauaacaauacacaguucugcauuaaagugcucaaccccuacaugccuagcgucaucgagaagauggaagcccugcaacgcaaauacgggggagcucugguucggaauccccucuccagaaacagcacccacgagauguauuggguguccaaugccucuggcaacaucgugagcuccgucaauaugauuucucgcaugcuuaucaaccgguuuacgaugagacauaagaaggcuaccuacgaaccugauguggaccuggggagcggaacacgcaacauuggcaucgaguccgaaauucccaaucuggauaucauuggcaaacggaucgagaagaucaaacaggagcacgaaaccucuuggcacuaugaccaggaucauccguacaagacaugggccuaucacgggagcuacgagaccaaacagacaggauccgcgagcucuaugguuaacggcguggucagacuccugaccaagccuugggacgugcuucccacgguuacacaaauggccaugaccgauaccacaccuuucgggcagcagcgcguguuuaaggaaaaagucgacacgcggacccaggagcccaaggaaggaaccaagaagcugaugaaaauuaccgcugaguggcucuggaaggagcugggcaaaaagaagacaccuagaauguguacccgcgaagaguucacaagaaaagugcgguccaaugccgcucugggggccaucuuuaccgaugaaaacaaguggaaaagcgcucgcgaggccguggaggacucuagauucugggaacucgucgauaaggagcggaaucugcaucuugaaggaaaaugcgagacguguguuuauaacaugaugggcaagagagaaaagaaacugggcgaguuugggaaggcgaaaggaucccgggccauuugguacauguggcucggcgcucgcuuccuggaguuugaagcccuuggguuccugaaugaggaccacugguuuagcagagaaaacucucucuccggaguggagggcgaagggcugcacaagcugggcuacauccuccgggacgugagcaaaaaggagggaggcgcuauguaugccgaugacaccgccgggugggauacacgcauuacccuggaggaccuuaagaaugaagagauggucacaaaccauauggaaggagagcacaaaaagcuggcggaagcuaucuucaaacucaccuaccaaaauaaggugguuagagugcagcggcccacgccgcgcggcacagucauggauaucauuuccagacgggaccagcgcgggagcggacaagugggcaccuaugggcugaacacauuuaccaauauggaggcccagcuuaucagacagauggagggcgaaggaguuuucaaaaacauucagcaucugacggccaccgaggaaguggcuguccaaaauuggcucgcccgggugggccgcgagagacugucucggauggcuaucagcggggaugacugcguugugaagccucuggaugaccgcuucgccaacgcgcucacagcccugaacgauaugggaaagauuagaaaagacauccagcagugggagcccuccaagggcuggaaugauuggacccagguccccuuuugcucucaccauuuccacgaacuuaucaugaaagacgggcgggugcuggucgugccuuguagaaaccaagacgagcucauuggacgcgcucggaucagccagggcgccggguggucccugagagaaacagcuugccuuggcaagucuuacgcccagauguggagccugauguauuuucaccgccgggaucucagacuggcggccaaugcuauuuguuccgccguuccgucucauugggugcccaccagccgcacaaccugguccauccacgcuaaacaugaguggaugacgacagaagacaugcugaccgucuggaaccggguguggauuagagagaauccuuggauggaggauaagacccccguggaaagcugggaggaaaucccuuaccucggaaagcgcgaggaccaguggugcggcucucugauugggcuuacaucccgggccaccugggcuaaaaacauccaagccgcgaucaaucagguuagaagccugauuggaaacgaagaguauacagauuacaugcccucuaugaagcgcuuccggagagaggaagaggaagccggcgugcucugguga

SEQ ID NO: 19678 - RNA, 9876 nt, Artificial Sequence
  derived and/or modified CDS sequence (opt5) from DENV-2__GU131897__SS-prME
agcgccggcaugaucauuaugcugauccccaccgugauggcuuuccaccugacaacgcggaauggggagccucauaugauuguuggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaagacaagcgguuugugugcaagcauagcaugguggaucgcggcuggggcaauggguguggacuguucggcaaagggggaauuguuaccugcgcuauguuuacaugcaagaaaaacauggaaggcaagaucguccagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucaucaacagccugguuaccgccggacacggccagguggauaauuucucccugggggugcuuggaauggcucucuuucuggaagagaugcugagaacacgggucggcaccaaacaugcgauucuccugguggccguuucuuucgugacacuuaucaccgggaacaugagcuuuaaggaccugggaagagucgugguuauggugggcgcuacgauggccgaugacauuggcaugggggucaccuaucucgcccugcuggcugccuucaaagugcgcccuacauuugcggcuggacuucugcuccggaagcugaccuccaaggagcucaugaugacaaccaucggcauuguucugcuuucucaaagcacgauccccgaaacagugcuggagcucaccgaugcccuggcccuggggaugaugguccuuaaaaucgugagaaauauggaaaaguaccagcuggcugugacaauuauggccauccucugcgucccuaacgcgguuauucugcagaaugcuuggaaaguguccuguaccauccucgccguggucucugugagcccccugcuucugaccuccagccagcaaaagacagacuggauuccucucgcccugacgaucaaaggacugaaccccaccgcuaucuuccuuacaacccugucucgcacaaauaagaaaagauccuggccgcucaacgaggccauuauggcuguuggcauggugagcauccuggccucuucccuccugaagaaugacauuccuaugaccgggccccuugucgcgggaggccugcugacggugugcuauguucucacaggccggagcgccgaucuggaacuugagcgcgcuaccgacgugaagugggaggaucaggccgaaaucucuggguccagcccuauucuguccaucaccauuagcgaggacggaucuaugagcaucaaaaacgaagaggaggaacagacacucaccauccugauuagaacaggccuccuggucaucuccgggcuuuuucccauuucuaucccgauuacggcugccgccugguaccugugggaggugaagaaacagcgggcuggaguccugugggaugugccuucucccccucccaugggcaaggcggaacucgaggacggggccuaucgcaucaaacaaaagggaauccugggcuacucccagauuggcgcugggguuuacaaggaaggaaccuuccacacaauguggcaugugaccagaggcgccguccuuaugcacaaagggaagcggaucgagcccuccugggccgaugugaaaaaggaccugauuagcuauggaggcggguggaaacucgagggagaauggaaggagggcgaagagguucaggugcuggcucucgaaccuggcaagaauccgcgcgccguccagacaaaacccgggcuguuuaagaccaacacgggaaccaucggcgcggugucccuugauuucucuccugggacaagcggaucccccauuaucgacaaaaagggcaaagugguugggcuguacggaaacggcgucgugaccagaagcggcgcuuaugugucugccaucgcccaaacagagaaguccauugaggauaauccugaaaucgaggacgauauuuuucggaagcgcagacugaccaucauggaccuccaccccggggcuggaaaaacaaagcgguaccugccugccauugucagagaagcgaucaaacgcggccuucggacgcugauucucgcuccgaccagagugguugccgccgagauggaagaggcucugcgcgggcuccccauccgguaucagaccccugccaucagagcugagcauaccggacgcgaaauuguggaccugaugugucacgccaccuucacaaugcggcuucugagccccgucagagugccuaacuacaaucugaucauuauggaugaggcgcauuucacggaccccgccucuaucgcugcccgcggcuauauuuccacccggguugaaaugggggaggcugccggcaucuuuaugacagccaccccgccuggaagcagagaucccuucccccaguccaacgcuccuaucauugacgaggaacgggagauccccgaacgcucuuggaauagcggccacgagugggugauggauuuuaaggggaaaacagucugguucgugccuuccauuaaggcgggaaacgacaucgccgcuugccucagaaagaauggcaaaaagguuauucaacugagccggaaaaccuuugauucugaauacgugaagacgcgcacaaacgacugggauuucgucgugaccaccgacaucuccgagaugggggccaauuuuaaagccgagagagugaucgauccgcggagauguaugaagcccgucauucuuacagacggagaggaacgcguuauccuggcuggcccuaugcccgugacccauagcucugccgcgcagcggagagggcgcauuggccggaacccuaaaaaugaaaacgaccaguacaucuauaugggagagccccucgaaaaugaugaggacugcgcucacuggaaggaggccaagaugcugcuggauaacauuaauacaccggaaggcaucauuccuagcauguucgagcccgaaagagagaaaguggacgccaucgauggggaauaccgccuccggggagaggcuagaaagaccuuugucgaccuuaugcgcagaggcgaucugccuguguggcuggccuauaaaguugcggccgaggggaucaacuacgcugaccggcgcugguguuucgauggaauuaagaacaaucagauccucgaagagaacguggaagucgagauuuggacgaaagagggcgaaagaaagaagcugaaaccccgguggcuugacgcccgcaucuauuccgauccucuggcucucaaggaguuuaaagaguucgccgcugggagaaagucucugacacugaaucucauuaccgagaugggccggcuucccacauucaugacccagaagacgagagacgcccuggauaaccuggcggugcuccacaccgccgaagcuggaggccgcgccuacaaucaugcucugagcgagcuuccggagacacuggaaacccuccugcugcucacacuucuggccaccguuacagggggaaucuuucuguuccucauguccggccgggggaucggaaagaugacccugggcaugugcugcauuaucacggccucuauucuucugugguaugcucagauccagccucacuggauugcggccagcaucauccucgaguuuuuccugauugugcugcucauccccgaacccgagaagcagagaacaccucaagacaaccagcuuaccuacgucgugauugcuauccugaccgucguggccgccacaauggcuaaugaaaugggcuuucuggagaaaaccaagaaagaccucgggcugggauccauugccacacagcagccggagagcaacauccuugauauugaccugcgccccgcgucugccuggacgcucuacgcuguugccaccacauucgugaccccuaugcugcggcauuccaucgaaaauagcuccgugaacgucucucugacagcuaucgccaaucaagcgaccguucucaugggccuugggaagggauggccccugagcaaaauggauauuggcgugccucugcucgccaucggguguuauucccaggugaaccccauuacgcugaccgcugcccuucugcuccuggucgcucacuacgccaucauuggaccuggccugcaggcuaaggccacaagagaggcgcagaagcgggccgcugccggcaucaugaaaaauccgaccguggacgggaucacaguuauugaucucgaccccaucccuuaugaucccaaguuugaaaaacaacuuggacaggugaugcugcugauucucugcgucacccaggugcugaugaugcgcacgacaugggcucuuugugaggcccugacccucgccacaggcccuaucucuacccugugggaagggaaccccggaagauucuggaauaccacaauugcggucagcauggcuaacaucuuucggggcuccuaccuggccggggcuggacuccuuuucagcaucaugaagaauacgaccaacacacgcagaggcaccggcaacauuggggagacacugggagagaaauggaagucucggcugaaugcccucggcaaauccgaauuucaaaucuauaaaaagagcgggauucaggagguggaccgcacccuggccaaagaaggaaucaagagaggcgagacggaucaccaugcuguuucucggggguccgccaaacuucgcugguucguggagagaaacauggucacaccggaaggaaaggugguugaccugggcugcggcagagggggauggagcuacuauuguggcgggcucaaaaaugugcgggaggucaagggacugaccaagggcgggccuggacacgaagaacccauucccaugucuaccuacggcuggaaccuggugcgccuccagagcggcguggaugucuuuuucaucccucccgaaaaaugcgacacacuucugugugauaucggggaguccucuccuaauccgaccgucgaggcgggacggacacugagagugcucaaccugguggaaaauuggcuuaacaauaacacgcaguucugcauuaagguccugaaucccuacaugccuagcguuaucgagaaaauggaagcccuccaacgcaaguauggcggggcucuggugcggaacccccuguccagaaauagcacccaugagauguacuggguguccaacgccucuggaaauauugucagcuccgugaacaugaucucucgcaugcucauuaaccgguuuacaaugagacacaaaaaggcuaccuaugaaccugacguugaccuuggcagcgggacacgcaauaucggaauugaguccgagauccccaaccuggauaucauuggcaagcggaucgagaagauuaaggaggaacaugagaccucuuggcacuacgaccaggaucacccguauaaaacgugggccuaccauggcagcuaugaaaccaagcagacaggguccgcgagcucuauggugaauggagucgugagacugcucaccaaaccuugggacguucugcccacagugacccagauggccaugacagauaccacgccuuucggccaacagcgcgucuuuaaggagaagguggacacacggacccaggagcccaaagaagggaccaagaaacuuaugaagaucacagcugaguggcuguggaaagaacucggaaagaaaaagacgccuagaauguguacccgcgaggaguucacaagaaaggugcgguccaacgccgcucugggcgccauuuuuaccgaugaaaauaaauggaaaagcgcucgcgaggccgucgaagacucuagauucugggagcugguugauaaagaacggaaccuccaccuggaggggaagugcgagacauguguguacaauaugaugggaaaaagagaaaagaaacuuggcgaguuuggcaaagcgaaggggucccgggccaucugguacauguggcugggagcucgcuuccucgaauuugaggcccugggcuuccuuaacgaagaccauugguuuagcagagaaaauucucuguccgggguggagggagaaggccuccacaaacugggguauauccugcgggaugucagcaagaaagagggcggagcuauguacgccgacgacaccgccggcugggauacacgcauuacccucgaagaccugaagaacgaggaaauggugacgaaucacauggagggggagcauaagaaacuugcggaagcuaucuucaagcugaccuaucagaacaaaguugugagaguccaacggcccacaccgcgcggaaccgugauggauauuaucuccagacgggaccagcgcggcagcgggcagguuggaacauacggccucaauaccuuuacgaacauggaggcccaacugauuagacagauggaaggggagggcguguucaagaauauccagcaccuuacagucaccgaggaagccgcugugcagaacuggcuggcccggguuggacgcgagagacucucucggauggcuaucagcggcgaugacugcguggucaaaccucuggaugaccgcuucgccaacgcgcugacagcccucaaugauauggggaagauuagaaaggacauccaacagugggaacccuccaaaggauggaacgauuggacccaggugcccuuuugcucucaucacuuccaugagcugauuaugaaggacggccggguccuugugguuccuuguagaaaucaggaugaacugaucgggcgcgcucggauuagccaaggagccggcuggucccucagagagacggcuugccuggggaaaucuuaugcccagauguggagccuuauguacuuucaccgccgggaccugagacucgcggccaacgcuaucuguuccgccgugccgucucacuggguccccaccagccgcacaaccugguccauucaugcuaagcacgaguggaugacaaccgaagacaugcugacaguguggaaucggguguggaucagagagaacccuuggauggaagauaaaacccccguugagagcugggaagagaucccuuaucugggcaagcgcgaggaccaguggugcggaucucucauuggccugacgucccgggccacaugggcuaagaauauccaggccgcgauuaaccaagugagaagccuuaucgggaaugaagaguacaccgauuacaugcccucuaugaaacgcuuccggagagaagaggaagaggccggaguccugugguga

SEQ ID NO: 19679 - RNA, 9876 nt, Artificial Sequence
  derived and/or modified CDS sequence (opt5) from DENV-2__GQ868631__SS-prME
agcgccggaaugaucauuaugcugauccccaccgugauggcuuuccaccugacaacgagaaauggggagccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaagggggagcacagaagagaaaaacgguccguggcgcucgucccucaugugggaaugggccuggagacccgcacagaaaccuggaugucuagcgagggcgcuuggaagcacgcccagagaaucgagacguggauucugcggcaucccggguucacaaucauggccgcuauucucgccuacaccaucggaacaacccacuuucagcgcguucugauuuucauccuucugaccgcuguggccccuuccaugacaaugagaugcauuggcaucucuaaccgggauuuugucgaaggggugagcggaggcuccuggguugacaucgugcucgagcacgggagcugugucacgaccauggcgaagaauaaacccacacuggauuucgaacuuauuaagaccgaggccaaacagccugcuacacugcgcaaguauugcaucgaagccaaacucaccaacacgacaaccgagucuagauguccgacccaaggagagcccucccugaaggaggaacaagacaagcgguuugugugcaaacauagcaugguggaucgcggcuggggcaauggguguggacuguucggcaaaggcgggauugucacaugcgcuauguuuaccugcaaaaagaacauggaagggaaaaucguucagccugagaaucucgaauacacaauuguggugacgccccacucuggggaggagcaugccgucggaaacgacaccggcaagcacggcauggaaaucaaagugacaccucaguccagcaucaccgaggcggaacugacaggguauggaaccguuacgauggaguguucucccagaaccggccuugauuucaaugaaauggugcugcuccaaauggagaacaaggccuggcugguccaccggcagugguuucuugaccugccgcucccuuggcugcccggggcugauaagcaggaguccaauuggauucagaaagaaacacuggugaccuucaagaacccucaugccaaaaagcaagacguugugguccucggaagccaggagggcgcuaugcacacagcccugaccggggccacggaaauccagauguccucuggcaaucuucuguuuacaggacaucucaaaugccgccugagaauggacaaacuucaacugaagggcaugagcuacuccauguguaccgggaaauucaagguggucaaagagauugcugagacacagcacggaaccaucgugauucggguucaguaugaaggcgaugggagccccugcaagauccccuucgagaucauggaccucgagaagcgguacgugcugggacgccugauuaccgucaacccuaucgugacagagaaggauucuccgguuaacauugaagcggagcccccuuuuggcgacuccuacaucauuaucgggguggagcccggccagcucaagcugaauugguucaaaaagggaagcucuauuggccaaauguuugaaacgaccaugagaggggcuaaaagaauggcuauccuuggagauacagccugggacuucggcagccucgggggagucuuuaccuccaucggcaaggcccuccaucagguguucggggcuauuuauggcguggccuuuucuggaguuagcuggacaaugaaaauccugauuggcgucaucauuaccuggaucgggaugaacucccgcagcacgucucuguccgugagccuugugcucgucggaaucgugacacuguaccugggcguuauggugcaggcggauucugggugugucguguccuggaagaauaaggagcucaaaugcggaagcggcauuuucaucaccgacaacguucacaccuggacagaacaguauaaguuucaaccugagucccccucuaaacuggcuagcgccauucagaaggcccaggaagaggggaucuguggcauucgguccgugaccagacuugagaaucugauguggaaacagaucacaccggaacucaaccacauccuggcugagaaugaagucaagcugacgauuaugaccggagauaucaaaggcauuaugcaagccgggaagcgcucucuucggccucagcccacagagcucaaguacagcuggaaaaccuggggaaaggcuaaaaugcuguccacagaaagcuauaaccagaccuuccugaucgacggcccugagacggccgagugccccaauaccaacagagcguggaacucucucgaaguggaggauuacggguuuggaguuuucacaaccaacauuuggcugaaacuuaaagaaaagcaggacgccuuuugugacuccaagcugaugagcgcugccaucaaagauaaucgcgcugugcaugccgacaugggcuauuggaucgagucugcgcucaacgauacauggaagauugagaaagccuccuucaucgaagucaagaauugccacuggccuaaaagccauacccuguggucuaacggcgugcuggagagcgaaaugauuauccccaagaaccuugcugggccggugucccaacacaauuaccggccuggauaccacacacagauugccggccccuggcaucucgggaagcuggagauggacuucgauuuuugugacggaaccacggucaucguuacagaagauugcggcaacagagggcccagccugcgcaccaccacagcuucuggaaaacucauuaccgaguggugcugucgguccugcacgcugccuccgcuuagauaucggggcgaggacggcuguugguacgggauggaaauccgcccccugaaggagaaagaagagaaucucgugaacagccuggugacagccggacacggccaggucgauaauuucucccugggggugcuuggaauggcccucuuucuggaagagaugcugagaacccggguuggcacaaagcaugcuauccuccugguggcggucucuuucgugacccuuauuacagggaacaugagcuuuaaagaccugggaagaguuguggucauggugggcgccaccauggcugaugacaucggcauggggguuacguaucucgcccugcuggccgcuuucaaggugcgcccuaccuuugccgcgggacuucugcuccggaagcugacauccaaagagcucaugauggcuaccauuggcaucguccugcuuucucaaagcacaauucccgaaaccgugcuggagcucacggaugcccuggcccuggggaugauggcucuuaagaucgugagaaauauggaaaaauaccagcuggccgucacaaucauggcgauucucugcguuccuaacgcugugauccugcagaaugccuggaagguguccuguaccauucucgccgucgugucuguuagcccccugcuucugacauccagccagcagaagacagacuggaucccucucgcucugaccauuaagggacugaaccccacagccaucuuccuuacgacccugucucgcacaaauaaaaagagauccuggccgcucaacgaggcuaucauggccgugggcauggucagcauucuggcgucuucccuccugaagaaugacaucccuaugaccgggccccuuguggccggaggccugcugacaguuugcuaugugcucaccggccggagcgcugaucuggaacuugagcgcgccacggacgucaaaugggaggaucaggcugaaauuucuggguccagcccuauccuguccauuacaaucagcgaggacggaucuaugagcauuaagaacgaagaggaggaacagacccucaccauccugaucagaacaggccuccuggugauuuccgggcuuuuucccaucucuauuccgaucaccgccgccgcuugguaccugugggaggucaaaaagcagcgggcgggagugcugugggauguuccuucucccccucccaugggcaaagccgaacucgaggacggggcuuaucgcauuaagcaaaagggaauccugggcuacucccagaucggcgccgggguguacaaagaaggaacauuccacacgauguggcaugucaccagaggcgccgugcuuaugcacaaggggaaacggauugagcccuccugggcugauguuaagaaagaccugaucagcuauggaggcggguggaagcucgagggagaauggaaggagggcgaagaggugcagguccuggcccucgaaccuggcaaaaauccgcgcgcggugcagacaaagcccgggcuguuuaaaaccaacacaggaaccauuggcgcugugucccuugauuucucuccugggacgagcggaucccccaucauugacaagaaaggcaagguugucgggcuguacggaaacggcguggugaccagaagcggcgccuaugucucugccaucgcucaaacagagaaguccaucgaggauaauccugaaauugaggacgauaucuuucggaaacgcagacugaccauuauggaccuccaccccggggccggaaagacaaaacgguaccugccugcgaucgugagagaagcuauuaagcgcggccuucggacccugauccucgccccgacaagaguuguggccgcugagauggaagaggcccugcgcgggcuccccauucgguaucagacgccugcuaucagagccgagcauaccggacgcgaaaucgucgaccugaugugucacgcgacauucaccaugcggcuucugagccccgugagaguuccuaacuacaaucugauuaucauggaugaggcccauuucaccgaccccgcuucuauugccgcucgcggcuauaucuccacacggguggaaaugggggaggccgccggcauuuuuaugacggcuaccccgccuggaagcagagaucccuucccccaguccaacgcgccuaucaucgacgaggaacgggagauucccgaacgcucuuggaauagcggccacgagugggucacagauuuuaaagggaagaccgugugguucguuccuuccaucaaggccggaaacgacauugcugccugccuccgcaaaaauggcaagaaagugauccaacugagccggaagacauuugauucugaauacgucaaaacccgcacgaacgacugggauuucguggugacaaccgacauuuccgagaugggggccaauuuuaaggcugagagagucaucgauccgcggagauguaugaaacccguuauccuuaccgacggagaggaacgcgugauucuggccggcccuaugcccgugacacauagcucugcggcucagcggagagggcgcaucggccggaacccuaagaaugaaaacgaccaguacauuuauaugggagagccccucgaaaaugaugaggacugcgcccacuggaaggaggccaaaaugcugcuggauaacaucaauaccccggaaggcauuaucccuagcauguucgagcccgaaagagagaaggucgacgcuauugauggggaauaccgccuccggggagaggccagaaaaacauuuguggaccuuaugcgcagaggcgaucugccuguuuggcuggcguauaagguggccgcugaggggaucaacuacgccgaccggcgcugguguuucgauggaaucaaaaacaaucagauucucgaagagaacgucgaaguggagaucuggaccaaggagggcgaaagaaagaaacugaagccccgguggcuugacgcucgcauuuauuccgauccucuggcccucaaagaguuuaaggaguucgcugccgggagaaaaucucugacgcugaaucucaucacagagaugggccggcuucccaccuucaugacacaaaagaccagagacgcgcuggauaaccuggccguucuccacacggcugaagccggaggccgcgcuuacaaucaugcccugagcgagcuuccggagacccuggaaacacuccugcugcucacccuucuggccacagugaccgggggaauuuuucuguuccucauguccggccgggggaucggaaagaugacacugggcaugugcugcaucauuaccgcuucuauccuucugugguaugcgcagauucagccucacuggaucgccgcuagcauuauccucgaguuuuuccugaucguccugcucauucccgaacccgagaaacagagaacgccucaagacaaccagcuuacauacguggucaucgccauucugaccgugguugccgcuaccauggccaaugaaaugggcuuucuggagaagaccaagaaggaccucgggcugggauccaucgcgacccagcagccggagagcaacauucuugauaucgaccugcgccccgccucugcuuggacacucuacgccguggcuacgaccuucgugacaccuaugcugcggcauuccauugaaaauagcuccgucaacguuucucugaccgccaucgcgaaucaagccacagugcucaugggccuugggaaaggauggccccugagcaagauggauaucggcgugccucugcucgcuauuggguguuauucccaggucaaccccaucacccugacggccgcccuucugcuccugguggcccacuacgcuauuaucggaccuggccugcaggccaaggcgaccagagaggcccagaaacgggcugccgcuggcauuaugaagaauccgacaguugacgggaucaccgugaucgaucucgaccccauuccuuaugaucccaaauuugaaaagcaacuuggacaggucaugcugcugauccucugcgugacacagguccugaugaugcgcaccacgugggcccuuugugaggcccugacacucgcgaccggcccuauuucuacacugugggaagggaaccccggaagauucuggaauaccaccaucgcugugagcauggccaacauuuuucggggcuccuaccuggcuggggccggacuccuuuucagcaucaugaaaaauacaacgaacacccgcagaggcacaggcaacaucggggagacccugggagagaaguggaaaucucggcugaaugcccucggcaaguccgaauuucaaauuuauaagaaaagcgggauccaggagguugaccgcacacuggcuaaggaaggaauuaaaagaggcgagaccgaucaccaugccgugucucggggguccgcgaaacuucgcugguucgucgagagaaacauggugacgccggaaggaaaaguuguggaccugggcugcggcagagggggauggagcuacuauuguggcgggcucaagaauguccgggaggugaagggacugacaaaaggcgggccuggacacgaagaacccauccccaugucuaccuacggcuggaaccuggugcgccuccagagcggcguugaugucuuuuucauuccucccgaaaagugcgacacccuucugugugauaucggggaguccucuccuaauccgacaguggaggccggacggacccugagagugcucaaccuggucgaaaauuggcuuaacaauaacacacaguucugcaucaaaguucugaaucccuacaugccuagcgugauugagaagauggaagcuaugcaacgcaaauauggcggggcccucgugcggaacccccuguccagaaauagcacgcaugagauguacugggucuccaacgcuucuggaaauaucgugagcuccguuaacaugauuucucgcaugcugaucaaccgguuuaccaugagacacaagaaggccacauaugaaccugacguggaccucggcagcgggacccgcaauauuggaaucgaguccgagauucccaaccuugauaucaucggcaaacggauugaaaagaucaaagaggaacaugagacaucuuggcacuacgaccaggaucacccguauaagaccugggcguaccauggcagcuaugaaacgaaacagaccggguccgccagcucuauggucaauggagugguuagacugcugacaaagccuugggacgugcuccccaccgucacacagauggcuaugaccgauacaaccccuuucggccaacagcgcguguuuaaggagaaaguggacacgcggacacaggagcccaaggaagggaccaaaaagcugaugaaaauuaccgccgaguggcuuuggaaggaacugggcaagaagaagacaccuagaauguguacgcgcgaggaguucaccagaaaaguccgguccaacgcugcccucggcgcuaucuuuacagaugaaaauaaguggaaaagcgcccgcgaggcgguugaagacucuagauucugggagcugguggauaaggaacggaaccugcaccucgaggggaaaugcgagaccuguguguacaauaugaugggaaagagagaaaagaaacugggcgaguuuggcaaggccaaagggucccgggcuauuugguacauguggcuuggagcccgcuuccuggaauuugaggcucucggcuuccugaacgaagaccauugguuuagcagagaaaauucucuuuccggggucgagggagaaggccugcacaagcucggguauauccugcgggaugugagcaaaaaggagggcggagccauguacgccgacgacacagcgggcugggauacccgcaucacacuggaagaccucaagaacgaggaaaugguuaccaaucacauggagggggagcauaaaaagcuggcugaagccauuuucaaacuuacguaucagaacaagguggucagagugcaacggcccaccccgcgcggaacaguuauggauaucauuuccagacgggaccagcgcggcagcggacaggugggaaccuacggccugaauacauuuaccaacauggaggcccaacucaucagacagauggaaggggagggcgucuucaaaaauauucagcaccugacggugacagaggaagcugccguucagaacuggcuugcucgggugggacgcgagagacugucucggauggccaucagcggcgaugacugcgucgugaagccucucgaugaccgcuucgcgaacgcccugaccgcucugaaugauauggggaagaucagaaaagacauucaacagugggaacccuccaagggauggaacgauuggacacagguccccuuuugcucucaucacuuccaugagcucaucaugaaagacggccgggugcugguugugccuuguagaaaucaggaugaacuuauugggcgcgcccggaucagccaaggagcuggcuggucccugagagagaccgccugccucgggaagucuuaugcgcagauguggagccugauguacuuucaccgccgggaccuuagacuggccgcuaacgccauuuguuccgcugucccgucucacugggugcccacgagccgcaccacaugguccauccaugccaaacacgaguggaugaccacagaagacaugcucaccguguggaaucggguuuggauuagagagaacccuuggauggaagauaagacacccguggagagcugggaagagaucccuuaucugggcaagcgcgaggaccaguggugcggaucucugaucggccucaccucccgggcuacgugggccaaaaauauucaggcggccaucaaccaagucagaagccugauugggaaugaagaguacacagauuacaugcccucuaugaagcgcuuccggagagaagaggaagaggcuggagugcuuugguga

SEQ ID NO: 19680 - RNA, 9876 nt, Artificial Sequence
  derived and/or modified CDS sequence (opt5) from DENV-2__GU131899__SS-prME
agcgccggcaugaucauuaugcugauccccacagugauggcuuuccaccugacgacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagcggagcccccuuuuggcgacuccuacaucauuaucgggguggagcccggccagcucaagcugaauugguucaaaaagggaagcucuauuggccaaauguuugaaaccacaaugagaggggccaaaagaauggcuauccuuggagauaccgccugggacuucggcagccucgggggagucuuuacauccaucggcaaggcccuccaucagguguucggggcuauuuauggcgccgcguuuucuggagugagcuggaccaugaaaauccugauuggcguuaucauuacguggaucgggaugaacucccgcagcacaucucuguccgucagccuugugcucgugggaaucgucacccuguaccugggcgugaugguucaggcugauucuggguguguggucuccuggaagaauaaggagcucaaaugcggaagcggcauuuucaucaccgacaacgugcacacauggaccgaacaguauaaguuucaaccugagucccccucuaaacuggccagcgccauucagaaggcucaggaagaggggaucuguggcauucgguccguuacaagacuugagaaucugauguggaaacagaucacgccggaacucaaccacauccuggccgagaaugaagugaagcugaccauuaugacaggagauaucaaaggcauuaugcaagcugggaagcgcucucuucggccucagcccaccgagcucaaguacagcuggaaaacauggggaaaggccaaaaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaagaaaagcaggacgcuuuuugugacuccaagcugaugagcgccgcuaucaaagauaaucgcgccguucaugcggacaugggcuauuggaucgagucugcccucaacgauaccuggaagauugagaaggcuagcuucaucgaagugaagaauugccacuggccuaaaagccauacacuguggucuaacggcguccuggagagcgaaaugauuauccccaagaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaaacucauuacggaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcucucuuucuggaagagaugcugagaacacgggugggcaccaagcaugcgauccuccugguugccgugucuuucgucacacuuauuaccgggaacaugagcuuuaaagaccugggaagagugguugugauggucggcgcuacgauggccgaugacaucggcaugggggugaccuaucucgcccugcuggcugccuucaagguucgcccuacauuugcggcuggacuucugcuccggaagcugaccuccaaagagcucaugaugacaaccauuggcaucgugcugcuuucucaaagcacgauucccgaaacaguccuggagcucaccgaugcccuggcccuggggaugauggugcuuaagaucgugagaaauauggaaaaauaccagcuggcugucacaaucauggccauucucugcguuccuaacgcggugauccugcagaaugcuuggaagguguccuguaccauucucgccgucgugucuguuagcccccugcuucugaccuccagccagcagaagaccgacuggaucccucucgcccugacgauuaagggacugaaccccaccgcuaucuuccuuacaacccugucucgcacaaauaaaaagagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaaaugggaggaucaggccgaaauuucuggguccagcccuauccuguccauuaccaucagcgaggacggaucuaugagcauuaagaacgaagaggaggaacagacacucaccauccugaucagaacaggccuccuggugauuuccgggcuuuuucccaucucuauuccggucacggcugccgccugguaccugugggaggugaaaaagcagcgggcuggaguucugugggaugugccuucucccccucccaugggcaaagcggaacucgaggacggggccuaucgcaucaagcaaaagggcauucugggauacucccagaucggcgcuggggucuacaaagaaggaaccuuccacacaauguggcaugugaccagaggcgccguucuuaugcacaaggggaaacggaucgagcccuccugggccgaugugaagaaagaccugauuagcuauggaggcggguggaagcucgagggagaauggaaggagggcgaagagguccaggugcuggcucucgaaccuggcaaaaauccgcgcgccgugcagacaaagcccgggcuguuuaaaaccaacacgggaaccaucggcgcgguuucccuugauuucucuccugggacaagcggaucccccauuaucgacaagaaaggcaaggucguggggcuguacggaaacggcguggucaccagaagcggcgcuuaugugucugccauugcccaaacagagaaguccaucgaggauaauccugaaaucgaggacgauauuuuucggaaacgcagacugaccaucauggaccuccaccccggggcuggaaagacaaaacgguaccugccugccauuguuagagaagcgaucaagcgcggccuucggacgcugauucucgcuccgaccagaguggucgccgccgagauggaagaggcucugcgcgggcuccccauccgguaucagaccccugccauuagagcugagcauaccggacgcgaaaucguggaccugaugugucacgccaccuucacaaugcggcuucugagccccguuagagugccuaacuacaaucugaucauuauggaugaggcgcauuucacggaccccgccucuaucgcugcccgcggcuauauuuccacccgggucgaaaugggggaggcugccggcaucuuuaugacagccaccccgccuggaagcagagaucccuucccccaguccaacgcuccuauuaucgacgaggaacgggagauccccgaacgcucuuggaauagcggccacgagugggugacagauuuuaaagggaagaccguuugguucgugccuuccauuaaggcgggaaacgacaucgccgcuugccuccgcaaaaauggcaagaaagucauucaacugagccggaagacguuugauucugaauacgugaaaacacgcaccaacgacugggauuucguggucaccacagacaucuccgagaugggggccaauuuuaaggccgagagaguuauugauccgcggagauguaugaaacccgugauccuuaccgacggagaggaacgcgugauccuggcuggcccuaugcccgucacacauagcucugccgcgcagcggagagggcgcauuggccggaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaccgccuccggggagaggcuagaaaaacguuuguugaccuuaugcgcagaggcgaucugccuguguggcuggccuauaaggucgcggccgaggggauuaacuacgcugaccggcgcugguguuucgauggaaucaaaaacaaucagauccucgaagagaacauggaaguggagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacagagaugggccggcuucccaccuucaugacgcaaaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaaucuuucuguuccucauguccggccgggggauuggaaagaugacgcugggcaugugcugcaucaucacagccucuauucuucugugguaugcucagauccagccucacuggauugcggccagcaucauucucgaguuuuuccugaucguccugcucauccccgaacccgagaaacagagaaccccucaagacaaccagcuuaccuacguggucauugcuauccugacagugguugccgccaccauggcuaaugaaaugggcuuucuggagaagaccaagaaggaccucgggcugggauccauugccacgcagcagccggagagcaacauccuugauauugaccugcgccccgcgucugccuggacccucuacgcuguggccacaaccuucgugacaccuaugcugcggcauuccaucgaaaauagcuccgucaacguuucucugaccgcuauugccaaucaagcgacggugcucaugggccuugggaaaggauggccccugagcaagauggauaucggcgugccucugcucgccaucggguguuauucccaggucaaccccauuacccugacagcugcccuucugcuccugguggcucacuacgccaucauuggaccuggccugcaggcuaaggccaccagagaggcgcagaaacgggccgcugccggcaucaugaagaauccgacaguugacgggauuaccgugaucgaucucgaccccaucccuuaugaucccaaauuugaaaagcaacuuggacaggucaugcugcugauucucugcgugacgcagguccugaugaugcgcacaaccugggcucuuugugaggcccugacacucgccaccggcccuaucucuacccugugggaagggaaccccggaagauucuggaauacaacgauugcggugagcauggcuaacaucuuucggggcuccuaccuggccggggcuggacuccuuuucagcauuaugaaaaauaccacaaacacccgcagaggcacaggcaacaugggggagacccugggagagaaguggaaaucucggcugaaugcccucggcaaguccgaauuucaaaucuauaagcgcagcgggauccaggagguugacagaacgcuggccaaagaaggaauuaagcggggcgagacagaucaccaugcugugucucgcggguccgccaaacuuagaugguucgucgagcggaacauggugaccccggaaggaaagguuguggaccugggcugcggcagagggggauggagcuacuauuguggcgggcucaaaaauguccgcgaggugaagggacugaccaagggcgggccuggacacgaagaacccauccccaugucuacauacggcuggaaccuggugcggcuccagagcggcguugaugucuuuuucauuccucccgaaaaaugcgacacccuucugugugauaucggggaguccucuccuaauccgacaguggaggcgggaagaacgcugcgcgugcucaaccuggucgaaaauuggcuuaacaauaacacccaguucugcauuaagguucugaaucccuacaugccuagcgugaucgagaaaauggaagcccuccaacggaaguauggcggggcucuggugagaaacccccugucccgcaauagcacacaugagauguacugggucuccaacgccucuggaaauaucgugagcuccguuaacaugauuucucggaugcucaucaacagauuuaccaugcgccacaaaaaggcuacauaugaaccugacguggaccuuggcagcgggacccggaauauuggaaucgaguccgagauucccaaccuggauaucauuggcaagagaaucgagaagaucaagcaggagcaugaaacgucuuggcacuacgaccaggaucacccguauaaaaccugggccuaccauggcagcuaugagacaaagcagaccggguccgcgagcucuauggucaauggagugguucgccugcucacaaaaccuugggacgugcugcccaccgucacacaaauggccaugaccgauacgacaccuuucggccagcagcggguguuuaaggaaaagguggacaccagaacccaggagcccaaagaggggacaaagaaacuuaugaagauuacggcugaauggcuguggaaagagcucggaaagaaaaagaccccucgcauguguacaagagaagaguucacccggaagguccgcuccaacgccgcucugggcgccaucuuuacagaugagaauaaauggaaaagcgcuagagaagccguugaggacucucgguucugggaacugguggauaaagagagaaaccuccaccuggaagggaagugcgagaccuguguguacaauaugaugggaaaacgggagaagaaacuuggcgaauuuggcaaagcgaaggggucccgcgccauuugguacauguggcugggagcuagauuccucgaguuugaagcccugggcuuccuuaacgaggaccauugguuuagccgggaaaauucucuguccggggucgagggagagggccuccacaaacugggguauauccugcgcgaugugagcaagaaagaaggcggagcuauguacgccgacgacacagccggcugggauaccagaauuacgcucgaggaccugaagaacgaagagaugguuaccaaucacaugaagggggaacauaagaaacuugcggaggcuaucuucaaacugacauaucaaaacaaagugguccgggugcagcgccccaccccgagaggaacaguuauggauaucauuucccggcgcgaccagagaggcagcgggcaagugggaaccuacggccucaauacguuuacaaacauggaggcccagcugauccggcagauggaaggggagggcgucuucaaaaauauucagcaccuuaccgugacagaagagguugccgugcaaaacuggcuggcucgcgucggaagagagcggcucucucgcauggccaucagcggcgaugacugcguggucaagccucuggaugacagauucgcuaacgcccugaccgcgcucaaugauauggggaagauucggaaagacauccagcagugggaacccuccaagggauggaacgauuggacacaggugcccuuuugcucucaucacuuccaugagcugaucaugaaagacggcagaguucuuguggucccuugucgcaaucaagaugaacugauugggcgggccagaaucagccagggagcuggcuggucccuccgcgagaccgccugccuggggaagucuuaugcucagauguggagccuuauguacuuucaccggagagaccugcgccucgccgcgaacgccauuuguuccgcugugccgucucacugggugcccacaagccggaccacaugguccauccaugccaaacacgaauggaugaccacagaggacaugcugaccguuuggaauagaguguggauucgcgagaacccuuggauggaagauaagacgcccgucgagagcugggaagagaucccuuaucugggcaagcgggaagaccaguggugcggaucucucauuggccugacauccagagcuaccugggccaaaaauauccaagcugccaucaaccaggugcgcagccuuauugggaaugaggaguacaccgauuacaugcccucuaugaagcgguucagacgggaagaggaagaggcgggaguucugugguga

SEQ ID NO: 19681 - RNA, 9876 nt, Artificial Sequence
  derived and/or modified CDS sequence (opt5) from DENV-2__GU131900__SS-prME
agcgccggcaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccagguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucaaagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaaggacgauaucccuaugaccgggccccuuguggcgggaggccugcugacgguuugcuaugugcucacaggccggagcgccgaccuggaacuugagcgcgcuaccgaugucaagugggaggaccaggccgaaauuucuggguccagcccuauccuguccauuaccaucagcgaggauggaucuaugagcauuaaaaaugaagaggaggaacagacacucaccauccugaucagaacaggccuccuggugauuuccgggcuuuuucccaucucuauuccgaucacggcugccgccugguaccugugggaggucaagaaacagcgggcuggagugcugugggacguuccuucucccccucccaugggcaaggcggaacucgaggauggggccuaucgcauuaaacaaaagggaauccugggcuacucccagaucggcgcugggguguacaaggaaggaaccuuccacacaauguggcaugucaccagaggcgccgugcuuaugcacaaagggaagcggauugagcccuccugggccgacguuaaaaaggaucugaucagcuauggaggcggguggaaacucgagggagaauggaaggagggcgaagaggugcagguccuggcucucgaaccuggcaagaacccgcgcgccgugcagacaaaacccgggcuguuuaagaccaauacgggaaccauuggcgcggugucccuugacuucucuccugggacaagcggaucccccaucauugauaaaaagggcaaaguugucgggcuguacggaaacggcguggugaccagaagcggcgcuuaugucucugccaucgcccaaacagagaaguccaucgaggacaacccugaaauugaggaugacaucuuucggaagcgcagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaucugaugugucacgccaccuucacaaugcggcuucugagccccgugagaguuccuaauuacaaccugauuaucauggacgaggcgcauuucacggaucccgccucuauugcugcccgcggcuauaucuccacccggguggaaaugggggaggcugccggcauuuuuaugacagccaccccgccuggaagcagagaccccuucccccaguccaaugcuccuaucaucgaugaggaacgggagauucccgaacgcucuuggaacagcggccacgagugggucacagacuuuaaggggaaaaccgugugguucguuccuuccaucaaggcgggaaaugauauugccgcuugccucagaaagaacggcaaaaaggugauccaacugagccggaaaacguuugacucugaauacgucaagacacgcaccaaugauugggacuucguggugaccacagauauuuccgagaugggggccaacuuuaaagccgagagagucaucgacccgcggagauguaugaagcccguuauccuuaccgacggagaggaacgcgugauucuggcuggcccuaugcccgugacacauagcucugccgcgcagcggagagggcgcaucggccggaauccuaaaaacgaaaaugaucaguacauuuauaugggagagccccucgaaaacgacgaggauugcgcucacuggaaggaggccaagaugcugcuggacaauaucaacaccccggaaggcauuaucccuagcauguucgagcccgaaagagagaaagucgaugccauugacggggaauaccgccuccggggagaggcuagaaagacguuuguggaucuuaugcgcagaggcgaccugccuguuuggcuggccuauaaaguggcggccgaggggaucaauuacgcugaucggcgcugguguuucgacggaaucaagaacaaccagauucucgaagagaaugucgaaguggagaucuggacaaaagagggcgaaagaaagaagcugaaaccccgguggcuugaugcccgcauuuauuccgacccucuggcucucaaggaguuuaaagaguucgccgcugggagaaagucucugacccugaaccucaucacagagaugggccggcuucccaccuucaugacgcagaagaccagagaugcccuggacaaucuggcgguucuccacacagccgaagcuggaggccgcgccuacaaccaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaagcagagaaccccucaagacaaucagcuuaccuacguggucaucgcuauucugacagugguugccgccaccauggcuaacgaaaugggcuuucuggagaaaacaaagaaagaucucgggcugggauccaucgccacgcagcagccggagagcaauauucuugacaucgaucugcgccccgcgucugccuggacccucuacgcuguggccacaaccuucgugacaccuaugcugcggcauuccauugaaaacagcuccgucaauguuucucugaccgcuaucgccaaccaagcgacggugcucaugggccuugggaagggauggccccugagcaaaauggacaucggcgugccucugcucgccauuggguguuauucccaggucaaucccaucacccugacagcugcccuucugcuccugguggcucacuacgccauuaucggaccuggccugcaggcuaaggccaccagagaggcgcagaagcgggccgcugccggcauuaugaaaaacccgacaguugaugggaucaccgugaucgaccucgaucccauuccuuaugaccccaaguuugaaaaacaacuuggacaggucaugcugcugauccucugcgugacgcagguccugaugaugcgcacaaccugggcucuuugugaggcccugacacucgccaccggcccuauuucuacccugugggaagggaaucccggaagauucuggaacacaacgaucgcggugagcauggcuaauauuuuucggggcuccuaccuggccggggcuggacuccuuuucagcaucaugaagaacaccacaaauacccgcagaggcacaggcaacaucggggagacccugggagagaaauggaagucucggcugaacgcccucggcaaauccgaauuucaaauuuauaaaaagagcgggauccaggagguugaucgcacgcuggccaaagaaggaauuaagagaggcgagacagaccaccaugcugugucucggggguccgccaaacuucgcugguucgucgagagaaauauggugaccccggaaggaaagguuguggaucugggcugcggcagagggggauggagcuacuauuguggcgggcucaaaaacguccgggaggugaagggacugaccaagggcgggccuggacacgaagaacccauccccaugucuacauacggcuggaaucuggugcgccuccagagcggcguugacgucuuuuucauuccucccgaaaaaugcgauacccuucugugugacaucggggaguccucuccuaacccgacaguggaggcgggacggacgcugagagugcucaaucuggucgaaaacuggcuuaauaacaauacccaguucugcaucaagguucugaaccccuacaugccuagcgugauugagaaaauggaagcccuccaacgcaaguauggcggggcucuggugcggaauccccuguccagaaacagcacacaugagauguacugggucuccaaugccucuggaaacaucgugagcuccguuaauaugauuucucgcaugcucaucaaccgguuuaccaugagacacaaaaaggcuacauaugaaccugacguggaucuuggcagcgggacccgcaacauuggaaucgaguccgagauucccaaucuggacaucaucggcaagcggauugagaagaucaaggaggaacaugagacgucuuggcacuacgaucaggaccacccguauaaaaccugggccuaccauggcagcuaugaaacaaagcagaccggguccgcgagcucuauggucaacggagugguuagacugcucacaaaaccuugggaugugcugcccaccgucacacagauggccaugaccgacacgacaccuuucggccaacagcgcguguuuaaggagaagguggauacccggacccaggagcccaaagaagggacaaagaaacuuaugaagauuacggcugaguggcuguggaaagaacucggaaagaaaaagaccccuagaauguguacacgcgaggaguucaccagaaagguccgguccaaugccgcucugggcgccaucuuuacagacgaaaacaaauggaaaagcgcucgcgaggccguugaagauucuagauucugggagcugguggacaaagaacggaaucuccaccuggaggggaagugcgagaccuguguguacaacaugaugggaaaaagagaaaagaaacuuggcgaguuuggcaaagcgaaggggucccgggccauuugguacauguggcugggagcucgcuuccucgaauuugaggcccugggcuuccuuaaugaagaucauugguuuagcagagagaacucucuguccggggucgagggagaaggccuccacaaacugggguauauccugcgggacgugagcaagaaagagggcggagcuauguacgccgacgauacagccggcugggacacccgcaucacgcucgaagaucugaagaaugaggaaaugguuaccaaccacauggagggggagcauaagaaacuugcggaagcuauuuucaagcugacauaucagaauaaaguggucagagugcaacggcccaccccgcgcggaacaguuauggacaucauuuccagacgggaucagcgcggcagcgggcaggucggaaccuacggccucaacacguuuacaaauauggaggcccaacugaucagacagauggaaggggagggcgucuucaagaacauucagcaccuuaccgugacagaggaagccgcuguucagaauuggcuggcccgggugggacgcgagagacucucucggauggcuaucagcggcgacgauugcgucgugaaaccucuggacgaucgcuucgccaacgcgcugaccgcccucaacgacauggggaagaucagaaaggauauucaacagugggaacccuccaaaggauggaaugacuggacgcagguccccuuuugcucucaucacuuccaugagcugaucaugaaggauggccgggugcuuguugugccuuguagaaaccaggacgaacugauugggcgcgcucggaucagccaaggagccggcuggucccucagagagaccgcuugccuggggaaaucuuaugcccagauguggagccuuauguacuuucaccgccgggaccugagacucgcggccaaugcuauuuguuccgccgucccgucucacugggugcccacaagccgcaccacaugguccauccaugcuaagcacgaguggaugaccacagaagauaugcugaccguguggaaccggguuuggauuagagagaauccuuggauggaagacaaaacgcccguggagagcugggaagagaucccuuaucugggcaagcgcgaggaucaguggugcggaucucucaucggccugacaucccgggccaccugggcuaagaacauucaggccgcgaucaaucaagucagaagccuuauugggaacgaagaguacaccgacuacaugcccucuaugaaacgcuuccggagagaagaggaagaggccggagugcugugguga

SEQ ID NO: 19682 - RNA, 9876 nt, Artificial Sequence
  derived and/or modified CDS sequence (opt5) from DENV-2__GU131901__SS-prME
agcgccggcaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccagguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucaaagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacagcgggcuggagugcugugggauguuccuucucccccucccaugggcaaggcggaacucgaggacggggccuaucgcauuaaacaaaagggaauccugggcuacucccagaucggcgcugggguguacaaggaaggaaccuuccacacaauguggcaugucaccagaggcgccgugcuuaugcacaaagggaagcggauugagcccuccugggccgauguuaaaaaggaccugaucagcuauggaggcggguggaaacucgagggagaauggaaggagggcgaagaggugcagguccuggcucucgaaccuggcaagaauccgcgcgccgugcagacaaaacccgggcuguuuaagaccaacacgggaaccauuggcgcggugucccuugauuucucuccugggacaagcggaucccccaucauugacaaaaagggcaaaguugucgggcuguacggaaacggcguggugaccagaagcggcgcuuaugucucugccaucgcccaaacagagaaguccaucgaggauaauccugaaauugaggacgauaucuuucggaagcgcagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccucagaaagaauggcaaaaaggugauccaacugagccggaaaacguuugauucugaauacgucaagacacgcaccaacgacugggauuucguggugaccacagacauuuccgagaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaaagagagaaagucgacgccauugauggggaauaccgccuccggggagaggcuagaaagacguuuguggaccuuaugcgcagaggcgaucugccuguuuggcuggccuauaaaguggcggccgaggggaucaacuacgcugaccggcgcugguguuucgauggaaucaagaacaaucagauucucgaagagaacgucgaaguggagaucuggacaaaagagggcgaaagaaagaagcugaaaccccgguggcuugacgcccgcauuuauuccgauccucuggcucucaaggaguuuaaagaguucgccgcugggagaaagucucugacccugaaucucaucacagagaugggccggcuucccaccuucaugacgcagaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaagcagagaaccccucaagacaaccagcuuaccuacguggucaucgcuauucugacagugguugccgccaccauggcuaaugaaaugggcuuucuggagaaaacaaagaaagaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaagggauggccccugagcaaaauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaagcgggccgcugccggcauuaugaaaaauccgacaguugacgggaucaccgugaucgaucucgaccccauuccuuaugaucccaaguuugaaaaacaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaugaagaauaccacaaacacccgcagaggcacaggcaacguuggggagacccugggagagaaauggaagucucggcugaaugcccucggcaaauccgaauuucaaaucuauaaaaagagcgggauucaggagguggaccgcacgcuggccaaagaaggaaucaagagaggcgagacagaucaccaugcugucucucggggguccgccaaacuucgcugguucguggagagaaacaugguuaccccggaaggaaagguggucgaccugggcugcggcagagggggauggagcuacuauuguggcgggcucaaaaaugugcgggaggugaagggacugaccaagggcgggccuggacacgaagaacccauucccaugucuacauacggcuggaaccugguucgccuccagagcggcgucgauguguuuuucaucccucccgaaaaaugcgacacccuucugugugauauuggggaguccucuccuaauccgacaguggaggcgggacggacgcugagaguccucaaccugguugaaaauuggcuuaacaauaacacccaguucugcaucaaggugcugaaucccuacaugccuagcgugaucgagaaaauggaagcccuccaacgcaaguauggcggggcucugguccggaacccccuguccagaaauagcacacaugagauguacuggguguccaacgccucuggaaauauuguuagcuccgugaacaugaucucucgcaugcucauuaaccgguuuaccaugagacacaaaaaggcuacauaugaaccugacgucgaccuuggcagcgggacccgcaauaucggaauugaguccgagauccccaaccuggauauuaucggcaagcggaucgagaagauuaaggaggaacaugagacgucuuggcacuacgaccaggaucacccguauaaaaccugggccuaccauggcagcuaugaaacaaagcagaccggguccgcgagcucuauggugaauggaguugugagacugcucacaaaaccuugggacguccugcccaccgugacacagauggccaugaccgauacgacaccuuucggccaacagcgcguguuuaaggagaaggucgacacccggacccaggagcccaaagaagggacaaagaaacuuaugaagaucacggcugaguggcuguggaaagaacucggaaagaaaaagaccccuagaauguguacacgcgaggaguucaccagaaagguucgguccaacgccgcucugggcgccauuuuuacagaugaaaauaaauggaaaagcgcucgcgaggccguggaagacucuagauucugggagcugguggauaaagaacggaaccuccaccuggaggggaagugcgagaccugugucuacaauaugaugggaaaaagagaaaagaaacuuggcgaguuuggcaaagcgaaggggucccgggccaucugguacauguggcugggagcucgcuuccucgaauuugaggcccugggcuuccuuaacgaagaccauugguuuagcagagaaaauucucuguccgggguggagggagaaggccuccacaaacugggguauauucugcgggauguuagcaagaaagagggcggagcuauguacgccgacgacacagccggcugggauacccgcaucacgcucgaagaccugaagaacgaggaaauggugaccaaucacauggagggggagcauaagaaacuugcggaagcuaucuucaagcugacauaucagaacaaagucgugagaguucaacggcccaccccgcgcggaacagugauggauauuaucuccagacgggaccagcgcggcagcgggcaggucggaaccuacggccucaauacguuuacaaacauggaggcccaacugauuagacagauggaaggggagggcguguucaagaauauccagcaccuuaccguuacagaggaagccgcugugcagaacuggcuggcccgggucggacgcgagagacucucucggauggcuauuagcggcgaugacugcguggucaaaccucuggaugaccgcuucgccaacgcgcugaccgcccucaaugauauggggaagaucagaaaggacauccaacagugggaacccuccaaaggauggaacgauuggacgcagguccccuuuugcucucaucacuuccaugagcugauuaugaaggacggccggguucuuguggucccuuguagaaaucaggaugaacugaucgggcgcgcucggauuagccaaggagccggcuggucccucagagagaccgcuugccuggggaaaucuuaugcccagauguggagccuuauguacuuucaccgccgggaccugagacucgcggccaacgcuaucuguuccgccgugccgucucacugggugcccacaagccgcaccacaugguccauucaugcuaagcacgaguggaugaccacagaagacaugcugaccguuuggaaucggguguggaucagagagaacccuuggauggaagauaaaacgcccgucgagagcugggaagagauuccuuaucugggcaagcgcgaggaccaguggugcggaucucucaucggccugacaucccgggccaccugggcuaagaauauccaggccgcgauuaaccaagugagaagccuuaucgggaaugaagaguacaccgauuacaugcccucuaugaaacgcuuccggagagaagaggaagaggccggaguucugugguga

SEQ ID NO: 19683 - RNA, 9876 nt, Artificial Sequence
  derived and/or modified CDS sequence (opt5) from DENV-2__GU131902__SS-prME
agcgccggcaugaucauuaugcugauccccaccgugauggcuuuccaccugaccacgcggaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggcuaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauugccgaguggugcugucgguccugcacgcugccuccgcuuagauaucggggcgaggacggcuguugguacgggauggaaauccgcccccugaaagagaaggaagagaaucucguuaacagccuggugacagcuggacacggccagguggauaauuucucccuggggguccuuggaauggcgcucuuucuggaagagaugcugagaacccgggugggcacaaaacaugccauccuccugguugcugugucuuucgucacccuuauuacagggaacaugagcuuuaaggaccugggaagagugguugugauggucggcgccaccauggccgaugacaucggcaugggggugacguaucucgcucugcuggccgcguucaaaguucgcccuaccuuugcugccggacuucugcuccggaagcugacauccaaggagcucaugaugaccacaauuggcaucgugcugcuuucucaaagcaccauucccgaaacgguccuggagcucacagaugcccuggcucuggggaugauggugcuuaaaaucgugagaaauauggaaaaguaccagcuggccgucaccaucauggcgauucucugcguuccuaacgcugugauccugcagaaugccuggaaaguguccuguacaauucucgccgucgugucuguuagcccccugcuucugaccuccagccagcaaaagaccgacuggaucccucucgcucugacaauuaaaggacugaaccccacggccaucuuccuuaccacacugucucgcaccaauaagaaaagauccuggccgcucaacgaggcuaucauggccgugggcauggucagcauucuggcgucuucccuccugaagaaugacaucccuaugacagggccccuuguggccggaggccugcugaccguuugcuaugugcucacgggccggagcgcugaucuggaacuugagcgcgccacagacgucaagugggaggaucaggcugaaauuucuggguccagcccuauccuguccauuaccaucagcgaggacggaucuaugagcauuaaaaacgaagaggaggaacagacccucacaauccugaucagaaccggccuccuggugauuuccgggcuuuuucccaucucuauuccgaucacagccgccgcuugguaccugugggaggucaagaaacagcgggcgggagugcugugggauguuccuucucccccucccaugggcaaggccgaacucgaggacggggcuuaucgcauuaaacaaaagggaauccugggcuacucccagaucggcgccgggguguacaaggaaggaacguuccacaccauguggcaugucacaagaggcgccgugcuuaugcacaaagggaagcggauugagcccuccugggcugauguuaaaaaggaccugaucagcuauggaggcggguggaaacucgagggagaauggaaggagggcgaagaggugcagguccuggcccucgaaccuggcaagaauccgcgcgcggugcagaccaaacccgggcuguuuaagacaaacaccggaacgauuggcgcugugucccuugauuucucuccugggaccagcggaucccccaucauugacaaaaagggcaaaguugucgggcuguacggaaacggcguggugacaagaagcggcgccuaugucucugccaucgcucaaaccgagaaguccaucgaggauaauccugaaauugaggacgauaucuuucggaagcgcagacugacaauuauggaccuccaccccggggccggaaaaaccaagcgguaccugccugcgaucgugagagaagcuauuaaacgcggccuucggacacugauccucgccccgacgagaguuguggccgcugagauggaagaggcccugcgcgggcuccccauucgguaucagaccccugcuaucagagccgagcauacaggacgcgaaaucgucgaccugaugugucacgcgaccuucaccaugcggcuucugagccccgugagaguuccuaacuacaaucugauuaucauggaugaggcccauuucacagaccccgcuucuauugccgcucgcggcuauaucuccacgcggguggaaaugggggaggccgccggcauuuuuaugaccgcuacaccgccuggaagcagagaucccuucccccaguccaacgcgccuaucaucgacgaggaacgggagauucccgaacgcucuuggaauagcggccacgagugggucaccgauuuuaaggggaaaacagugugguucguuccuuccaucaaggccggaaacgacauugcugccugccucagaaagaauggcaaaaaggugauccaacugagccggaaaaccuuugauucugaauacgucaagacgcgcacaaacgacugggauuucguggugaccaccgacauuuccgagaugggggccaauuuuaaagcugagagagucaucgauccgcggagauguaugaagcccguuauccuuacagacggagaggaacgcgugauucuggccggcccuaugcccgugacccauagcucugcggcucagcggagagggcgcaucggccggaacccuaaaaaugaaaacgaccaguacauuuauaugggagagccccucgaaaaugaugaggacugcgcccacuggaaggaggccaagaugcugcuggauaacaucaauacaccggaaggcauuaucccuagcauguucgagcccgaaagagagaaagucgacgcuauugauggggaauaccgccuccggggagaggccagaaagaccuuuguggaccuuaugcgcagaggcgaucugccuguuuggcuggcguauaaaguggccgcugaggggaucaacuacgccgaccggcgcugguguuucgauggaaucaagaacaaucagauucucgaagagaacgucgaaguggagaucuggacgaaagagggcgaaagaaagaagcugaaaccccgguggcuugacgcucgcauuuauuccgauccucuggcccucaaggaguuuaaagaguucgcugccgggagaaagucucugacacugaaucucaucaccgagaugggccggcuucccacauucaugacccagaagacgagagacgcgcuggauaaccuggccguucuccacaccgcugaagccggaggccgcgcuuacaaucaugcccugagcgagcuuccggagacacuggaaacccuccugcugcucacacuucuggccaccgugacagggggaauuuuucuguuccucauguccggccgggggaucggaaagaugacccugggcaugugcugcaucauuacggcuucuauccuucugugguaugcgcagauucagccucacuggaucgccgcuagcauuauccucgaguuuuuccugaucguccugcucauucccgaacccgagaagcagagaacaccucaagacaaccagcuuaccuacguggucaucgccauucugaccgugguugccgcuacaauggccaaugaaaugggcuuucuggagaaaaccaagaaagaccucgggcugggauccaucgcgacacagcagccggagagcaacauucuugauaucgaccugcgccccgccucugcuuggacgcucuacgccguggcuaccacauucgugaccccuaugcugcggcauuccauugaaaauagcuccgucaacguuucucugacagccaucgcgaaucaagccaccgugcucaugggccuugggaagggauggccccugagcaaaauggauaucggcgugccucugcucgcuauuggguguuauucccaggucaaccccaucacgcugaccgccgcccuucugcuccugguggcccacuacgcuauuaucggaccuggccugcaggccaaggcgacaagagaggcccagaagcgggcugccgcuggcauuaugaaaaauccgaccguugacgggaucacagugaucgaucucgaccccauuccuuaugaucccaaguuugaaaaacaacuuggacaggucaugcugcugauccucugcgugacccagguccugaugaugcgcacgacaugggcccuuugugaggcccugacccucgcgacaggcccuauuucuacccugugggaagggaaccccggaagauucuggaauaccacaaucgcugugagcauggccaacauuuuucggggcuccuaccuggcuggggccggacuccuuuucagcaucaugaagaauacgaccaacacacgcagaggcaccggcaacaucggggagacacugggagagaaauggaagucucggcugaaugcccucggcaaauccgaauuucaaauuuauaaaaagagcgggauccaggagguugaccgcacccuggcuaaagaaggaauuaagagaggcgagacggaucaccaugccgugucucggggguccgcgaaacuucgcugguucgucgagagaaacauggugacaccggaaggaaagguuguggaccugggcugcggcagagggggauggagcuacuauuguggcgggcucaaaaauguccgggaggugaagggacugaccaagggcgggccuggacacgaagaacccauccccaugucuaccuacggcuggaaccuggugcgccuccagagcggcguugaugucuuuuucauuccucccgaaaaaugcgacacacuucugugugauaucggggaguccucuccuaauccgaccguggaggccggacggacacugagagugcucaaccuggucgaaaauuggcuuaacaauaacacgcaguucugcaucaagguucugaaucccuacaugccuagcgugauugagaaaauggaagcucuccaacgcaaguauggcggggcccuggugcggaacccccuguccagaaauagcacccaugagauguacugggucuccaacgcuucuggaaauaucgugagcuccguuaacaugauuucucgcaugcucaucaaccgguuuacaaugagacacaaaaaggccaccuaugaaccugacguggaccuuggcagcgggacacgcaauauuggaaucgaguccgagauucccaaccuggauaucaucggcaagcggauugagaagaucaaggaggaacaugagaccucuuggcacuacgaccaggaucacccguauaaaacgugggcguaccauggcagcuaugaaaccaagcagacaggguccgccagcucuauggucaauggagugguuagacugcucaccaaaccuugggacgugcugcccacagucacccagauggcuaugacagauaccacgccuuucggccaacagcgcguguuuaaggagaagguggacacacggacccaggagcccaaagaagggaccaagaaacuuaugaagauuacagccgaguggcuguggaaagaacucggaaagaaaaagacgccuagaauguguacccgcgaggaguucacaagaaagguccgguccaacgcugcccugggcgcuaucuuuaccgaugaaaauaaauggaaaagcgcccgcgaggcgguugaagacucuagauucugggagcugguggauaaagaacggaaccuccaccuggaggggaagugcgagacauguguguacaauaugaugggaaaaagagaaaagaaacuuggcgaguuuggcaaagccaaggggucccgggcuauuugguacauguggcugggagcccgcuuccucgaauuugaggcucugggcuuccuuaacgaagaccauugguuuagcagagaaaauucucuguccggggucgagggagaaggccuccacaaacugggguauauccugcgggaugugagcaagaaagagggcggagccauguacgccgacgacaccgcgggcugggauacacgcaucacccucgaagaccugaagaacgaggaaaugguuacgaaucacauggagggggagcauaagaaacuugcugaagccauuuucaagcugaccuaucagaacaaaguggucagagugcaacggcccacaccgcgcggaaccguuauggauaucauuuccagacgggaccagcgcggcagcgggcaggucggaacauacggccucaauaccuuuacgaacauggaggcccaacugaucagacagauggaaggggagggcgucuucaagaauauucagcaccuuacagugaccgaggaagcugccguucagaacuggcuggcucgggugggacgcgagagacucucucggauggccaucagcggcgaugacugcgucgugaaaccucuggaugaccgcuucgcgaacgcccugacagcucucaaugauauggggaagaucagaaaggacauucaacagugggaacccuccaaaggauggaacgauuggacccagguccccuuuugcucucaucacuuccaugagcugaucaugaaggacggccgggugcuuguugugccuuguagaaaucaggaugaacugauugggcgcgcccggaucagccaaggagcuggcuggucccucagagagacggccugccuggggaaaucuuaugcgcagauguggagccuuauguacuuucaccgccgggaccugagacucgccgcuaacgccauuuguuccgcugucccgucucacugggugcccaccagccgcacaaccugguccauccaugccaagcacgaguggaugacaaccgaagacaugcugacaguguggaaucggguuuggauuagagagaacccuuggauggaagauaaaacccccguggagagcugggaagagaucccuuaucugggcaagcgcgaggaccaguggugcggaucucucaucggccugacgucccgggcuacaugggccaagaauauucaggcggccaucaaccaagucagaagccuuauugggaaugaagaguacaccgauuacaugcccucuaugaaacgcuuccggagagaagaggaagaggcuggagugcugugguga

SEQ ID NO: 19684 - RNA, 9876 nt, Artificial Sequence
  derived and/or modified CDS sequence (opt5) from DENV-2__GU131924__SS-prME
agcgccggaaugaucauuaugcugauccccaccgugauggcuuuccaccugacaacgcggaauggggagccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucggcggggucuuuacauccaucgggaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccagguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucaaagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacagcgggcuggagugcugugggauguuccuucucccccucccaugggcaaggcggaacucgaggacggggccuaucgcauuaaacaaaagggaauccugggcuacucccagaucggcgcugggguguacaaggaaggaaccuuccacacaauguggcaugucaccagaggcgccgugcuuaugcacaaagggaagcggauugagcccuccugggccgauguuaaaaaggaccugaucagcuauggaggcggguggaaacucgagggagaauggaaggagggcgaagaggugcagguccuggcucucgaaccuggcaagaauccgcgcgccgugcagacaaaacccgggcuguuuaagaccaacacgggaaccauuggcgcggugucccuugauuucucuccugggacaagcggaucccccaucauugacaaaaagggcaaaguugucgggcuguacggaaacggcguggugaccagaagcggcgcuuaugucucugccaucgcccaaacagagaaguccaucgaggauaauccugaaauugaggacgauaucuuucggaagcgcagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccucagaaagaauggcaaaaaggugauccaacugagccggaaaacguuugauucugaauacgucaagacacgcaccaacgacugggauuucguggugaccacagacauuuccgagaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaaagagagaaagucgacgccauugauggggaauaccgccuccggggagaggcuagaaagacguuuguggaccuuaugcgcagaggcgaucugccuguuuggcuggccuauaaaguggcggccgaggggaucaacuacgcugaccggcgcugguguuucgauggaaucaagaacaaucagauucucgaagagaacgucgaaguggagaucuggacaaaagagggcgaaagaaagaagcugaaaccccgguggcuugacgcccgcauuuauuccgauccucuggcucucaaggaguuuaaagaguucgccgcugggagaaagucucugacccugaaucucaucacagagaugggccggcuucccaccuucaugacgcagaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaagcagagaaccccucaagacaaccagcuuaccuacguggucaucgcuauucugacagugguugccgccaccauggcuaaugaaaugggcuuucuggagaaaacaaagaaagaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaagggauggccccugagcaaaauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaagcgggccgcugccggcauuaugaaaaauccgacaguugacgggaucaccgugaucgaucucgaccccauuccuuaugaucccaaguuugaaaaacaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaagaaaaauaccacaaacacccgcagaggcacaggcaacaucggggagacccugggagagaaguggaaaucucggcugaaugcccucggcaaguccgaauuucaaauuuauaagaaaagcgggauccaggagguugaccgcacgcuggccaaggaaggaauuaaaagaggcgagacagaucaccaugcugugucucggggguccgccaaacuucgcugguucgucgagagaaacauggugaccccggaaggaaaaguuguggaccugggcugcggcagagggggauggagcuacuauuguggcgggcucaagaauguccgggaggugaagggacugaccaaaggcgggccuggacacgaggaacccauccccaugucuacauacggcuggaaccuggugcgccuccagagcggcguugaugucuuuuucauuccucccgaaaagugcgacacccuucugugugauaucggggaguccucuccuaauccgacaguggaggcgggacggacgcugagagugcucaaccuggucgaaaauuggcuuaacaauaacacccaguucugcaucaaaguucugaaucccuacaugccuagcgugauugagaagauggaagcccuccaacgcaaauauggcggggcucuggugcggaacccccuguccagaaauagcacacaugagauguacugggucuccaacgccucuggaaauaucgugagcuccguuaacaugauuucucgcaugcucaucaaccgguuuaccaugagacacaagaaggcuacauaugaaccugacguggaccuuggcagcgggacccgcaauauuggaaucgaguccgagauucccaaccuggauaucaucggcaaacggauugaaaagaucaaagaggaacaugagacgucuuggcacuacgaccaggaucacccguauaagaccugggccuaccauggcagcuaugaaacaaaacagaccggguccgcgagcucuauggucaauggagugguuagacugcucacaaagccuugggacgugcugcccaccgucacacagauggccaugaccgauacgacaccuuucggccaacagcgcguguuuaaggagaaaguggacacccggacccaggagcccaaggaagggaccaagaaacuuaugaaaauuacggcugaguggcuguggaaggaacucggcaagaagaagaccccuagaauguguacacgcgaggaguucaccagaaaaguccgguccaacgccgcucugggcgccaucuuuacagaugaaaauaaguggaaaagcgcucgcgaggccguugaagacucuagauucugggagcugguggauaaggaacggaaccuccaccuggaggggaaaugcgagaccuguguguacaauaugaugggaaagagagaaaagaaacuuggcgaguuuggcaaggcgaaagggucccgggccauuugguacauguggcugggagcucgcuuccucgaauuugaggcccugggcuuccuuaacgaagaccauugguuuagcagagaaaauucucuguccggggucgagggagaaggccuccacaagcugggguauauccugcgggaugugagcaaaaaggagggcggagcuauguacgccgacgacacagccggcugggauacccgcaucacgcucgaagaccugaagaacgaggaaauuguuaccaaucacauggagggggagcauaagaaacuugcggaagcuaucuucaaacugacauaucagaacaaaguggucagagugcaacggcccaccccgcgcggaacaguuauggauauuaucuccagacgggaccagcgcggcagcggacaggugggaaccuacggccucaauacguuuacaaacauggaggcccaacugauuagacagauggaaggggagggcgucuucaaaaauauccagcaccuuaccgugacagaggaagccgcuguucagaacuggcuggcccgggugggacgcgagagacucucucggauggcuaucagcggcgaugacugcgucgugaagccucuggaugaccgcuucgccaacgcgcugaccgcccucaaugauauggggaagauuagaaaagacauccaacagugggaacccuccaagggauggaacgauuggacgcagguccccuuuugcucucaucacuuccaugagcugauuaugaaagacggccgggugcuuguugugccuuguagaaaucaggaugaacugaucgggcgcgcucggauuagccaaggagccggcuggucccucagagagaccgcuugccuggggaagucuuaugcccagauguggagccuuauguacuuucaccgccgggaccugagacucgcggccaacgcuaucuguuccgccgucccgucucacugggugcccacaagccgcaccacaugguccauucaugcuaaacacgaguggaugaccacagaagacaugcugaccguguggaaucggguuuggaucagagagaacccuuggauggaagauaagacgcccguggagagcugggaagagaucccuuaucugggcaagcgcgaggaccaguggugcggaucucucauuggccugacaucccgggccaccugggcuaaaaauauccaggccgcgauuaaccaagucagaagccuuaucgggaaugaagaguacaccgauuacaugcccucuaugaagcgcuuccggagagaagaggaagaggccggagugcugugguga

SEQ ID NO: 19685 - RNA, 9876 nt, Artificial Sequence
  derived and/or modified CDS sequence (opt5) from DENV-2__GQ868638__SS-prME
agcgccggaaugaucauuaugcugauccccaccgugauggcuuuccaccucaccacgagaaacggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcagggauccaauuggauucagaaagagacccuggucacauucaagaacccucaugcuaaaaagcaagacgugguugugcucggcagccaggaaggggccaugcacaccgcccugacgggcgcuacagagauccagauguccucuggaaaucuucuguuuaccggccaucucaaaugccgccugagaauggacaaacuucaacugaaggggaugagcuacuccauguguacaggaaaauucaaggucgugaaagaaauugcggagacccagcacggcaccaucgucauucggcuccaguaugagggggauggaagccccugcaagauccccuucgaaaucauggaccuggagaaaagauacgugcugggccgccucauuacaguuaacccuaucgugacggaaaaggauucuccggucaacauugaggccgaacccccuuuuggggacuccuacaucauuaucggcguggagcccggacagcugaaacuuaauugguucaaaaagggcagcucuauugggcaaauguuugagaccacaaugcggggagcuaaaagaauggccauccugggcgauaccgccugggacuucgggagccucggaggcguuuuuacauccguggggaaggcucugcaucagaucuucggcgccauuuauggagcggcuuuuucuggcgucagcuggaccaugaaaauccugauuggggugaucauuacguggaucggaaugaacucccgcagcacaucucuuuccgugagccucguucuggucggcaucgugacccuguaccucggggugaugguccaggccgauucuggaugugugguuuccuggaagaauaaggaacugaaaugcggcagcgggauuuucaucaccgacaacgugcacacauggaccgagcaguauaaguuucaaccugaaucccccucuaaacuugccagcgcuauucagaaggcccaggaggaaggcaucuguggcauucgguccgucacaagacuggagaaucucauguggaaacagaucacgccggagcugaaccacauccuggcugaaaaugaggugaaacuuaccauuaugacaggcgauaucaaagggauuaugcaagccggaaagcgcucucuccggccucagcccaccgaacugaaguacagcuggaaaacauggggcaaggcgaaaaugcuguccaccgagagccauaaccagacguuccucaucgacgggccugaaaccgccgagugccccaauacaaacagagcuuggaacucucuggagguugaagauuauggauuuggcguguucaccacaaacauuuggcuuaagcugaaagagaagcaggacgccuuuugugacuccaagcucaugagcgcugccaucaaagauaaucgcgcgguccacgccgacaugggcuacuggaucgaaucugcucugaacgauaccuggaagauugagaaagccuccuucaucgaggugaagaauugccauuggccuaaaagccacacacuguggucuaacgggguucuugaaagcgagaugauuauccccaagaaccucgcuggaccggugucccaacacaauuaucggccuggcuaccauacccagacggccgggcccuggcaccugggaaagcuggaaauggacuucgauuuuugugacggcacaaccgucauugugaccgaggauugcgggaacagaggacccagccuccgcacaaccacggccucuggcaaacugaucacagaauggugcugucgguccugcacccuuccuccgcugagauaccggggcgaggacggguguugguauggaauggagauucgcccccucaaggaaaaagaggaaaaucuggugaacagccuggucacagcuggccaugggcagguugauaauuucucccuuggagugcucggcauggcgcuguuucuggaggaaaugcucagaacccggguggggacaaagcacgccauccugcuugucgcugugucuuucguuacccugaucacgggaaacaugagcuuuaaagaccucggcagaguggucgugaugguuggcgccaccaugacagaugacauugggaugggagugaccuaccuggcccugcuugcugccuucaagguccgcccuacauuugcggcuggccugcuccugcggaagcucaccuccaaagagcugaugaugacgacaaucgggauugugcuucugucucaaagcaccauccccgagacaauucucgaacugaccgaugcccuggcccuuggaaugaugguucugaagaucgugagagacauggagaaauaucagcucgcugucaccaucauggccauucugugcgugccuaaugcggugauccuccagaacgcuuggaaggucuccuguacaauucuggccguugugucugugagcccccuucugcucacguccagccagcagaagaccgacuggaucccucuggcccugacaauuaagggccuuaaucccaccgcuaucuuccugacaacccucucucgcacgaacaaaaagagauccuggccgcugaaugaagccaucauggcugucgggauggugagcauucucgccucuucccugcuuaagaacgauaucccuaugacaggaccccugguugcgggcggccugcucaccgugugcuacguccugaccgggcggagcgccgaccuugagcuggaacgcgcuacagaugugaaaugggaggaccaggccgagauuucuggauccagcccuauccucuccauuaccaucagcgaagauggcucuaugagcauuaagaaugaggaagaggagcagacacugacgauccucaucagaaccgggcugcuuguuauuuccggacuguuucccgugucuaucccgauuacagcugccgccugguaucugugggaagucaaaaagcagcgggcuggcgugcucugggacgucccuucucccccucccauggggaaagcggagcuggaagauggagccuaccgcaucaagcaaaagggcauucuuggcuauucccagaucggggcuggaguguacaaagagggcaccuuccauacaauguggcacguuaccagaggggccgugcugaugcacaagggaaaacggaucgaacccuccugggccgacgucaagaaagaucucauuagcuacggcgggggauggaagcuggagggcgaguggaaggaaggcgaggaagugcagguucucgcucuggagccugggaaaaacccgcgcgccgugcagacgaagcccggacuuuuuaaaaccaauacaggcaccaucggggcggucucccuggacuucucuccuggaacaagcggcucccccauuaucgauaagaaagggaagguggugggacuguauggcaacggcguugucaccagaagcggggcuuacgugucugccauugcccaaacagaaaaguccaucgaggacaacccugagaucgaagaugacauuuuucggaaacgcagacucacgaucauggaccugcaucccggagcuggcaagaccaaacgguaucuuccugccauugugagagaggcgaucaagcgcgggcugcggacacucauucuggcuccgaccagagucguggccgccgaaauggaggaagcucuccgcggacugcccauccgguaccagaccccugccauuagagcugagcacacaggccgcgagaucguugaucuuaugugucaugccacguucaccaugcggcugcugagccccgugagagucccuaauuauaaccucaucauuauggacgaagcgcacuucacagaucccgccucuaucgcugcccgcggguacauuuccacccggguggagaugggcgaagcugccggaaucuuuaugacagccaccccgccuggcagcagagaccccuucccccaguccaaugcuccuauuaucgaugaggagcgggaaauccccgagcgcucuuggaacagcgggcaugaauggguuacggacuuuaaaggaaagacagugugguucgucccuuccauuaaggcgggcaaugauaucgccgcuugccugcgcaagaaugggaagaaagugauucaacuuagccggaagaccuuugacucugaguauguuaaaacccgcacaaaugauugggacuucguggucaccacagauaucuccgaaaugggagccaacuuuaaggccgacagagugauugacccgcggagauguaugaaacccgugauccugaccgauggcgaggagcgcgucauccucgcugggccuaugcccguuacgcacagcucugccgcgcagcggagaggccgcauuggacggaauccuaagaacgaaaaugaccaguacaucuacaugggcgagccccuggaaaacgaugaggacugcgcucacuggaaggaagccaaaaugcugcucgauaauauuaacacaccggaggggaucauuccuagcauguucgagcccgaaagagagaagguggacgccaucgauggagaauaucgccuucggggcgaggcuagaaaaaccuuuguggaccugaugcgcagaggggaucugccugucuggcucgccuacaagguggcggccgaaggaauuaauuaugcugaccggcgcugguguuucgauggcaucaaaaacaaccagauccuggaggagaauguugaaguggagauuuggacaaaggaaggggagagaaagaaacuuaagccccgguggcuggacgcccgcaucuacuccgauccucucgcucugaaagaguuuaaggaguucgccgcuggcagaaaaucucugacccucaaccuuauuacggagaugggacggcugcccaccuucaugacacaaaagaccagagacgcccuggacaaucucgcgguccugcauacagccgaagcuggcgggcgcgccuauaaccacgcucuuagcgagcugccggaaacccucgagacacugcugcuccuuacccugcuggccacggugacaggaggcaucuuucucuuccugauguccgggcggggaauuggcaagaugacccuuggcaugugcugcaucaucaccgccucuauucugcucugguacgcucagauccagccucauuggauugcggccagcaucauucuggaguuuuuccugaucguucuccuuauccccgaacccgagaaacagagaacaccucaagauaaucagcugaccuauguggucauugcuauccugacaguggucgccgccacgauggcuaacgaaaugggguuucucgagaagaccaaaaaggaccugggacuuggcuccauugccacacagcagccggaaagcaauauccuggauauugaccuccgccccgcgucugccuggacccuguacgcuguggccacaaccuucguuacgccuaugcugcggcacuccaucgagaacagcuccgugaaugugucucucaccgcuauugccaaccaagcgacaguccuuauggggcugggaaaaggcuggccccugagcaagauggauaucgggguuccucuccuggccaucggauguuacucccaggugaaucccauuacccuuacagcugcccugcuccugcugguggcucacuaugccaucauuggcccuggccuccaggcuaaggccaccagagaggcgcagaaacgggccgcugccgggaucaugaagaacccgacggucgacggaauuacagugaucgaucuugaccccaucccuuacgaucccaaauuugaaaagcaacugggccagguuaugcugcucauucugugcgugacccagguccuuaugaugcgcacaaccugggcucugugugaggcccucacccuggccacagggccuaucucuacgcugugggaaggaaaucccggcagauucuggaacaccacaauugcggugagcauggcuaauaucuuucggggguccuaucucgccggagcuggccuucuguucagcauuaugaaaaacaccacaaauacccgcagaggcacggggaacaucggagagacacugggcgaaaaguggaaaucucggcucaacgcccuggggaaguccgaguuucaaaccuacaagaaaagcggaauccaggaggucgaccgcacccuugccaaggaaggcauuaaaagaggggagacagaucaucacgcugugucucggggauccgccaagcugcgcugguucguugaaagaaauauggugaccccggagggcaaagucguggaccucggcugcgggcggggaggcuggagcuauuacugugggggacugaagaacguuagagaggugaagggccugacaaaagggggaccuggccaugaggaacccauccccaugucuacguauggcuggaaucucguccgccuucagagcgggguggauguguuuuucauuccucccgaaaagugcgacacccugcugugugacaucggagaguccucuccuaacccgacaguugaagcgggccggacccucagaguccugaaucuuguggagaacuggcugaauaacaauacacaguucugcauuaaagugcucaaccccuacaugccuagcgucaucgagaagauggaagcccugcaacgcaaauacgggggagcucugguucggaauccccucuccagaaacagcacccacgagauguauuggguguccaaugccucuggcaacaucgugagcuccgucaauaugauuucucgcaugcuuaucaaccgguuuacgaugagacauaagaaggcuaccuacgaaccugauguggaccuggggagcggaacacgcaacauuggcaucgaguccgaaauucccaaucuggauaucauuggcaaacggaucgagaagaucaaacaggagcacgaaaccucuuggcacuaugaccaggaucauccguacaagacaugggccuaucacgggagcuacgagaccaaacagacaggauccgcgagcucuaugguuaacggcguggucagacuccugaccaagccuugggacgugcuucccacgguuacacaaauggccaugaccgauaccacaccuuucgggcagcagcgcguguuuaaggaaaaagucgacacgcgggcucaggagcccaaggaaggaaccaaaaagcugaugaaaauuacagccgaguggcucuggaaggagcugggcaaaaagaagaccccuagaauguguacacgcgaagaguucaccagaaaagugcgguccaaugcugcccugggggcuaucuuuacagaugaaaacaaguggaaaagcgcccgcgaggcgguggaggacucuagauucugggaacucgucgauaaggagcggaaucugcaucuugaaggaaaaugcgagaccuguguuuauaacaugaugggcaagagagaaaagaaacugggcgaguuugggaaggccaaaggaucccgggcuauuugguacauguggcucggcgcccgcuuccuggaguuugaagcucuuggguuccugaaugaggaccacugguuuagcagagaaaacucucucuccggaguggagggcgaagggcugcacaagcugggcuacauccuccgggacgugagcaaaaaggagggaggcgccauguaugccgaugacacggcggggugggauacccgcauuacacuggaggaccuuaagaaugaagagauggucaccaaccauauggaaggagagcacaaaaagcuggcugaagccaucuucaaacucacauaccaaaauaaggugguuagagugcagcggcccaccccgcgcggcacggucauggauaucauuuccagacgggaccagcgcgggagcggacaagugggcacauaugggcugaacaccuuuacaaauauggaggcccagcuuaucagacagauggagggcgaaggaguuuuccggaacauucagcaucugaccgcuacggaggaaguggccguccaaaauuggcucgcucgcgugggcagagagcggcugucucgcauggccaucagcggggaugacugcguugugaaaccucuggaugacagauucgcgaacgcccucaccgcucugaacgauaugggaaagauucggaaggacauccagcagugggagcccuccaaaggcuggaaugauuggacacagguccccuuuugcucucaccauuuccacgaacuuaucaugaaggacgggagagugcuggucgugccuugucgcaaccaagacgagcucauuggacgggccagaaucagccagggcgcuggguggucccugcgcgaaaccgccugccuuggcaaaucuuacgcgcagauguggagccugauguauuuucaccggagagaucuccgccuggccgcuaaugccauuuguuccgcuguuccgucucauugggugcccacaagccggaccacaugguccauccacgccaagcaugaguggaugaccacggaagacaugcugacagucuggaacagaguguggauucgcgagaauccuuggauggaggauaaaacccccguggaaagcugggaggaaaucccuuaccucggaaagcgggaggaccaguggugcggcucucugauugggcuuaccuccagagcuacaugggccaagaacauccaagcggccaucaaucagguucgcagccugauuggaaacgaagaguauaccgauuacaugcccucuaugaaacgguucagacgggaggaagaggaagcuggcgugcucugguga

SEQ ID NO: 19686 - RNA, 9876 nt, Artificial Sequence
  derived and/or modified CDS sequence (opt5) from DENV-2__GU131927__SS-prME
uccgcuggaaugaucauuaugcugauccccaccgugauggcuuuccaccugacaacgagaaauggggaaccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuuccgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggcccgcaauaagcccacccuggauuucgaacuuauuaagacagaggcuaaacagccugccacccugagaaaguauugcaucgaagcuaaacucacgaacacaaccaccgagucucgguguccgacacaaggagagcccucccugaaggaagaacaagacaaacgcuuugucugcaagcauagcaugguggauagaggcuggggcaauggguguggacuguucggcaaagggggaauugugaccugcgccauguuuacaugcaaaaagaacauggaaggcaaaaucguccagccugagaaucucgaauacacgauuguugugacaccccacucuggggaggagcaugcggugggaaacgacacaggcaagcacggcaaagaaaucaaggucaccccucaguccagcaucacagaggccgaacugaccggguauggaacggugaccauggaguguucuccccggacaggccuugauuucaaugaaaugguucugcuccaaauggagaacaaggcuuggcuggugcaccgccagugguuucuugaccugccgcucccuuggcugcccggggccgauaagcaggaguccaauuggauucagaaggaaacccuggucacauucaaaaacccucaugcuaagaaacaagacgugguugugcucggaagccaggagggcgccaugcacaccgcccugacgggggcuacagaaauccagauguccucuggcaaucuucuguuuaccggacaucucaagugcagacugcggauggacaaacuucaacugaagggcaugagcuacuccauguguacagggaaguucaaagucgugaaggagauugcggagacccagcacggaaccaucgucauuagagugcaguaugaaggcgaugggagccccugcaaaauccccuucgagaucauggaccucgaaaagcgcuacguucugggacggcugauuacagugaacccuaucgucacggagaaagauucuccggugaacauugaagccgagcccccuuuuggcgacuccuacaucauuaucgggguugagcccggccagcucaagcugaauugguucaagaaaggaagcucuauuggccaaauguuugaaaccacaaugagaggggcuaagcgcauggccauccuuggagauaccgccugggacuucggcagccucgggggaguguuuacauccgucggcaaagcucuccaucagguguucggggccaucuauggcgcggcuuuuucuggagugagcuggaccaugaagauucugaucggcguuauuaucacguggauugggaugaacucccggagcacaucucuguccgucagccuugugcucgugggaaucgucacccuguaccugggcgugaugguucaggccgauucuggguguguggucuccuggaaaaauaaggagcucaagugcggaagcggcaucuucauuaccgacaacgugcacacauggaccgaacaguauaaauuucaaccugagucccccucuaagcuggccagcgcuauccagaaagcccaggaagaggggauuuguggcaucagauccguuacacgccuugagaaucugauguggaagcagauuacgccggaacucaaccacauccuggcugagaaugaagugaaacugaccaucaugacaggagauauuaagggcaucaugcaagccgggcggagaucucuucgcccucagcccaccgagcucaaauacagcuggaagacauggggaaaggcgaaaaugcuguccaccgaaagcuauaaccagacguuccugauugacggcccugagaccacagagugccccaaugccaaccgggcuuggaacucucucgaagucgaggauuacggguuuggaguguucaccacaaacaucuggcugaaacuuaaagaaaagcaggacgccuuuugugacuccaaacugaugagcgcugccauuaaggauaauagagcgguucaugccgacaugggcuauuggaucgagucugcucucaacgauaccuggaagaucgagaaagccuccuucauugaagugaagaauugccacuggccuaaaagccauacacuguggucuaacggcguccuggagagcgaaaugaucauucccaagucccuugcugggccggugagccaacacaacuaccgcccuggauaccacacccagaucgccggccccuggcaucucgggaaacuggagauggacuucgauuuuugugacggaacgacagugauugucaccgaagauugcggcaaucgggggcccucucugagaaccacaaccgccuccggaaagcucaucacggaguggugcugucggagcugcacacugccuccgcuucgcuauagaggcgaggacggcuguugguacgggauggaaauucggccccugaaggagaaagaagagaaccucguuaauucccuggugaccgcuggacacggccagguggauaacuucucucuggggguccuuggaauggcgcucuuucuggaagagaugcugagaacacgcgugggcaccaagcaugccauccuccugguugcugugagcuucgucacacuuaucaccgggaauauguccuuuaaagaccugggacgggugguugugauggucggcgccacgauggccgaugacauuggcaugggggugaccuaucucgcucugcuggccgcguucaagguuagaccuacauuugcugccggacuucugcuccgcaaacugaccucuaaggagcucaugaugacaaccaucggcauugugcugcuuagccaauccacgauccccgaaacaauucuggagcucaccgaugcccuggcucuggggaugaugguccuuaagaucgugagaaacauggaaaaauaccagcuggccgugacaaucauggcgauucucugcgucccuaaugcuguuauccugcagaacgccuggaaggugucuuguaccauucucgccguggucagcgugagcccccugcuucugaccagcucucagcagaagacggacuggaucccucucgcucugacgauuaagggacugaaucccaccgccaucuuccuuacaacccugucccggacaaacaaaaagcgcagcuggccgcucaaugaggcuaucauggccguuggcauggugucuauucuggcguccagccuccugaaaaacgacaucccuaugaccgggccccuugucgccggaggccugcugacggugugcuauguucucacaggcagaucugcugaucuggaacuugagcgggccaccgacgugaagugggaggaacaggcugagauuuccgggagcuccccuauccugagcauuaccaucucugaagauggaagcauguccauuaagaaugaggaggaggaacagacacucaccauccugauccgcacaggccuccuggucauuucugggcuuuuucccaucagcauuccgaucacggccgccgcuugguaccugugggaagugaaaaagcagagagcgggaguccugugggacgugccuucucccccucccaugggcaaagccgagcucgaagauggggcuuaucggauuaagcaaaaaggaauccugggcuacagccagaucggcgccgggguuuacaaggagggaaccuuccacacaauguggcaugugacccgcggcgccguccuuaugcacaaggggaaaagaauugagcccagcugggcugacgugaagaaagaucugaucuccuauggaggcggguggaagcucgaaggagaguggaaagaaggcgaggaaguucaggugcuggcccucgagccuggcaagaacccgcgggcgguccagacaaagcccgggcuguuuaaaaccaauacgggaaccauuggcgcugugucucuugacuucagcccugggacauccggaagccccaucauugauaagaaaggcaaggugguugggcuguacggaaacggcgucgugacccgcucuggcgccuauguguccgccaucgcucaaacagagaaaagcaccgaagacaacccugagaucgaagaugacauuuuuagaaagcggagacugacaaucauggaucuccaccccggggccggaaagacgaaacgcuaccugccugcgauuguccgggaggcuaucaagagaggccuucgcacccugauucucgccccgacacgggugguugccgcugaaauggaggaggcccugagagggcuccccauccgcuaucagaccccugcuauucgggccgaacauaccggaagagagaucguggaccugaugugucacgcgacauucacgaugcgccuucugucucccguccgggugccuaauuacaaccugaucauuauggacgaagcccauuucaccgaucccgcuuccaucgccgcuagaggcuauauuagcacacggguugagaugggggaggccgccggcaucuuuaugaccgcuacaccgccuggaucccgcgaccccuucccccagucuaaugcgccuauuaucgaugaagagagagaaauccccgagcggagcuggaacuccggccacgaaugggugaccgacuuuaaagggaagacggucugguucgugccuagcauuaaagccggaaaugauaucgcugccugccuccgcaagaacggcaagaaaguuauucaacugucuagaaagacauuugacuccgaguacgugaaaacccggaccaaugauugggacuucgucgugacaaccgauaucagcgagaugggggccaacuuuaaggcugaaagagugauugacccgcgccgguguaugaaacccgucauccuuacagauggagaggaaagaguuauccuggccggcccuaugcccgugacccauucuagcgcggcucagcgccgggggagaauuggccgcaauccuaagaacgagaaugaccaguacaucuauaugggagaaccccucgagaacgacgaggauugcgcccacuggaaagaagccaagaugcugcuggacaauauuaacacgccggagggcaucauuccuuccauguucgaacccgagcgggaaaagguggaugcuaucgacggggaguacagacuccgcggagaggccagaaaaacauuugucgaucuuaugcggcgcggcgaccugccuguguggcuggcguauaagguugccgcugaagggauuaauuacgccgauagacggugguguuucgacggaaucaaaaacaaccagauccucgaggaaaauguggaggucgagauuuggaccaaggaaggcgagcgcaaaaagcugaagcccagauggcuugaugcucggaucuauucugacccucuggcccucaaagaauuuaaggaguucgcugccgggagaaaaagccugacacugaaccucauuaccgaaaugggccgccuucccacguucaugacccaaaagacacgggaugcgcuggacaaucuggccgugcuccacaccgcugaggccggaggcagagcuuacaaccaugcccuguccgagcuuccggaaacacuggagacccuccugcugcucacacuucuggccaccguuacagggggaaucuuucuguuccucaugucuggccgcgggauuggaaaaaugacacugggcaugugcugcaucaucaccgcuagcauucuucugugguaugcgcagauccagccucacuggauugccgcuuccaucauucucgaauuuuuccugaucgugcugcucauccccgagcccgaaaagcagcggaccccucaagauaaucagcuuacauacgucgugauugccauccugaccgucguggccgcuacaauggccaacgagaugggcuuucuggagaagacgaaaaaggaccucgggcugggaagcauugcgacccagcagccggaaucuaauauccuugacauugaucugagacccgccuccgcuuggacacucuacgccguugcuaccacauucaucaccccuaugcugcggcauagcauugagaacuccucugugaauacgagccugaccgccaucgcgaaccaagccacagugcucaugggccuugggaaaggauggccccuguccaagauggacaucggcgucccucugcucgcuauuggguguuauucucagguuaaucccaucacccugacagccgcccuucugcuccugguggcccacuacgcuauuaucggaccuggccugcaggccaaagcgacccgcgaagcccagaagagagcugccgcuggcauuaugaagaacccgacgguggaugggaucacagucaucgaccucgaucccauuccuuaugaccccaaauuugagaagcaacuuggacaggugaugcugcugauccucugcguuacccaggugcugaugaugcggacaaccugggcccuuugugaagcccugacccucgcgacaggcccuauuagcacgcugugggaggggaaucccggacgcuucuggaacaccacaaucgcugucuccauggccaauauuuuuagaggcagcuaccuggcuggggccggacuccuuuucucuaucaugaaaaacaccacaaauacccggcgcggcacgggcaacaucggggagacacugggagaaaaguggaaauccagacugaacgcccucggcaagagcgaguuucaaauuuauaaaaagucugggauccaggaaguggaucggacccuggcuaaggagggaauuaaacgcggcgagaccgaccaccaugccgucuccagagggagcgcgaaacuucggugguucguggaaagaaauaugguuacaccggagggaaaaguggucgaucugggcugcggccgcgggggauggucuuacuauuguggcgggcucaagaacgugaaagaaguuaagggacugaccaagggcgggccuggacacgaggaacccauccccaugagcacauacggcuggaaucuggugcggcuccaguccggcgucgacguguuuuucauuccucccgagaaaugcgauacgcuucugugugacaucggggagucuagcccuaacccgaccguggaagccggaagaacacugcgcguucucaaucuggucgagaacuggcuuaauaacaauacccaguucugcaucaaggugcugaaccccuacaugccuuccgugauugagaagauggaggcucuccaacggaaguauggcggggcccuggucagaaauccccugagccgcaacuccacacaugaaauguacuggguuucuaaugcuagcggaaacaucguguccucugugaauaugauuagccggaugcucaucaacagauuuaccaugcgccacaaaaaggccacguaugagccugaugucgaccuuggcuccgggacccggaacauuggaaucgagucugaagugcccaaucuggacauuaucggcaagagaaucgagaaaauuaagcaggaacaugagacaagcuggcacuacgaucaggaccacccguauaaaaccugggcguaccauggcuccuaugaaacaacccagacagggagcgccucuuccaugguuaacggagugguccgccugcucaccaagccuugggaugugcugcccacgguuacacaaauggcuaugaccgacaccacaccuuucggccagcagcggguguuuaaagagaaggucgauacgagaacccaggagcccaaggaagggaccaagaaacuuaugaaaaucaccgccgaguggcuguggaaggaacucggcaagaagaaaacaccucgcauguguaccagagaggaguucacacggaaggugcgcagcaaugcugcccugggcgcuauuuuuaccgacgaaaacaaguggaaaucugccagagaggcgguggaagauucccgguucugggagcuggucgacaaggaaagaaaucuccaccuggaggggaaaugcgagacguguguuuacaacaugaugggaaagcgggagaagaaacuuggcgaguuuggcaaagccaaagggagccgcgcuaucugguacauguggcugggagccagauuccucgaauuugaggcucugggcuuccuuaaugaagaucauugguuuucucgggagaacucccugagcgggguggagggagaaggccuccacaagcugggguauauucugcgcgacguguccaaaaaggagggcggagccauguacgccgaugacaccgcgggcugggacacaagaaucacccucgaagaucugaaaaaugaggaaauggucacaaaccacaugaagggggagcauaagaaacuugcugaggccaucuucaagcugaccuaucaaaauaaagugguucgggugcagcgccccacgccgagaggaacagucauggacauuaucagccggcgcgaucagagaggcucugggcaagugggaaccuacggccucaacacauuuaccaauauggaagcccagcugauucggcagauggagggggaaggcguuuucaagaacauccagcaccuuacggugaccgaggaggucgcugugcaaaauuggcuggcccgcguuggaagagaacggcucagccgcauggcuauuuccggcgacgauugcguggucaaaccucuggacgauagauucgccaacgcgcugacagcccucaacgacauggggaagauccggaaggauauccagcagugggagcccucuaaaggauggaaugacuggacccaggugcccuuuugcagccaucacuuccaugaacugauuaugaaggauggcagaguccuugugguuccuugucgcaaccaagacgagcugaucgggcgggcuagaauuucccagggagccggcuggucucuccgcgaaacagcuugccuggggaaaagcuaugcccagauguggucccuuauguacuuucaccggagagaucugcgccucgcggccaaugcuaucuguucugccgugccgagccacuggguccccaccucccggacaaccuggagcauucaugcuaagcacgaguggaugacgacagaggacaugcugaccguguggaacagaguguggauccgcgaaaauccuuggauggaggacaaaacccccguugaaucuugggaggaaauuccuuaucugggcaagcgggaggaucaguggugcggaucccucaucggccugacaagcagagccaccugggcuaagaacauccaagccgcgauuaaucaggugcgcucucuuaucgggaacgaggaauacacagacuacaugcccuccaugaaacgguucagacgggaggaagaggaagccggaguccugugguga

SEQ ID NO: 19687 - RNA, 9876 nt, Artificial Sequence
  derived and/or modified CDS sequence (opt5) from DENV-2__GU131928__SS-prME
agcgccggcaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggcuaagagaauggcuauccuuggagauaccgccugggacuucggcagccucgggggagucuuuacauccaucggcaaagcccuccaucagguguucggggcuauuuauggcguggccuuuucuggaguuagcuggaccaugaagauccugauuggcgucaucauuacguggaucgggaugaacucccgcagcacaucucuguccgugagccuugugcucgucggaaucgugacccuguaccugggcguuauggugcaggcggauucugggugugucguguccuggaaaaauaaggagcucaagugcggaagcggcauuuucaucaccgacaacguucacacauggaccgaacaguauaaauuucaaccugagucccccucuaagcuggcuagcgccauucagaaagcccaggaagaggggaucuguggcauucgguccgugacaagacuugagaaucugauguggaagcagaucacgccggaacucaaccacauccuggcugagaaugaagucaaacugaccauuaugacaggagauaucaagggcauuaugcaagccgggaaacgcucucuucggccucagcccaccgagcucaaguacagcuggaagacauggggaaaagcuaagaugcuguccaccgaaagcuauaaccagacguuccugaucgacggcccugagaccgccgagugccccaauacaaacagagcguggaacucucucgaaguggaggauuacggguuuggaguuuucaccacaaacauuuggcugaaacuuaaggaaaaacaggacgccuuuugugacuccaagcugaugagcgcugccaucaaggauaaucgcgcugugcaugccgacaugggcuauuggaucgagucugcgcucaacgauaccuggaaaauugagaaggccuccuucaucgaagucaaaaauugccacuggccuaagagccauacacuguggucuaacggcgugcuggagagcgaaaugauuauccccaaaaaccuugcugggccggugucccaacacaauuaccggccuggauaccacacccagauugccggccccuggcaucucgggaagcuggagauggacuucgauuuuugugacggaacgacagucaucguuaccgaagauugcggcaacagagggcccagccugcgcaccacaaccgcuucuggaaagcucauuacggaguggugcugucgguccugcacacugccuccgcuuagauaucggggcgaggacggcuguugguacgggauggaaauccgcccccugaaagagaaggaagagaaucucgugaacagccuggugaccgccggacacggccaggucgauaauuucucccugggggugcuuggaauggcccucuuucuggaagagaugcugagaacacggguuggcaccaaacaugcuauccuccugguggcggucucuuucgugacacuuauuaccgggaacaugagcuuuaaggaccugggaagaguuguggucauggugggcgccacgauggcugaugacaucggcauggggguuaccuaucucgcccugcuggccgcuuucaaagugcgcccuacauuugccgcgggacuucugcuccggaagcugaccuccaaggagcucaugaugacaaccauuggcaucguccugcuuucucaaagcacgauucccgaaacagugcuggagcucaccgaugcucuggcccuggggaugauggugcuuaaaaucgucagaaauauggaaaaguaccagcuggccguuacaaucauggcuauucucugcgugccuaacgccgugauccugcagaaugcguggaaagucuccuguaccauucucgcugugguuucugugagcccccugcuucugaccuccagccagcaaaagacagacuggaucccucucgcccugacgauuaaaggacugaaccccaccgccaucuuccuuacaacccugucucgcacaaauaagaaaagauccuggccgcucaacgaggcuaucauggccgucggcauggugagcauucuggcuucuucccuccugaagaaugacaucccuaugaccgggccccuuguugccggaggccugcugacggugugcuauguccucacaggccggagcgcggaucuggaacuugagcgcgccaccgacgugaagugggaggaucaggcugaaauuucuggguccagcccuauccuguccauuaccaucagcgaggacggaucuaugagcauuaaaaacgaagaggaggaacagacacucaccauccugaucagaacaggccuccuggucauuuccgggcuuuuucccaucucuauuccgaucacggccgcugccugguaccugugggaggugaagaaacagcgggccggaguucugugggaugugccuucucccccucccaugggcaaggcugaacucgaggacggggcguaucgcauuaaacaaaagggaauccugggcuacucccagaucggcgccggggucuacaaggaaggaaccuuccacacaauguggcaugugaccagaggcgcuguucuuaugcacaaagggaagcggauugagcccuccugggccgaugugaaaaaggaccugaucagcuauggaggcggguggaaacucgagggagaauggaaggagggcgaagagguccaggugcuggcccucgaaccuggcaagaauccgcgcgcugugcagacaaaacccgggcuguuuaagaccaacacgggaaccauuggcgccguuucccuugauuucucuccugggacaagcggaucccccaucauugacaaaaagggcaaagucguggggcuguacggaaacggcguggucaccagaagcggcgcguaugugucugcuaucgcccaaacagagaaguccaucgaggauaauccugaaauugaggacgauaucuuucggaagcgcagacugaccauuauggaccuccaccccggggccggaaaaacaaagcgguaccugccugcuaucguuagagaagccauuaaacgcggccuucggacgcugauccucgcgccgaccagaguggucgcugccgagauggaagaggcccugcgcgggcuccccauucgguaucagaccccugcuaucagagccgagcauaccggacgcgaaaucguggaccugaugugucacgcuaccuucacaaugcggcuucugagccccguuagagugccuaacuacaaucugauuaucauggaugaggcccauuucacggaccccgcgucuauugccgcucgcggcuauaucuccacccgggucgaaaugggggaggccgcuggcauuuuuaugacagccaccccgccuggaagcagagaucccuucccccaguccaacgccccuaucaucgacgaggaacgggagauucccgaacgcucuuggaauagcggccacgagugggugacagauuuuaaggggaaaaccguuugguucgugccuuccaucaaggcuggaaacgacauugcggccugccucagaaagaauggcaaaaaggucauccaacugagccggaaaacguuugauucugaauacgugaagacacgcaccaacgacugggauuucguggucaccacagacauuuccgagaugggggcuaauuuuaaagccgagagaguuaucgauccgcggagauguaugaagcccgugauccuuaccgacggagaggaacgcgugauucuggccggcccuaugcccgucacacauagcucugcugcccagcggagagggcgcaucggccggaacccuaaaaaugaaaacgaccaguacauuuauaugggagagccccucgaaaaugaugaggacugcgcgcacuggaaggaggcuaagaugcugcuggauaacaucaauaccccggaaggcauuaucccuagcauguucgagcccgaaagagagaaaguggacgccauugauggggaauaccgccuccggggagaggccagaaagacguuuguugaccuuaugcgcagaggcgaucugccuguguggcuggcuuauaaagucgccgcggaggggaucaacuacgccgaccggcgcugguguuucgauggaaucaagaacaaucagauucucgaagagaacguggaaguugagaucuggacaaaagagggcgaaagaaagaagcugaaaccccgguggcuugacgcucgcauuuauuccgauccucuggcccucaaggaguuuaaagaguucgcugccgggagaaagucucugacccugaaucucaucacagagaugggccggcuucccaccuucaugacgcagaagaccagagacgcucuggauaaccuggccgugcuccacacagcggaagccggaggccgcgcuuacaaucaugcccugagcgagcuuccggagacccuggaaacacuccugcugcucacccuucuggcuacagucaccgggggaauuuuucuguuccucauguccggccgggggaucggaaagaugacgcugggcaugugcugcaucauuacagccucuauccuucugugguaugcccagauucagccucacuggaucgcugcgagcauuauccucgaguuuuuccugaucgugcugcucauucccgaacccgagaagcagagaaccccucaagacaaccagcuuaccuacgucgugaucgccauucugacaguuguggcugccaccauggccaaugaaaugggcuuucuggagaaaacaaagaaagaccucgggcugggauccaucgcuacgcagcagccggagagcaacauucuugauaucgaccugcgccccgccucugcguggacccucuacgccguggcuacaaccuucgucacaccuaugcugcggcauuccauugaaaauagcuccguuaacgugucucugaccgccaucgcuaaucaagccacggugcucaugggccuugggaagggauggccccugagcaaaauggauaucggcgucccucugcucgcgauuggguguuauucccaggugaaccccaucacccugacagccgcccuucugcuccugguugcccacuacgcuauuaucggaccuggccugcaggccaaggcuaccagagaggcccagaagcgggcggccgcuggcauuaugaaaaauccgacaguggacgggaucaccgucaucgaucucgaccccauuccuuaugaucccaaguuugaaaaacaacuuggacaggugaugcugcugauccucugcgucacgcagguccugaugaugcgcacaaccugggcccuuugugaggcucugacacucgccaccggcccuauuucuacccugugggaagggaaccccggaagauucuggaauacaacgaucgccguuagcauggcgaacauuuuucggggcuccuaccuggcuggggccggacuccuuuucagcaucaugaagaauaccacaaacacccgcagaggcacaggcaacaucggggagacccugggagagaaauggaagucucggcugaaugcucucggcaaauccgaauuucaaauuuauaaaaagagcgggauccaggagguggaccgcacgcuggccaaagaaggaauuaagagaggcgagacagaucaccaugccgucucucggggguccgcuaaacuucgcugguucguggagagaaacaugguuaccccggaaggaaagguggucgaccugggcugcggcagagggggauggagcuacuauuguggcgggcucaaaaaugugcgggaggugaagggacugaccaagggcgggccuggacacgaagaacccauccccaugucuacauacggcuggaaccugguucgccuccagagcggcgucgauguguuuuucauuccucccgaaaaaugcgacacccuucugugugauaucggggaguccucuccuaauccgacaguggaggccggacggacgcugagaguccucaaccugguugaaaauuggcuuaacaauaacacccaguucugcaucaaggugcugaaucccuacaugccuagcgugauugagaaaauggaagcgcuccaacgcaaguauggcggggcccugguccggaacccccuguccagaaauagcacacaugagauguacuggguguccaacgcuucuggaaauaucguuagcuccgugaacaugauuucucgcaugcucaucaaccgguuuaccaugagacacaaaaaggccacauaugaaccugacgucgaccuuggcagcgggacccgcaauauuggaaucgaguccgagacgcccaaccuggauauuaucggcaagcggaucgagaagauuaaggaggaacaugagaccucuuggcacuacgaccaggaucacccguauaaaacaugggcuuaccauggcagcuaugaaaccaagcagacaggguccgccagcucuauggugaauggaguugugagacugcucaccaaaccuugggacguccugcccacagugacccagauggcgaugacggauacaaccccuuucggccaacagcgcguguuuaaggagaaggucgacacccggacacaggagcccaaagaagggacgaagaaacuuaugaagaucaccgccgaguggcuguggaaagaacucggaaagaaaaagacaccuagaauguguacccgcgaggaguucacaagaaagguucgguccaacgcugcccugggcgcuauuuuuaccgaugaaaauaaauggaaaagcgcccgcgaggcuguggaagacucuagauucugggagcugguggauaaagaacggaaccuccaccuggaggggaagugcgagacaugugucuacaauaugaugggaaaaagagaaaagaaacuuggcgaguuuggcaaagccaaggggucccgggcgaucugguacauguggcugggagcccgcuuccucgaauuugaggcucugggcuuccuuaacgaagaccauugguuuagcagagaaaauucucuguccgggguggagggagaaggccuccacaaacugggguauauucugcgggauguuagcaagaaagagggcggagccauguacgcugacgacaccgccggcugggauacgcgcaucacccucgaagaccugaagaacgaggaaauggugacaaaucacauggagggggagcauaagaaacuugccgaagcgaucuucaagcugaccuaucagaacaaagucgugagaguucaacggcccacaccgcgcggaaccgugauggauauuaucuccagacgggaccagcgcggcagcgggcaggucggaacguacggccucaauacauuuaccaacauggaggcucaacugauuagacagauggaaggggagggcguguucaagaauauccagcaccuuacaguuaccgaggaagccgccgugcagaacuggcuggcucgggucggacgcgagagacucucucggauggccauuagcggcgaugacugcguggucaaaccucuggaugaccgcuucgcuaacgcccugacggcgcucaaugauauggggaagaucagaaaggacauccaacagugggaacccuccaaaggauggaacgauuggacccaggugcccuuuugcucucaucacuuccaugagcugauuaugaaggacggccggguucuuguggucccuuguagaaaucaggaugaacugaucgggcgcgcccggauuagccaaggagcuggcuggucccucagagagacagccugccuggggaaaucuuaugcucagauguggagccuuauguacuuucaccgccgggaccugagacucgccgcgaacgccaucuguuccgcugugccgucucacugggugcccaccagccgcacaaccugguccauucaugccaagcacgaguggaugacaaccgaagacaugcugacgguuuggaaucggguguggaucagagagaacccuuggauggaagauaaaacacccgucgagagcugggaagagauuccuuaucugggcaagcgcgaggaccaguggugcggaucucucaucggccugaccucccgggcuaccugggccaagaauauccaggcugccauuaaccaagugagaagccuuaucgggaaugaagaguacacagauuacaugcccucuaugaaacgcuuccggagagaagaggaagaggcgggaguucugugguga

SEQ ID NO: 19688 - RNA, 9876 nt, Artificial Sequence
  derived and/or modified CDS sequence (opt5) from DENV-2__GU131929__SS-prME
agcgccggcaugaucauuaugcugauccccaccgugauggcuuuccaccugacaacgcggaauggggaaccucauaugauugucggaauccaggaaaagggcaaaucccugcuuuuuaagaccgaagacgggguuaauaugugcacacugauggccauggaucuuggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagcggaucgagacauggauucugcggcaucccggguucaccaucauggccgcuauucucgccuacacaaucggaaccacccacuuucagcgcguucugauuuucauccuucugacagcuguggccccuuccaugacgauuagaugcaucggcaucucuaaccgggauuuugucgaaggggugagcggaggcuccuggguugacauugugcucgagcacgggagcugugucaccacaauggcgaagaauaagcccacccuggauuucgaacuuaucaaaacagaggccaagcagccugcuacccugcgcaaauauugcauugaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaaucgugaccugcgcuauguuuacaugcaagaaaaacauggaaggcaagauuguucagccugagaaucucgaauacacgaucguggugacaccccacucuggggaggagcaugccgucggaaacgacacaggcaaacacggcauggaaaucaaggugaccccucaguccagcauuacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauccagaaggaaacccuggugacauucaaaaacccucaugccaagaaacaagacguugugguccucggaagccaggagggcgcuaugcacaccgcccugacgggggccacagaaauucagauguccucuggcaaucuucuguuuaccggacaucucaagugccgccugagaauggacaaacuucaacugaagggcaugagcuacuccauguguacagggaaguucaaaguggucaaggagaucgcugagacccagcacggaaccauugugauccggguucaguaugaaggcgaugggagccccugcaaaauccccuucgagauuauggaccucgaaaagagauacgugcugggacgccugaucacagucaacccuauugugacggagaaagauucuccgguuaacaucgaagcggagcccccuuuuggcgacuccuacauuaucauugggguggagcccggccagcucaagcugaauugguucaagaaaggaagcucuaucggccaaauguuugaaaccacaaugagaggggcuaagagaauggcuauccuuggagauaccgccugggacuucggcagccucgggggagucuuuacauccauuggcaaagcccuccaucagguguucggggcuaucuauggcguggccuuuucuggaguuagcuggaccaugaagauucugaucggcgucauuaucacguggaucgggaugaacucccgcagcacaucucuguccgugagccuugugcucgucggaauugugacccuguaccugggcguuauggugcaggcggauucugggugugucguguccuggaaaaauaaggagcucaagugcggaagcggcaucuucauuaccgacaacguucacacauggaccgaacaguauaaauuucaaccugagucccccucuaagcuggcuagcgccauccagaaagcccaggaagaggggauuuguggcauccgguccgugacaagacuugagaaucugauguggaagcagaucacgccggaacucaaccacauucuggcugagaaugaagucaaacugaccaucaugacaggagauauuaagggcaucaugcaagccgggaaacgcucucuucggccucagcccaccgagcucaaguacagcuggaagacauggggaaaagcuaagaugcuguucaccgaauccuauaaccagacguuucugauugacggcccugagaccgccgagugccccaauacaaacagagcguggaauagccucgaaguggaggauuacggguucggaguuuuuaccacaaacaucuggcugaaacuuaaggaaaaacaggacgccuucugugacucuaagcugauguccgcugccaucaaggauaaucgcgcugugcaugccgacaugggcuauuggauugagagcgcgcucaacgauaccuggaaaaucgagaaggccucuuucauugaagucaaaaauugccacuggccuaagucccauacacuguggagcaacggcgugcuggagucugaaaugaucauucccaaaaaccuugcugggccggugagccaacacaauuaccggccuggauaccacacccagaucgccggccccuggcaucucgggaagcuggagauggacuuugauuucugugacggaacgacagucauuguuaccgaagauugcggcaacagagggcccucccugcgcaccacaaccgcuagcggaaagcucaucacggaguggugcugucggucuugcacacugccuccgcuuagauaucggggcgaggacggcuguugguacgggauggaaauccgcccccugaaagagaaggaagagaaucucgugaacucccuggugaccgccggacacggccaggucgauaauuuuagccugggggugcuuggaauggcccucuuccuggaagagaugcugagaacacggguuggcaccaaacaugcuauucuccugguggcggucuccuuugugacacuuaucaccgggaacaugucuuucaaggaccugggaagaguuguggucauggugggcgccacgauggcugaugacauuggcauggggguuaccuaucucgcccugcuggccgcuuuuaaagugcgcccuacauucgccgcgggacuucugcuccggaagcugaccagcaaggagcucaugaugacaaccaucggcauuguccugcuuucccaaucuacgauccccgaaacagugcuggagcucaccgaugcucuggcccuggggaugauggugcuuaaaaucgucagaaauauggaaaaguaccagcuggccguuacaauuauggcuauccucugcgugccuaacgccgugauucugcagaaugcguggaaagucagcuguaccauccucgcugugguuuccgugucuccccugcuucugaccagcucccagcaaaagacagacuggauuccucucgcccugacgaucaaaggacugaaccccaccgccaucuuucuuacaacccugagccgcacaaauaagaaaagaucuuggccgcucaacgaggcuauuauggccgucggcaugguguccauccuggcuagcucucuccugaagaaugacauuccuaugaccgggccccuuguugccggaggccugcugacggugugcuauguccucacaggccgguccgcggaucuggaacuugagcgcgccaccgacgugaagugggaggaucaggcugaaaucagcgggucuuccccuauucugagcaucaccauuuccgaggacggaagcaugucuaucaaaaacgaagaggaggaacagacacucaccauccugauuagaacaggccuccuggucaucagcgggcuuuuccccauuuccaucccgauuacggccgcugccugguaccugugggaggugaagaaacagcgggccggaguucugugggaugugccuucucccccucccaugggcaaggcugaacucgaggacggggcguaucgcaucaaacaaaagggaauccugggcuacagccagauuggcgccggggucuacaaggaaggaaccuuucacacaauguggcaugugaccagaggcgcuguucuuaugcacaaagggaagcggaucgagcccuccugggccgaugugaaaaaggaccugauuucuuauggaggcggguggaaacucgagggagaauggaaggagggcgaagagguccaggugcuggcccucgaaccuggcaagaauccgcgcgcugugcagacaaaacccgggcuguucaagaccaacacgggaaccaucggcgccguuagccuugauuuuuccccugggacaucuggaagccccauuaucgacaaaaagggcaaagucguggggcuguacggaaacggcguggucaccagauccggcgcguaugugagcgcuaucgcccaaacagagaagucuauugaggauaauccugaaaucgaggacgauauuuuccggaagcgcagacugaccaucauggaccuccaccccggggccggaaaaacaaagcgguaccugccugcuauuguuagagaagccaucaaacgcggccuucggacgcugauucucgcgccgaccagaguggucgcugccgagauggaagaggcccugcgcgggcuccccauccgguaucagaccccugcuaucagagccgagcauaccggacgcgaaauuguggaccugaugugucacgcuaccuucacaaugcggcuucugucccccguuagagugccuaacuacaaucugaucauuauggaugaggcccauuuuacggaccccgcgagcaucgccgcucgcggcuauauuucuacccgggucgaaaugggggaggccgcuggcaucuucaugacagccaccccgccuggauccagagaucccuuuccccagagcaacgccccuaucauugacgaggaacgggagauccccgaacgcuccuggaacucuggccacgagugggugacagauuucaaggggaaaaccguuugguuugugccuagcauuaaggcuggaaacgacaucgcggccugccucagaaagaauggcaaaaaggucauucaacugucccggaaaacguucgauagcgaauacgugaagacacgcaccaacgacugggauuuuguggucaccacagacaucucugagaugggggcuaauuucaaagccgagagaguuaucgauccgcggagauguaugaagcccgugauucuuaccgacggagaggaacgcgugauccuggccggcccuaugcccgucacacauuccagcgcugcccagcggagagggcgcauuggccggaacccuaaaaaugaaaacgaccaguacaucuauaugggagagccccucgaaaaugaugaggacugcgcgcacuggaaggaggcuaagaugcugcuggauaacauuaauaccccggaaggcaucauuccuucuauguuugagcccgaaagagagaaaguggacgccaucgauggggaauaccgccuccggggagaggccagaaagacguucguugaccuuaugcgcagaggcgaucugccuguguggcuggcuuauaaagucgccgcggaggggaucaacuacgccgaccggcgcugguguuuugauggaauuaagaacaaucagauccucgaagagaacguggaaguugagauuuggacaaaagagggcgaaagaaagaagcugaaaccccgguggcuugacgcucgcaucuauagcgauccucuggcccucaaggaguucaaagaguucgcugccgggagaaagucccugacccugaaucucauuacagagaugggccggcuucccaccuuuaugacgcagaagaccagagacgcucuggauaaccuggccgugcuccacacagcggaagccggaggccgcgcuuacaaucaugcccugucugagcuuccggagacccuggaaacacuccugcugcucacccuucuggcuacagucaccgggggaaucuuccuguuucucaugagcggccgggggaucggaaagaugacgcugggcaugugcugcauuaucacagccuccauucuucugugguaugcccagauccagccucacuggauugcugcgucuaucauccucgaguucuuucugauugugcugcucauccccgaacccgagaagcagagaaccccucaagacaaccagcuuaccuacgucgugauugccauccugacaguuguggcugccaccauggccaaugaaaugggcuuccuggagaaaacaaagaaagaccucgggcugggaagcauugcuacgcagcagccggaguccaacauccuugauauugaccugcgccccgccagcgcguggacccucuacgccguggcuacaaccuuugucacaccuaugcugcggcauucuaucgaaaauuccagcguuaacgugucccugaccgccaucgcuaaucaagccacggugcucaugggccuugggaagggauggccccugucuaaaauggauauuggcgucccucugcucgcgaucggguguuauagccaggugaaccccauuacccugacagccgcccuucugcuccugguugcccacuacgcuaucauuggaccuggccugcaggccaaggcuaccagagaggcccagaagcgggcggccgcuggcaucaugaaaaauccgacaguggacgggaucaccgucauugaucucgaccccaucccuuaugaucccaaguucgaaaaacaacuuggacaggugaugcugcugauucucugcgucacgcagguccugaugaugcgcacaaccugggcccuuugugaggcucugacacucgccaccggcccuaucuccacccugugggaagggaaccccggaagauuuuggaauacaacgauugccguuucuauggcgaacaucuuccggggcagcuaccuggcuggggccggacuccucuuuuccaucaugaagaauaccacaaacacccgcagaggcacaggcaacauuggggagacccugggagagaaauggaaaagccggcugaaugcucucggcaaaucugaguuccaaaucuauaagaaguccgggauucaggagguggaccgcacgcuggccaaagaaggaaucaagagaggcgagacagaucaccaugccgucagccgggggucugcuaaacuucgcugguuuguggagagaaacaugguuaccccggaaggaaagguggucgaccugggcugcggcagagggggaugguccuacuauuguggcgggcucaaaaaugugagagaggugaagggacugaccaagggcgggccuggacacgaagaacccauucccaugagcacauacggcuggaaccugguucgccuccagucuggcgucgauguguucuucaucccucccgaaaaaugcgacacccuucugugugauaucggggagagcuccccuaauccgacaguggaggccggacggacgcugagaguccucaaccugguugaaaauuggcuuaacaauaacacccaguuuugcauuaaggugcugaaucccuacaugccuucugugaucgagaaaauggaagcgcuccaacgcaaguauggcggggcccugguccggaacccccugagcagaaauuccacacaugagauguacugggugagcaacgcuuccggaaauauuguuucuagcgugaacaugaucucccgcaugcucauuaaccgguucaccaugagacacaaaaaggccacauaugaaccugacgucgaccuuggcucugggacccgcaauaucggaauugagagcgagacgcccaaccuggauaucaucggcaagcggauugagaagaucaaggaggaacaugagaccuccuggcacuacgaccaggaucacccguauaaaacaugggcuuaccauggcucuuaugaaaccaagcagacagggagcgccuccagcauggugaauggaguugugagacugcucaccaaaccuugggacguccugcccacagugacccagauggcgaugacggauacaaccccuuuuggccaacagcgcguguucaaggagaaggucgacacccggacacaggagcccaaagaagggacgaagaaacuuaugaagauuaccgccgaguggcuguggaaagaacucggaaagaaaaagacaccuagaauguguacccgcgaggaguuuacaagaaagguucggucuaacgcugcccugggcgcuaucuucaccgaugaaaauaaauggaaguccgcccgcgaggcuguggaagacagcagauuuugggagcugguggauaaagaacggaaccuccaccuggaggggaagugcgagacaugugucuacaauaugaugggaaaaagagaaaagaaacuuggcgaguucggcaaagccaaggggucucgggcgauuugguacauguggcugggagcccgcuuucucgaguucgaggcucugggcuuucuuaacgaagaccauugguucuccagagagaauagccugucugggguggagggagaaggccuccacaaacugggguauauccugcgggauguuuccaagaaagagggcggagccauguacgcugacgacaccgccggcugggauacgcgcaucacccucgaagaccugaagaacgaggaaauggugacaaaucacauggagggggagcauaagaaacuugccgaagcgauuuuuaagcugaccuaucagaacaaagucgugagaguucaacggcccacaccgcgcggaaccgugauggauaucauuagcagacgggaccagcgcggcuccgggcaggucggaacguacggccucaauacauucaccaacauggaggcucaacugaucagacagauggaaggggagggcguguucaagaauauucagcaccuuacaguuaccgaggaagccgccgugcagaacuggcuggcucgggucggacgcgagagacucagccggauggccaucucuggcgaugacugcguggucaaaccucuggaugaccgcuuugcuaacgcccugacggcgcucaaugauauggggaagaucagaaaggacauucaacagugggaacccagcaaaggauggaacgauuggacccaggugcccuucugcucccaucacuuucaugagcugaucaugaaggacggccggguucuuguggucccuuguagaaaucaggaugaacugauugggcgcgcccggaucucucaaggagcuggcuggagccucagagagacagccugccuggggaaauccuaugcucagauguggucucuuauguacuuccaccgccgggaccugagacucgccgcgaacgccauuuguagcgcugugccgucccacugggugcccaccucucgcacaaccuggagcauccaugccaagcacgaguggaugacaaccgaagacaugcugacgguuuggaaucggguguggauuagagagaacccuuggauggaagauaaaacacccgucgaguccugggaagagaucccuuaucugggcaagcgcgaggaccaguggugcggaagccucaucggccugaccucucgggcuaccugggccaagaauauucaggcugccaucaaccaagugagaucccuuauugggaaugaagaguacacagauuacaugcccagcaugaaacgcuuucggagagaagaggaagaggcgggaguucugugguga

SEQ ID NO: 19689 - RNA, 9876 nt, Artificial Sequence
  derived and/or modified CDS sequence (opt5) from DENV-2__GU131930__SS-prME
uccgcuggaaugaucauuaugcugauccccacagugauggcuuuccaccucacaacgagaaacggggagccucauaugauugucgggauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucguuccucaugugggaaugggccuggagacacgcaccgaaacguggaugucuuccgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggaguccaaggcuuggcuggugcaccggcagugguuucuugaccugccgcucccuuggcugcccggggccgauaagcagggaagcaacuggauucagaaagagacccuggucacauucaagaauccucaugcuaaaaagcaagacgugguugugcucggcucccaggaaggggccaugcacaccgcccugacgggcgcuacagagauccagaugucuagcggaaaccuucuguuuaccggccaucucaaaugccgccugagaauggacaaacuucaacugaaggggauguccuacagcauguguacaggaaaauucaaggucgugaaagaaauugcggagacccagcacggcaccaucgucauucgggugcaguaugagggggauggaucucccugcaagauccccuucgaaaucauggaccucgagaaaagauacguucugggccgccugauuacagugaauccuaucgucacggaaaaggauuccccggugaacauugaggccgaacccccuuuuggggacagcuacaucauuaucggcguugagcccggacagcucaagcugaacugguucaaaaagggcucuagcauugggcaaauguuugagaccacaaugcggggagcuaaaagaauggccauccuuggcgauaccgccugggacuucgggucccugggaggcguguuuacaucuaucgggaaggcucuccaucaggucuucggcgccauuuauggagcggcuuuuagcggcguguccuggaccaugaaaauccugauuggggugaucauuacguggaucggaaugaauagccgcucuacaucccugagcguuucucuuguccucgugggcaucgugacccuguaccugggggucauggugcaggccgauuccggauguguugugagcuggaagaacaaggaacucaaaugcggcuccgggauuuucaucaccgacaauguccacacauggaccgagcaguauaaguuucaaccugaaucucccagcaaacuggccuccgcuauucagaaggcccaggaggaaggcaucuguggcauucggucugugacaagacuugagaaccugauguggaaacagaucacgccggagcucaaucacauccuggcugaaaacgagguuaagcugaccauuaugacaggcgauaucaaagggauuaugcaagccggaaagcgcagccuucggccucagcccaccgaacucaaguacuccuggaaaacauggggcaaggcgaaaaugcugagcaccgagucucauaaucagacguuccugaucgacgggccugaaaccgccgagugccccaacacaaauagagcuuggaacucccucgagguggaagauuauggauuuggcgucuucaccacaaauauuuggcugaaacuuaaagagaagcaggacgccuuuugugacagcaagcugaugucugcugccaucaaagauaaccgcgcggugcacgccgacaugggcuacuggaucgaauccgcucucaaugauaccuggaagauugagaaagccagcuucaucgagguuaagaacugccauuggccuaaaucucacacacuguggagcaauggggugcuggaauccgagaugauuauccccaagaaccuugcuggaccggucagccaacacaacuaucggccuggcuaccauacccagacggccgggcccuggcaccucggaaagcuggaaauggacuucgauuuuugugacggcacaaccgugauugugaccgaggauugcgggaauagaggacccucucugcgcacaaccacggccuccggcaaacucaucacagaauggugcugucggagcugcacccugccuccgcuuagauaccggggcgaggacggguguugguauggaauggagauucgcccccugaaggaaaaagaggaaaaccucgucaauucccugguuacagcuggccauggacagguggauaacuucucucugggagugcuuggcauggcgcucuuucuggaggaaaugcugagaacccgggucgggacaaagcacgccauccuccugguggcuguuagcuucgugacccuuaucacgggaaauauguccuuuaaagaccugggcagagucgugguuauggugggcaccacaaugaccgaugacauugggaugggagucacauaccucgcccugcuggccgcuuucaaggugcgcccuaccuuugccgcgggccuucugcuccggaagcugacgucuaaagagcucaugaugacaaccaucgggauuguucugcuuagccaauccacaauccccgagaccauucuggaacucaccgaugcucuggcccugggaaugauggugcuuaagaucgucagagacauggagaaauaucagcuggccgugacaaucauggcuauucucugcgugccuaacgccgucauccugcagaaugcguggaagguuucuuguacgauucucgcuguggugagcgucagcccccugcuucugaccagcucucagcagaagacagacuggaucccucucgcccugaccauuaagggccugaaccccacagccaucuuccuuaccacgcugucccgcacaaauaaaaagagaagcuggccgcucaacgaagcuaucauggccguggggaugguuucuauucuggcuuccagccuccugaagaaugauaucccuaugaccggaccccuuguggccggcggccugcugaccgucugcuacgugcucacagggcggucugcggaccuggagcuugaacgcgccaccgauguuaaaugggaggaccaggcugagauuuccggaagcuccccuauccugagcauuacaaucucugaagauggcagcauguccauuaagaacgaggaagaggagcagacgcucaccauccugaucagaacagggcuccuggugauuucuggacuuuuucccgucagcaucccgauuaccgccgcugccugguaucugugggaagugaaaaagcagcgggccggcguccugugggacgugccuucucccccucccauggggaaagcugagcucgaagauggagcguaccgcaucaagcaaaagggcauucugggcuauagccagaucggggccggaguuuacaaagagggcacauuccauaccauguggcacgugacgagaggggcuguccuuaugcacaagggaaaacggaucgaacccagcugggccgacgugaagaaagaucugauuuccuacggcgggggauggaagcucgagggcgaguggaaggaaggcgaggaaguucaggugcuggcccucgagccugggaaaaauccgcgcgcuguccagaccaagcccggacuguuuaaaacaaacaccggcacaaucggggccgugucucuugacuucagcccuggaaccuccggcagccccauuaucgauaagaaagggaaggugguuggacuguauggcaauggcgucgugacaagaucuggggcguacguguccgcuauugcccaaacggaaaagagcaucgaggacaacccugagaucgaagaugacauuuuucggaaacgcagacugaccaucauggaccuccaucccggagccggcaagacaaaacgguaucugccugcuauugucagagaggccaucaagcgcgggcuucggacccugauucucgcgccgaccagagugguugcugccgaaauggaggaagcccugcgcggacuccccauccgguaccagaccccugcuauuagagccgagcacacgggccgcgagaucguggaucugaugugucaugcuaccuucacaaugcggcuucugucucccgucagagugccuaacuauaaucugaucauuauggacgaagcccacuucaccgaucccgcguccaucgccgcucgcggguacauuagcacacggguugagaugggcgaagccgcuggaaucuuuaugaccgccacgccgccuggcuccagagaccccuucccccagucuaacgccccuauuaucgaugaggagcgggaaauccccgagcgcagcuggaauacagggcaugaaugggugaccgacuuuaaaggaaagaccgucugguucgugccuuccauuaaggcuggcaacgauaucgcggccugccuccgcaagaaugggaagaaaguuauucaacugagccggaagacauuugacucugaguaugugaaaacccgcacaaacgauugggacuucgucgugaccacggauaucuccgaaaugggagcuaauuuuaaggccgagagagugauugacccgcggagauguaugaaacccgucauccuuacagacggcgaggaacgcguuauccuggccgggccuaugcccgugacccacagcucugcugcccagcggagaggccgcauuggacggaacccuaagaaugagaacgaucaguacaucuacaugggcgaaccccucgagaaugacgaagauugcgcgcacuggaaggaggcuaaaaugcugcuggacaacauuaauacaccggaggggaucauuccuagcauguucgaacccgagagagaaaagguggaugccaucgacggagaguaucgccuccggggcgaagccagaaaaaccuuugucgaucuuaugcgcagaggggaccugccuguguggcuggcuuacaagguugccgcggagggaauuaacuaugccgaucggcgcugguguuucgacggcaucaaaaauaaccagauccucgaggaaaacguggaggucgaaauuuggacgaaggagggggagagaaagaaacugaagccccgguggcuugaugcucgcaucuacuccgacccucuggcccucaaagaauuuaaggaguucgcugccggcagaaaaucucugacccugaaucucauuacagaaaugggacggcuucccaccuucaugacacaaaagaccagagaugcucuggacaaccuggccgugcuccauacagcggaggccggcgggcgcgcuuauaaucacgcccugagcgaacuuccggagacccuggagacgcuccugcugcucacacuucuggcuaccguuaccggaggcaucuuucuguuccucauguccgggcggggaauuggcaagaugacacugggcaugugcugcaucaucaccgccucuauucuucugugguacgcccagauccagccucauuggauugcugcgagcaucauucucgaauuuuuccugaucgugcugcucauccccgagcccgaaaaacagagaacaccucaagacaaccagcuuacguaugucgugauugccauccugaccgucguggcugccacaauggccaaugagaugggguuucuggaaaagaccaaaaaggaucucggacugggcuccauugcuacacagcagccggagagcaacauccuugacauugaucugcgccccgccucugcguggacccucuacgccguugcuacgaccuucgugacaccuaugcugcggcacuccaucgagaauagcuccgugaacgucucucugaccgccauugcuaaucaagccacaguucucauggggcuuggaaaaggcuggccccugagcaagauggacaucggggugccucugcucgcgaucggauguuacucccaggugaaccccauuacccugacggccgcccuucugcuccuggucgcccacuaugcuaucauuggcccuggccugcaggccaaggcuacaagagaagcccagaaacgggcggccgcugggaucaugaagaauccgaccguggauggaauuacaguuaucgaccucgaucccaucccuuacgaccccaaauuugagaagcaacuuggccaggugaugcugcugauucucugcgucacccaggugcugaugaugcgcaccacaugggcccuuugugaagcucugacgcucgccaccgggccuaucucuacacugugggagggaaaccccggcagauucuggaauaccacaauugccgucagcauggcgaacaucuuucggggguccuaucuggcuggagccggccuccuuuucagcauuaugaaaaauaccacgaacacacgcagaggcaccgggaauaucggagaaacccugggcgagaaguggaaaucucggcugaacgcucucgggaaguccgaguuucaaacauacaagaaaagcggaauccaggaaguggaucgcacccuggccaaggagggcauuaaaagaggggaaacagaccaucacgccguuucucggggauccgcuaaacuucgcugguucguggagagaaacauggucacgccggagggcaaagugguugaucugggcugcgggcggggaggcuggagcuauuacugugggggacucaagaaugugagagaagucaagggccugaccaaagggggaccuggccaugaggaacccauccccaugucuacauauggcuggaaccuggugcgccuccagagcgggguggacgucuuuuucauuccucccgagaagugcgauacccuucugugugacaucggagaauccucuccuaauccgacagucgaggccggccggacccugagagugcucaaccugguggagaauuggcuuaacaauaacacgcaguucugcauuaaaguccugaaucccuacaugccuagcguuaucgaaaagauggaggcgcuccaacgcaaauacgggggagcccuggugcggaacccccuguccagaaauagcacccacgaaauguauuggguguccaacgcuucuggcaauaucgucagcuccgugaacaugauuucucgcaugcucaucaaucgguuuacaaugagacauaagaaggccaccuacgagccugacguugaucuugggagcggaacacgcaacauuggcaucgaauccgagauucccaaccuggacaucauuggcaaacggaucgagaagaucaaacaggaacacgagaccucuuggcacuaugaucaggaccauccguacaagacaugggcuuaucacgggagcuacgaaaccaaacagacgggauccgccagcucuauggugaauggcgucgugagacugcucacaaagccuugggauguucugcccaccgugacccaaauggcgaugacagacacgaccccuuucgggcagcagcgcgucuuuaaggagaaaguggauacacggacccaggaacccaaggagggaaccaagaaacuuaugaaaauuaccgccgaguggcuguggaaggaacucggcaaaaagaagacaccuagaauguguacccgcgaggaguucacgagaaaagugcgguccaacgcugcccugggggcuaucuuuaccgacgagaauaaguggaaaagcgcccgcgaggcugucgaagauucuagauucugggagcugguugacaaggaacggaaccuccaucuggagggaaaaugcgaaacauguguguauaauaugaugggcaagagagagaagaaacuuggcgaguuugggaaggccaaaggaucccgggcgauuugguacauguggcugggcgcccgcuuccucgaauuugaggcucugggguuccuuaacgaagaucacugguuuagcagagaaaauucucuguccggaguggaaggcgaggggcuccacaagcugggcuacauccugcgggacgucagcaaaaaggagggaggcgccauguaugcugacgauaccgccgggugggacacacgcauuacccucgaagaucugaagaacgaggaaauggugacgaaucauauggagggagaacacaagaaacuugccgaggcgaucuucaaacugacauaccaaaacaaaguugugagaguccagcggcccaccccgcgcggcacagugauggacaucauuuccagacgggaucagcgcgggagcggacaaguuggcaccuaugggcucaauacguuuaccaacauggaggcucagcugaucagacagauggaaggcgagggaguguucaaaaauauucagcaucuuacagccaccgaagaggucgccgugaagaacuggcuggcucggguuggccgcgagagacucucucggauggccaucagcggggacgauugcguggucaagccucuggacgaucgcuucgcuaaugcccugacagcgcucaacgacaugggaaaaauuagaaaggauauccaacagugggaacccuccaaaggcuggaacgacuggacccaggugcccuuuugcucucaccauuuccacgagcugaucaugaaggaugggcggguccuugugguuccuuguagaaaucaggacgaacugauuggacgcgcccggaucagccaaggcgcuggguggucccucagagagacagccugccugggcaaaucuuacgcucagauguggagccuuauguauuuucaccgccgggaccugagacucgccgcgaacgccauuuguuccgcugugccgucucauuggguccccaccagccgcacgacaugguccauccacgccaagcaugaauggaugaccaccgaggauaugcugacaguguggaaucggguguggauuagagagaacccuuggauggaagacaagacccccguugagagcugggaagagaucccuuaccugggaaaacgcgaagaucaguggugcggcucucucauugggcugacaucccgggcuacgugggccaagaauauccaggcugccaucaaccaagugagaagccuuauuggaaaugaggaguauaccgacuacaugcccucuaugaaacgcuuccggagagaagaggaagaggcgggcguccugugguga

SEQ ID NO: 19690 - RNA, 9876 nt, Artificial Sequence
  derived and/or modified CDS sequence (opt5) from DENV-2__GU131931__SS-prME
agcgccggcaugaucauuaugcugauccccaccgugauggcuuuccaccugacgacgcggaauggggagccucauaugauuguuggaauccaggaaaagggcaagagccugcuuuuuaagaccgaggacgggguuaauaugugcacgcugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgcccacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcaugggagcugugucaccacaauggcgaagaauaagcccacccuggauuucgaacuuauuaaaacagaggccaagcagccugcuacccugcgcaaauacugcaucgaagccaagcucacgaacacaaccaccgagucuagauguccgacacaaggagagcccucccugaaagaggaacaagacaagcgguuugugugcaagcacagcaugguggaucgcggcuggggcaauggguguggacuguucggcaaagggggaauuguuaccugcgcuauguuuacaugcaagaaaaacauggaaggcaagaucguccagccugagaaucucgaauauacgauuguggugacaccccauucuggggaggagcacgccgucggaaacgacacaggcaaacacggcauggaaaucaaggugaccccucaguccagcaucacagaggcggaacugaccggguacggaacgguuaccauggaguguucucccagaacaggccuugauuucaaugaaauggugcugcuccaaauggagaacaaagccuggcugguccaucggcagugguuucuugaccugccgcucccuuggcugcccggggcugauaagcaggaguccaauuggauucagaaggaaacccuggugacauucaaaaacccucacgccaagaaacaagacguugugguccucggaagccaggagggcgcuaugcauaccgcccugacgggggccacagaaauccagauguccucuggcaaucuucuguuuaccggacaccucaagugccgccugagaauggacaaacuucaacugaagggcaugagcuauuccauguguacagggaaguucaaaguggucaaggagauugcugagacccagcauggaaccaucgugauucggguucaguacgaaggcgaugggagccccugcaaaauccccuucgagaucauggaccucgaaaagagauaugugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaccagauuuucggggcuaucuacggcgccgcguuuucuggagugagcuggaccaugaagauucugaucggcgugauuaucacguggaucgggaugaacucccgcagcacaucucuguccguuagccuuguccucgugggaauugugacccuguaucugggcgucauggugcaggcugauucuggguguguuguguccuggaaaaauaaggagcucaagugcggaagcggcaucuucauuaccgacaacguccacacauggaccgaacaguacaaauuucaaccugagucccccucuaagcuggccagcgccauccagaaagcucaggaagaggggauuuguggcauccgguccgugacaagacuugagaaucugauguggaagcagaucacgccggaacucaaccauauucuggccgagaaugaaguuaaacugaccaucaugacaggagauauuaagggcaucaugcaagcugggaaacgcucucuucggccucagcccaccgagcucaaguauagcuggaagacauggggaaaagccaagaugcuguccaccgaaagccacaaccagacguuccugauugacggcccugagaccgcggagugccccaauacaaacagagccuggaacucucucgaaguggaggauuacggguuuggagucuucaccacaaacaucuggcugaaacuuaaggaaaaacaggacgcuuuuugugacuccaagcugaugagcgccgcuaucaaggauaaucgcgccgugcaugcggacaugggcuauuggauugagucugcccucaacgauaccuggaaaaucgagaaggcuuccuucauugaaguuaaaaauugccacuggccuaagagccacacacuguggucuaacggcgugcuggagagcgaaaugaucauucccaaaaaccuugccgggccggucucccaacauaauuaccggccuggauaucacacccagaucgcuggccccuggcaucucgggaagcuggagauggacuucgauuuuugugacggaacgacagugauugugaccgaagauugcggcaacagagggcccagccugcgcaccacaaccgccucuggaaagcucaucacggaguggugcugucgguccugcacacugccuccgcuuagauaccggggcgaggacggcuguugguacgggauggaaauccgcccccugaaagagaaggaagagaaucucgucaacagccugguuaccgccggacacggccagguggauaauuucucccugggggugcuuggaauggcucucuuucuggaagagaugcugagaacacgggucggcaccaaacaugcgauucuccugguggccguuucuuucgugacacuuaucaccgggaacaugagcuuuaaggaccugggaagagucgugguuauggugggcgcuacgauggccgaugacauuggcaugggggucaccuaucucgcccugcuggcugccuucaaagugcgcccuacauuugcggcuggacuucugcuccggaagcugaccuccaaggagcucaugaugacaaccaucggcauuguucugcuuucucaaagcacgauccccgaaacagugcuggagcucaccgaugcccuggcccuggggaugaugguccuuaaaaucgugagaaauauggaaaaguaccagcuggcugugacaauuauggccauccucugcgucccuaacgcgguuauucugcagaaugcuuggaaaguguccuguaccauccucgccguggucucugugagcccccugcuucugaccuccagccagcaaaagacagacuggauuccucucgcccugacgaucaaaggacugaaccccaccgcuaucuuccuuacaacccugucucgcacaaauaagaaaagauccuggccgcucaacgaggccauuauggcuguuggcauggugagcauccuggccucuucccuccugaagaaugacauuccuaugaccgggccccuugucgcgggaggccugcugacggugugcuauguucucacaggccggagcgccgaucuggaacuugagcgcgcuaccgacgugaagugggaggaucaggccgaaaucucuggguccagcccuauucuguccaucaccauuagcgaggacggaucuaugagcaucaaaaacgaagaggaggaacagacacucaccauccugauuagaacaggccuccuggucaucuccgggcuuuuucccauuucuaucccgauuacggcugccgccugguaccugugggaggugaagaaacagcgggcuggaguccugugggaugugccuucucccccucccaugggcaaggcggaacucgaggacggggccuaucgcaucaaacaaaagggaauccugggcuacucccagauuggcgcugggguuuauaaggaaggaaccuuccacacaauguggcacgugaccagaggcgccguccuuaugcauaaagggaagcggaucgagcccuccugggccgaugugaaaaaggaccugauuagcuacggaggcggguggaaacucgagggagaauggaaggagggcgaagagguucaggugcuggcucucgaaccuggcaagaauccgcgcgccguccagacaaaacccgggcuguuuaagaccaacacgggaaccaucggcgcggugucccuugauuucucuccugggacaagcggaucccccauuaucgacaaaaagggcaaagugguugggcuguacggaaacggcgucgugaccagaagcggcgcuuaugugucugccaucgcccaaacagagaaguccauugaggauaauccugaaaucgaggacgauauuuuucggaagcgcagacugaccaucauggaccuccaccccggggcuggaaaaacaaagcgguaccugccugccauugucagagaagcgaucaaacgcggccuucggacgcugauucucgcuccgaccagagugguugccgccgagauggaagaggcucugcgcgggcuccccauccgguaucagaccccugccaucagagcugagcauaccggacgcgaaauuguggaccugaugugucacgccaccuucacaaugcggcuucugagccccgucagagugccuaacuacaaucugaucauuauggaugaggcgcauuucacggaccccgccucuaucgcugcccgcggcuauauuuccacccggguugaaaugggggaggcugccggcaucuuuaugacagccaccccgccuggaagcagagaucccuucccccaguccaacgcuccuaucauugacgaggaacgggagauccccgaacgcucuuggaauagcggccacgagugggugacagauuuuaaggggaaaaccgucugguucgugccuuccauuaaggcgggaaacgacaucgccgcuugccucagaaagaauggcaaaaagguuauucaacugagccggaaaacguuugauucugaauacgugaagacacgcaccaacgacugggauuucgucgugaccacagacaucuccgagaugggggccaauuuuaaagccgagagagugaucgauccgcggagauguaugaagcccgucauucuuaccgacggagaggaacgcguuauccuggcuggcccuaugcccgugacacacagcucugccgcgcagcggagagggcgcauuggccggaacccuaaaaaugaaaacgaccaguauaucuacaugggagagccccucgaaaaugaugaggacugcgcucauuggaaggaggccaagaugcugcuggauaacauuaauaccccggaaggcaucauuccuagcauguucgagcccgaaagagagaaaguggacgccaucgauggggaauaccgccuccggggagaggcuagaaagacguuugucgaccuuaugcgcagaggcgaucugccuguguggcuggccuauaaaguugcggccgaggggaucaacuacgcugaccggcgcugguguuucgauggaauuaagaacaaucagauccucgaagagaacguggaagucgagauuuggacaaaagagggcgaaagaaagaagcugaaaccccgguggcuugacgcccgcaucuauuccgauccucuggcucucaaggaguuuaaagaguucgccgcugggagaaagucucugacccugaaucucauuacagagaugggccggcuucccaccuucaugacgcagaagaccagagacgcccuggauaaccuggcggugcuccacacagccgaagcuggaggccgcgccuacaaucaugcucugagcgagcuuccggagacccuggaaacacuccugcugcucacccuucuggccacaguuaccgggggaaucuuucuguuccucauguccggccgggggaucggaaagaugacgcugggcaugugcugcauuaucacagccucuauucuucugugguaugcucagauccagccucacuggauugcggccagcaucauccucgaguuuuuccugauugugcugcucauccccgaacccgagaagcagagaaccccucaagacaaccagcuuaccuacgucgugauugcuauccugacagucguggccgccaccauggcuaaugaaaugggcuuucuggagaaaacaaagaaagaccucgggcugggauccauugccacgcagcagccggagagcaacauccuugauauugaccugcgccccgcgucugccuggacccucuaugcuguugccacaaccuucgugacaccuaugcugcggcacuccaucgaaaauagcuccgugaacgucucucugaccgcuaucgccaaucaagcgacgguucucaugggccuugggaagggauggccccugagcaaaauggauauuggcgugccucugcucgccaucggguguuacucccaggugaaccccauuacccugacagcugcccuucugcuccuggucgcucauuacgccaucauuggaccuggccugcaggcuaaggccaccagagaggcgcagaagcgggccgcugccggcaucaugaaaaauccgacaguggacgggaucaccguuauugaucucgaccccaucccuuaugaucccaaguuugaaaaacaacuuggacaggugaugcugcugauucucugcgucacacaggugcugaugaugcgcacaaccugggcucuuugugaggcccugacacucgccaccggcccuaucucuacccugugggaagggaaccccggaagauucuggaauacaacgauugcggucagcauggcuaacaucuuucggggcuccuaccuggccggggcuggacuccuuuucagcaucaugaagaauaccacaaacacccgcagaggcacaggcaacauuggggagacccugggagagaaauggaagucucggcugaaugcccucggcaaauccgaauuucaaaucuauaaaaagagcgggauucaggagguggaccgcacgcuggccaaagaaggaaucaagagaggcgagacagaucaccaugcuguuucucggggguccgccaaacuucgcugguucguggagagaaacauggucaccccggaaggaaaggugguugaccugggcugcggcagagggggauggagcuacuauuguggcgggcucaaaaaugugcgggaggucaagggacugaccaagggcgggccuggacacgaagaacccauucccaugucuacauacggcuggaaccuggugcgccuccagagcggcguggaugucuuuuucaucccucccgaaaaaugcgacacccuucugugugauaucggggaguccucuccuaauccgacagucgaggcgggacggacgcugagagugcucaaccugguggaaaauuggcuuaacaauaacacccaguucugcauuaagguccugaaucccuauaugccuagcguuaucgagaaaauggaagcccuccaacgcaaguacggcggggcucuggugcggaacccccuguccagaaauagcacacaugagauguacuggguguccaacgccucuggaaauauugucagcuccgugaacaugaucucucgcaugcucauuaaccgguuuaccaugagacacaaaaaggcuacauaugaaccugacguugaccuuggcagcgggacccgcaauaucggaauugaguccgagauccccaaccuggauaucauuggcaagcggaucgagaagauuaaggaggaacacgagacgucuuggcauuacgaccaggaucacccguauaaaaccugggccuaccauggcagcuaugaaacaaagcagaccggguccgcgagcucuauggugaauggagucgugagacugcucacaaaaccuugggacguucugcccaccgugacacagauggccaugaccgauacgacaccuuucggccaacagcgcgucuuuaaggagaagguggacacccggacccaggagcccaaagaagggacaaagaaacuuaugaagaucacggcugaguggcuguggaaagaacucggaaagaaaaagaccccuagaauguguacacgcgaggaguucaccagaaaggugcgguccaacgccgcucugggcgccauuuuuacagaugaaaauaaauggaaaagcgcucgcgaggccgucgaagacucuagauucugggagcugguugauaaagaacggaaccuccaccuggaggggaagugcgagaccuguguguacaauaugaugggaaaaagagaaaagaaacuuggcgaguuuggcaaagcgaaggggucccgggccaucugguauauguggcugggagcucgcuuccucgaauuugaggcccugggcuuccuuaacgaagaccacugguuuagcagagaaaauucucuguccgggguggagggagaaggccuccauaaacugggguacauccugcgggaugucagcaagaaagagggcggagcuauguacgccgacgacacagccggcugggauacccgcauuacgcucgaagaccugaagaacgaggaaauggugaccaaucacauggagggggagcauaagaaacuugcggaagcuaucuucaagcugacauaucagaacaaaguugugagaguccaacggcccaccccgcgcggaacagugauggauauuaucuccagacgggaccagcgcggcagcgggcagguuggaaccuacggccucaauacguuuacaaacauggaggcccaacugauuagacagauggaaggggagggcguguucaagaauauccagcaccuuaccgucacagaggaagccgcugugcagaacuggcuggcccggguuggacgcgagagacucucucggauggcuaucagcggcgaugacugcguggucaaaccucuggaugaccgcuucgccaacgcgcugaccgcccucaaugauauggggaagauuagaaaggacauccaacagugggaacccuccaaaggauggaacgauuggacacaggugcccuuuugcucucaucacuuccacgagcugauuaugaaggacggccggguccuugugguuccuuguagaaaucaggaugaacugaucgggcgcgcucggauuagccaaggagccggcuggucccucagagagaccgcuugccuggggaaaucuuaugcccagauguggagccuuauguacuuucaucgccgggaccugagacucgcggccaacgcuaucuguuccgccgugccgucucacuggguccccacaagccgcaccacaugguccauucaugcuaagcacgaguggaugaccacagaagacaugcugaccguguggaaucggguguggaucagagagaacccuuggauggaagauaaaacgcccguugagagcugggaagagaucccuuaucugggcaagcgcgaggaccaguggugcggaucucucauuggccugacaucccgggccaccugggcuaagaauauccaggccgcgauuaaccaagugagaagccuuaucgggaaugaagaguacaccgauuauaugcccucuaugaaacgcuuccggagagaagaggaagaggccggaguccugugguga

SEQ ID NO: 19691 - RNA, 9876 nt, Artificial Sequence
  derived and/or modified CDS sequence (opt5) from DENV-2__GU131932__SS-prME
agcgccggcaugaucauuaugcugauccccaccgugauggcuuuccaccugacaacgcggaauggggagccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccagguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucaaagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacagcgggcuggagugcugugggauguuccuucucccccucccaugggcaaggcggaacucgaggacggggccuaucgcauuaaacaaaagggaauccugggcuacucccagaucggcgcugggguguacaaggaaggaaccuuccacacaauguggcaugucaccagaggcgccgugcuuaugcacaaagggaagcggauugagcccuccugggccgauguuaaaaaggaccugaucagcuauggaggcggguggaaacucgagggagaauggaaggagggcgaagaggugcagguccuggcucucgaaccuggcaagaauccgcgcgccgugcagacaaaacccgggcuguuuaagaccaacacgggaaccauuggcgcggugucccuugauuucucuccugggacaagcggaucccccaucauugacaaaaagggcaaaguugucgggcuguacggaaacggcguggugaccagaagcggcgcuuaugucucugccaucgcccaaacagagaaguccaucgaggauaauccugaaauugaggacgauaucuuucggaagcgcagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccucagaaagaauggcaaaaaggugauccaacugagccggaaaacguuugauucugaauacgucaagacacgcaccaacgacugggauuucguggugaccacagacauuuccgagaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaaagagagaaagucgacgccauugauggggaauaccgccuccggggagaggcuagaaagacguuuguggaccuuaugcgcagaggcgaucugccuguuuggcuggccuauaaaguggcggccgaggggaucaacuacgcugaccggcgcugguguuucgauggaaucaagaacaaucagauucucgaagagaacgucgaaguggagaucuggacaaaagagggcgaaagaaagaagcugaaaccccgguggcuugacgcccgcauuuauuccgauccucuggcucucaaggaguuuaaagaguucgccgcugggagaaagucucugacccugaaucucaucacagagaugggccggcuucccaccuucaugacgcagaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaagcagagaaccccucaagacaaccagcuuaccuacguggucaucgcuauucugacagugguugccgccaccauggcuaaugaaaugggcuuucuggagaaaacaaagaaagaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaagggauggccccugagcaaaauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaagcgggccgcugccggcauuaugaaaaauccgacaguugacgggaucaccgugaucgaucucgaccccauuccuuaugaucccaaguuugaaaaacaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaugaagaauaccacaaacacccgcagaggcacaggcaacaucggggagacccugggagagaaauggaagaaucggcugaacgcccucggcaaaucugaauuucaaauuuauaagaaguccgggauccaggagguugaccgcacgcuggccaaagaaggaauuaagagaggcgagacagaucaccaugcugugagccgggggucugccaaacuucgcugguucgucgagagaaauauggugaccccggaaggaaagguuguggaccugggcugcggcagagggggaugguccuacuauuguggcgggcucaaaaacguccgggaggugaagggacugaccaagggcgggccuggacacgaagaacccauccccaugagcacauacggcuggaaucuggugcgccuccagucuggcguugaugucuuuuucauuccucccgaaaaaugcgacacccuucugugugauaucggggagagcuccccuaacccgacaguggaggcgggacggacgcugagagugcucaaucuggucgaaaacuggcuuaauaacaauacccaguucugcaucaagguucugaaccccuacaugccuucugugauugagaaaauggaagcccuccaacgcaaguauggcggggcucuggugcggaauccccugagcagaaacuccacacaugagauguacugggucagcaaugccuccggaaacaucgugucuagcguuaacaugauuucccgcaugcucaucaaucgguuuaccaugagacacaaaaaggcuacauaugaaccugacguggaccuuggcucugggacccgcaacauuggaaucgagagcgagauucccaaucuggauaucaucggcaagcggauugagaaaaucaaggaggaacaugagacguccuggcacuacgaccaggaucacccguauaaaaccugggccuaccauggcucuuaugaaacaaagcagaccgggagcgcguccagcauggucaacggagugguuagacugcucacaaaaccuugggacgugcugcccaccgucacacagauggccaugaccgauacgacaccuuucggccaacagcgcguguuuaaggagaagguggacacccggacccaggagcccaaagaagggacaaagaaacuuaugaagauuacggcugaguggcuguggaaagaacucggaaagaaaaagaccccuagaauguguacacgcgaggaguucaccagaaagguccggucuaaugccgcucugggcgccaucuuuacagaugaaaacaaauggaaguccgcucgcgaggccguugaagacagcagauucugggagcugguggauaaagaacggaaucuccaccuggaggggaagugcgagaccuguguguacaacaugaugggaaaaagagaaaagaaacuuggcgaguuuggcaaagcgaaggggucucgggccauuugguacauguggcugggagcucgcuuccucgaauuugaggcccugggcuuccuuaaugaagaccauugguuuuccagagagaacagccugucuggggucgagggagaaggccuccacaaacugggguauauccugcgggauguguccaagaaagagggcggagcuauguacgccgacgacacagccggcugggauacccgcaucacgcucgaagaccugaagaaugaggaaaugguuaccaaccacauggagggggagcauaagaaacuugcggaagcuauuuucaagcugacauaucagaauaaaguggucagagugcaacggcccaccccgcgcggaacaguuauggauaucauuagcagacgggaccagcgcggcuccgggcaggucggaaccuacggccucaacacguuuacaaauauggaggcccaacugaucagacagauggaaggggagggcgucuucaagaacauucagcaccuuaccgugacagaggaagccgcuguucagaacuggcuggcccgggugggacgcgagagacucagccggauggcuaucucuggcgaugacugcgucgugaaaccucuggaugaccgcuucgccaaugcgcugaccgcccucaacgauauggggaagaucagaaaggacauucaacagugggaacccagcaaaggauggaaugauuggacgcagguccccuuuugcucccaucacuuccaugagcugaucaugaaggacggccgggugcuuguugugccuuguagaaaccaggaugaacugauugggcgcgcucggaucucucaaggagccggcuggagccucagagagaccgcuugccuggggaaauccuaugcccagauguggucucuuauguacuuucaccgccgggaccugagacucgcggccaaugcuauuuguagcgccgucccgucccacugggugcccacaucucgcaccacauggagcauccaugcuaagcacgaguggaugaccacagaagacaugcugaccguguggaaccggguuuggauuagagagaauccuuggauggaagauaaaacgcccguggaguccugggaagagaucccuuaucugggcaagcgcgaggaccaguggugcggaagccucaucggccugacaucucgggccaccugggcuaagaacauucaggccgcgaucaaucaagucagaucccuuauugggaacgaagaguacaccgauuacaugcccagcaugaaacgcuuccggagagaagaggaagaggccggagugcugugguga

SEQ ID NO: 19692 - RNA, 9876 nt, Artificial Sequence
  derived and/or modified CDS sequence (opt5) from DENV-2__GQ199892__SS-prME
accgccggcgugaucgucaugcugauucccacagcuauggccuuccaccucacgacccggaacggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaagaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaccacggaggccgaacugaccggguauggaacagucaccauggaguguagcccccggacaggccuugauuucaacgaaauggugcugcuccaaauggaggacaaggcuuggcugguucaccgccagugguuucuugaucugccgcucccuuggcugcccggggccgacacccagggaucuaauuggauccagaaggagacgcuggugacauucaagaacccucaugcuaaaaagcaagacgucgugguucucggcucccaggaaggggccaugcacaccgcccugacaggcgcuaccgagauucagaugagcuccggaaaucuucuguuuaccggccaucucaaaugcagacugcggauggauaaacuucaacugaaagggaugucuuacagcauguguacaggaaaguucaagaucgugaaagaaauugcggagacgcagcacggcaccaucgucaucagagugcaguaugagggggacggagcccccugcaagauucccuucgaaaucacagaucucgagaaacgccauguccugggccggcugauuaccgugaacccuaucguuacagaaaaggacuccccggugaacauugaggcugaacccccuuuuggggauagcuacaucauugucggcguggagcccggacagcucaaacugaauugguucaagaagggcucuagcaucgggcaaauguuugagaccacgaugagaggagccaaacgcauggccauccuuggcgacacagcuugggauuucgggagccugggaggcguuuuuaccucuauugggaaggcccuccaccagguguucggcgcgaucuacggagcugccuuuagcggcgucuccuggaccaugaaaauucugaucggggugauuaucacauggaucggaaugaacucucggagcaccucccugagcgugucucuuguucucgucggcguggugacacuguaucugggggccaugguccaggcugacuccggauguauugugagcuggaagaauaaagaacucaagugcggcucugggaucuucauuacggauaacguucacaccuggacagagcaguacaaguuucaaccugaaucccccagcaaacuggccuccgcuauccagaaggcccaugaggaaggcauuuguggaaucagaucugugacccgccuugagaaucugauguggaaacagaucacaccggagcucaaccacauucugagcgaaaaugaggucaagcugaccaucaugacgggcgacauuaaagggaucaugcaggcgggaaagcggucccuuagaccucaacccaccgaacucaaauauucuuggaagacauggggcaaggccaaaaugcugagcaccgagucccauaaccagacauuccugauugaugggccugaaaccgcugagugccccaauacaaaccgcgccuggaauagccucgagguggaagacuacggauuuggcguuuucucuaccaacaucuggcugaaacuucgggagaaacaggacguguuuugugauuccaagcugaugagcgcugccaucaaagacaauagagcgguccacgccgauaugggcuauuggauugaaucugcucucaacgacacguggaagauggagaaggccuccuucaucgaggugaaaagcugccacuggccuaagucucauacacuguggagcaaugggguucuggaauccgagaugauuauccccaaaaacuucgcuggaccggugagccagcacaacuaccgcccuggcuaucauacccaaaccgccgggcccuggcaccuuggaaagcucgaaauggauuuugacuucugugagggcacaaccgucguggugacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggucaauucccucguuaccgcuggccaugggcagauugauaacuuuucucugggaauccugggcauggcgcuuuuccucgaagagaugcugagaacgcgcguggggaccaaacacgccauccugcucguggcucugagcuuugucacacuuauuaccggaaauauguccuuccgggaccugggcagagugaugguuauggugggcgccacaaugaccgaugacaucgggaugggagucacguaucucgcccugcuggcugccuuuaaggugcgcccuacauucgcggcuggccuucugcucagaaaacugaccucuaaggagcucaugauggccacaauugggaucgcccugcuuagccaguccacccugcccgaaaccauucucgagcugacagaugcucuggcccuuggaaugauggcgcugaaaaucguucggaacauggaaaaguaccaacucgcugugacgaucauggccauuucuugcgucccuaaugccgugauccugcagaacgcuuggaagguuagcuguaccauucucgccgcuguguccgucagcccccugcuucugacaucuucccagcagaaagccgacuggaucccucucgcgcugaccauuaagggccugaaucccacagccaucuuucuuaccacgcugagccgcacaucuaaaaagagauccuggccgcucaacgaggcuaucauggccguggggauggugagcauucuggcuucuucccuccugaaaaaugacaucccuaugaccggaccccuugucgccggcggccugcugaccguuugcuaugugcucacagggcggagcgccgaucuggaacuugagcgcgcugcggacgugaagugggaggaucaagccgaaauuuccggaagcucuccuauccugagcauuaccaucuccgaggacggcucuaugagcauuaaaaacgaagaggaggaacagacacucacgauccugaucagaaccgggcuccuggucauuuccggaguguuccccguuucuaucccgauuacagcugccgccugguaccuuugggaggugaagaagcagcgggcuggcguccugugggaugugccuucucccccucccguugggaaagccgaacuggaggacggagcguaucgcaucaagcagagaggcauucucggcuacucccaaaucggggcuggaguguauaaagaaggcaccuuucacacaauguggcaugucaccagaggggccgugcugaugcaccgcggaaagagaaucgagcccuccugggccgaugucaaaaaggaccuuauuagcuacggcgggggauggaagcuggagggcgaauggaaagagggcgaagaggugcagguucucgcucuggaaccugggaagaauccgcgggccgugcagacgaaacccggaaucuucaagaccaacacaggcaccauuggggcggucucccucgauuuuagcccuggaacaucuggcucccccaucguggacagaaaagggaagguugugggacuguacggcaauggcgucgugacccgcagcggggcuuaugugucugccauugcccagacagagaaguccaucgaggauaacccugaaaucgaggacgauauuuuccggaaaaagagacuuacgaucauggaccugcaucccggagcuggcaaaaccaagcgcuaccugccugccauuguucgggaagcuaucaaaagagggcuccgcacacugauucuugccccgacccgggucguggcggccgagauggaagaggcucugagaggacuccccauccgcuaucaaaccccugccauucgggcugagcacacaggcagagaaaucguggaccugaugugucaugccacguucaccaugcggcuccugagccccguccgcgugccuaacuacaaucuuaucauuauggaugaggcccacuuuacagaccccgcuuccaucgcggccagaggguauauuucuacccggguugaaaugggcgaggcugccggaaucuucaugacagccaccccgccuggcagccgcgaucccuuuccccaguccaacgcuccuauuauggacgaggaaagagagauccccgaacggagcuggaacucugggcacgagugggugacggauuucaagggaaagacagucugguuugugccuuccaucaaagccggcaaugacauugcggcuugccugagaaagaaugggaaaaagguuauccagcugagccgcaaaaccuucgauucugaauacgugaagacccgggccaacgacugggauuuugucgugacaaccgacauuagcgagaugggagccaauuucaaggcugagagaguuaucgauccgcgccgguguaugaaacccgugauucucacagacggcgaagagagagucauccuggccgggccuaugcccgugacccauuccucugcggcccaacgccggggcagaaucggacgcaacccuaagaaugaaaacgaccaguauauuuacaugggcgagccccuugaaaaugaugaggacugcgcucacuggaaagaggccaagaugcugcucgauaacaucaauacgccggaagggauuaucccuagcauguuugagcccgaaagagagaaaguggacgcuauugauggagaauaccggcugcgcggcgaggccagaaagacauucgucgaccugaugcggcgcggggaucucccuguuuggcuugcuuauaaaguggccgcggagggaaucaacuacgccgacagaaagugguguuuugauggcauuaagaauaaccagauccuggaagagaacguggaagucgagaucuggaccaaagagggggaacggaagaaacugaagcccagauggcucgacgcucgcauuuauuccgauccucuggcccuuaaagaguucaaggaguucgcugccggccggaagucucugacacucaaucugaucaccgagaugggaagacugcccacguuuaugacccagaaagcccgcaacgcucucgacaaucuugcggugcugcauacagccgaaguuggcgggcgggcuuacacccacgcccugagcgagcucccggagacacuggaaacccuucugcuccugacacugcucgccaccgugacgggaggcauuuuccuuuuucugauguccgggaagggaaucggcaaaaugacacugggcaugugcugcauuaucaccgcuagcauccuccugugguaugcccaaauucagccucacuggaucgcggccucuauuauccuugaguucuuucugauuguccuccugauccccgaacccgagaagcagagaaccccucaggauaaccaacugacauacgugguuaucgcuauucucaccguggucgccgcuacaauggccaaugaaaugggguuccuugagaaaacgaagaaggaccugggauuuggcuccaucaccacacaggagagcgaauccaacauucuggacaucgaucuccggccggcgucugccuggacccuguaugcuguggccacaaccuucgucacgcccaugcuucgccauagcauugaaaauuccucugugaacguuagccugaccgcuaucgccaaucaggcuacagugcucauggggcugggaaaaggcuggccucuguccaagauggacauuggggugccccuccuugccaucggauguuacagccaggucaacccuaucacccugacagcggcccugcuccugcuuguugcucacuacgccauuaucggccccggccugcaagcuaaagccaccagagaagcccagaagcgggcggcugccgggauuaugaaaaauccuacgguggauggaaucacagugauugaccucgagccgauccccuaugauccuaaguuugaaaagcagcugggccaggucaugcugcucauccuuugcgugacccaaguucugaugaugcgcacaaccugggcucugugugaggcccucacccuggccacagggcccauuucuacgcuuugggagggaaacccuggcagauucuggaauaccacaaucgcuguguccauggccaacauuuuucgggggagcuaccuggcgggagccggccuccuguucucuaucaugaaaaauaccacaaacacccgcagaggcacggggaaugucggagaaacacugggcgagaaguggaaaucccggcucaacgcucuuggaaagagcgaauuucagauuuauaaaaagucuggaauccaggagguggaccgcacccuggccaaagagggcaucaagagaggggaaaccgaucaucacgcugucagccggggauccgccaagcugagaugguucguggagcgcaacaugguuacacccgaaggcaaaguggucgaccucggcugcgggcggggaggcuggucuuacuauugugggggacugaagaaugugagagagguuaaaggccuuaccaaagggggaccgggccaugaggaaccuauucccaugagcacauacggcuggaaccuggugcgccuccaauccggggucgauguguucuuuacgcccccugagaaaugcgacacccugcugugugauaucggagaaagcucccccaauccuacaauugaggcgggccggacccucagagugcuuaaccugguugaaaauuggcugaacaauaacacacaguucugcaucaagguccucaauccguauaugcccucugugauugagaagauggaaacccugcagcgcaaauacgggggagcccuugugcggaacccucugagcagaaauuccacgcacgagauguacugggucucuaacgcuaccggcaauaucguuagcuccgugaacaugaucucucgcaugcucauuaaucgguuuacaaugaagcacaaaaaggccaccuaugagcccgacguggaucuggggagcggaacaagaaacaucggcauugaauccgagaucccuaaccuggacauuaucggcaaacgcauugaaaagaucaagcaggagcaugaaaccagcuggcacuacgaccaagaucaucccuauaaaacaugggcuuaccacgggucuuaugagaccaagcagacgggauccgccagcucuauggucaauggcgugguucggcuccuuacaaaaccgugggacguggucccuauggugacccagauggcuaugaccgauacaacgcccuucgggcagcaaagaguuuuuaaggagaaaguggacacccgcacacaggaaccuaaggagggaaccaagaaacugaugaagaucacagccgaauggcuguggaaagagcucggcaaggagaaaacccccagaauguguacacgggaagaguucacccgcaaggucagauccaacgcggcccugggggcuauuuuuacggaugaaaauaaauggaaaagcgcccgggaggcuguggaagacggaagauucugggagcuuguggaucgggagcgcaaccugcaccucgaaggcaagugcgagaccugugucuacaauaugaugggcaaaagagaaaagaaacugggggaguuuggaaaggccaaaggcucucgggccaucugguauauguggcugggggcgcgcuuccucgaauuugaggcucugggauuccuuaacgaggaccauugguuuuccagaggcaauagccuguccgggguugaaggcgagggacuccaccggcugggcuacauucuucgcgaaguggggaagaaggagggaggcgccauguacgccgaugacacagcugggugggauaccagaaucacacuggaagaccucaaaaacgaggagauggugaccaaucauaugaagggagaacacaaaaagcuggccgaggcuauuuucaaacugacguaucagaacaaggucgugcggguucagcgcccuacacccagaggcaccgugauggacaucaucagccggaaggaucaacgcgggucuggccaggucggaacauacggccucaauaccuucacgaacauggaagcccagcugauuagacaaauggagggggagggaaucuuuaaaagcauucagcaucuuaccgcgacagaagagaucgccgugcagaauuggcuggcucggguuggccgcgaaagacucucccggauggccauuucuggggacgauugcguggucaagccgaucgacgauagauucgcuagcgcccugaccgcgcuuaacgacaugggaaaagugcgcaaggauauccagcaaugggagccuucccggggcuggaaugacuggacacagguucccuuuugcucucaccacuuccaugaacuggugaugaaagaugggagaguccucgugguccccugucgcaaccaggacgagcugauuggccgggccagaaucagccagggagcuggcuggucccugaaggagaccgccugccucgggaagucuuaugcucaaauguggacacugauguacuuucaccgccgggaucuuagacuggccgcuaacgccauuuguagcgcggugccuucccauuggguuccgaccagccgcacgacauggucuauccacgccaaacacgaauggaugaccaccgaggacaugcucgcuguguggaaucgggucuggauucaggaaaaccccuggauggaggauaagacaccuguggaauccugggaggaggugcccuaucugggaaaaagagaagaccaguggugcggcagccuuaucgggcugaccucucgcgccacaugggccaagaauauucagacggcuaucaaccaaguucggucccucaucggaaaugagggcuacaccgacuauaugccuagcaugaaaagauuccggagagaagaggaagaggccggggugcugugguga

SEQ ID NO: 19693 - RNA, 9876 nt, Artificial Sequence
  derived and/or modified CDS sequence (opt5) from DENV-2__JF730044__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaaggaaccugccacgcugagaaaauauugcaucgaggcuaagcucacaaacaccaccacagagagccgguguccgacccagggagaacccucucugaaugaggaacaagacaaacgcuuugugugcaagcauuccaugguggauagaggcuggggcaacggguguggacuguucggcaaggggggaauugucacaugcgccauguuuacgugcaaaaagaauauggagggcaaaaucguucagccugaaaaccucgaguacaccauugugaucacaccccacagcggggaggaacaugcggugggaaaugacaccggcaagcacggcaaagagaucaagauuacaccucagucuuccagcaccgaagccgagcugacgggguauggaaccgucacaauggaauguucuccccggaccggccuugauuucaacgagauggugcugcuccagauggaggacaaagcuuggcugguucaccgccaaugguuucuugaucugccgcucccuuggcugcccggggccgacacacagggauccaauuggauccagaaggaaacccuggugacguucaagaacccucaugcuaaaaagcaggacgucgugguucucggcagccaagagggggccaugcacacagcccugaccggcgcuacagaaauucagauguccucuggaaaucuucuguuuaccggccaucucaaaugcagacugcggauggauaagcuucagcugaaagggaugagcuacuccauguguaccggaaaguucaagaucgugaaagagauugcggagacacaacacggcacgaucgucaucagagugcaguaugaaggggacggaagccccugcaagauucccuucgagaucauggaucucgaaaaacgccauguccugggccggcugauuaccgugaacccuaucguuacagagaaggacucuccggugaacauugaagccgagcccccuuuuggggauuccuacaucauuaucggcgucgagcccggacagcucaaacugaauugguucaagaagggcagcucuaucgggcagauguuugaaaccacaaugagaggagcuaaacgcauggccauucuuggcgacaccgccugggauuucgggagccugggaggcguguuuacguccauggggaaggcucuccaccaaguuuucggcgccaucuacggagcggcuuuuucuggcgugagcuggacaaugaaaauucugaucggggucauuaucaccuggaucggaaugaacucccggagcaccucucuguccgugagccuugugcucguuggcgucauuacacuguaucugggggccauggugcaggccgacucuggauguguggucuccuggaagaauaaagagcucaagugcggcagcgggaucuucauuaccgauaacgugcacacauggacggaacaguacaaguuucagccugagucccccucuaaacuggcuagcgccauccaaaaggcucaugaagagggcauuuguggaaucagauccguuacccgccuugagaaucugauguggaaacagaucacaccggaacucaaccacauucugucugagaaugaagugaagcugaccaucaugacaggcgacauuaaagggaucaugcaggccggaaagcggagccuuagaccucagcccaccgagcucaaauauuccuggaagacguggggcaaggcgaaaaugcugagcaccgaaucucauaaccaaacauuccugauugaugggccugagaccgccgagugccccaauacaaaccgcgcuuggaauucccucgaagucgaggacuacggauuuggcguguucaccacaaacaucuggcugaagcuucgggaaaaacaggacguuuuuugugauagcaagcugaugucugccgcuaucaaagacaauagagccgugcacgcggauaugggcuauuggauugaguccgcccucaacgacaccuggaagauggagaaggcuagcuucaucgaagucaaaucuugccacuggccuaagagccauacgcugugguccaauggggugcuggagagcgaaaugauuauccccaaaucuuucgccggaccgguuucccagcacaacuaccgcccuggcuauuacacacagaccgcugggcccuggcaucuuggaaagcucgagauggauuuugacuucugugaaggcaccacaguggucgugaccgaggauugcgggaaccggggacccagccugagaacgacaaccgccuccggcaaacugauuacagaguggugcugucggucuugcacccucccuccgcugcgcuacagaggcgaagacggguguugguauggaauggagauccggccccuuaaggaaaaggaggaaaaucuggugaacagccucgucacagccggccacgggcaaauugauaauuuuucccugggaguucugggcauggcucuuuuccucgaggagaugcugagaacccgcguggggacgaaacaugcgauccugcucguggccgucucuuuugugacccugaucacaggaaacaugagcuuccgggaccuuggcagaguuauggugauggucggcgcuaccaugacagaugacauugggaugggagugaccuaccuggcccuccuggccgcuuuuaagguucgcccuacguucgccgcgggccugcuucugagaaaacucacauccaaggaacugaugauggcuaccaucgggauugcccuccugucucagagcacaauccccgagaccauucuugaacugaccgaugcccucgcucugggaaugauggugcugaaaaucguccggaauauggagaaguaucagcuugccgugacaaucauggcgauuuccugcguuccuaacgcugugauccugcaaaaugccuggaaggucagcuguacgauucucgccgcugugucuguguccccccugcuccugaccagcucucagcagaaagccgacuggaucccucuugcucugacaauuaagggccucaaccccaccgccaucuuucugacaacccugucccgcacgagcaaaaagagaucuuggccgcuuaaugaagcgaucauggccgucgggaugguuuccauucuggcuagcucccuccugaaaaacgacaucccuaugacaggaccccucguggccggcggccugcuuaccgugugcuacguccugaccgggcggagcgcugaucuggagcucgagcgcgccacagacgugaagugggaagaucaggccgagauuucuggaagcuccccuauccugucuauuaccaucagcgaagacggcuccaugucuauuaaaaaugaggaggaagagcaaacacuuacgauccugaucagaaccgggcuccugguuauuagcggacucuuccccguguccaucccgauuacagcugcggccugguaucugugggaagucaagaagcagcgggcuggcgugcuuugggauguuccuucucccccucccguggggaaagccgagcuggaagacggagccuaccgcaucaagcagaaaggcauucugggcuauagccagaucggggcuggagucuacaaggagggcaccuuucacacaauguggcacgugaccagaggggccguccucaugcaucggggaaaacgcaucgagcccuccugggcggaugugaagaaggaccugauuagcuacggcgggggauggaaacuugaaggcgaguggaaggaaggcgaggaaguucaagugcuggcucucgagccugggaaaaacccgagagccguccagacgaagcccggacuguucaaaaccaauacaggcaccaucggggccgugucucucgauuuuuccccuggaacaagcggcucucccauuguugaccggaaggggaagguggucggacuguauggcaacggcguggugaccagauccggggcuuacguuagcgccaucgcgcagacagagaaauccauugaagauaauccugagaucgaagacgauaucuuccgcaagaaacggcuuacgauuauggaccugcaccccggagcuggcaagaccaaaagauaucugccugccaucguccgcgaggccauuaagcgggggcucagaacacugauccuugcuccgacccgcgugguggccgcugaaauggaggaggcccugcggggacuccccauuagauaccagaccccugcgauccgcgccgaacauacaggccgggagauugucgaccugaugugucacgcuacguucaccaugagacuccugucucccgugcggguuccuaacuauaaccuuaucaucauggaugaagcccauuuuacagaccccgcuagcauugccgcccgcggguacaucuccaccagaguggagaugggcgaggcugcgggaauuuucaugacagccaccccgccuggcagccgggaucccuuuccccaaucuaaugcuccuaucauggacgaagagcgcgaaauucccgagagauccuggaacagcgggcacgaaugggucacggauuucaagggaaaaacagugugguuuguuccuucuaucaaggccggcaaugacaucgccgcuugccugcggaaaaacgggaagaaagugauucagcugagcagaaagaccuucgauuccgaguaugucaagacccgcacaaaugacugggauuuugugguuaccacagacaucucugagaugggagccaacuucaaagcggaacgggugauugauccgagacgcuguaugaagcccgucauccucaccgacggcgaggaacgggugauucuggcugggccuaugcccgugacgcacagcuccgccgcccagagacgcggccggaucggaagaaauccuaaaaacgagaaugaccaauacaucuacaugggcgaaccccuugagaacgaugaggacugcgcucauuggaaggaagccaaaaugcugcucgauaauauuaacacaccggaggggaucauuccuucuauguuugaacccgagcgcgaaaaggucgacgcgaucgauggagaguauagacugcggggcgaggcccgcaaaaccuucguugaccugaugagacggggggaucucccuguguggcuugcuuaccgcguggccgcugaaggaauuaauuaugccgacagacggugguguuuugauggcgucaagaacaaucagauccuggaggaaaacguggagguugagauuuggacaaaggaaggggagagaaaaaagcugaaaccccgcuggcucgacgcucggaucuacagcgauccucuggcccuuaaggaauucaaagaguucgcggccggcagaaagucccugacccucaaccugaucacggaaaugggacgccugcccaccuuuaugacacagaaggcucgggacgcccucgauaaucuugcugugcugcacaccgccgaggccggcgggagagcuuauaaccaugcgcugagcgagcucccggaaacacuggagacccuucugcuccugacacugcucgccaccgucacgggaggcauuuuccuuuuucugaugucugggaaaggagugggcaagaugacacugggcaugugcugcaucauuaccgcuuccauccuccugugguacgcccagauucaaccucacuggaucgccgcuagcaucauucuugaauucuuucugaucguucuccugauucccgagcccgaaaaacagcggaccccucaggacaaucagcugacauauguggucaucgccauucucaccguggucgcggccacaauggcuaacgagaugggguuccuugagaagacgaaaaaggaccugggacugggcuccaucgccacccaagaaccggagucuaauauccucgauauugaccugcgccccgcuagcgccuggacacuuuacgcgguggccaccacauuuguuaccccuaugcugagacacuccaucgaaaacucuagcgugaaugugucccucacggcuauugccaaccaggcuaccguccugauggggcugggaaagggcuggccccucagcaaaauggauaucgggguuccucuucuggccauuggauguuacucucaggugaaucccgugacacugaccgcugcccuccugcuucuggucgcgcauuaugccaucauuggcccuggccuccaggcuaaggccacacgggaggcucaaaaacgcgccgccgcggggaucaugaagaacccgaccguggacggaaucacgguuauugaucuggaccccaucccuuacgaucccaaauucgaaaagcagcugggccaggugaugcuccuuauucugugcgucacacaggugcugaugaugagaaccacaugggcucucugugaggcccugacccuugcuaccgggccuaucuccacacugugggagggaaaucccggccgguuuuggaacacgaccauugccgucagcauggccaauaucuuccgcgggucuuaucucgcuggagccggccugcuguuuuccaucaugaagaacacaaccaauacaagacggggcaccgggaacauuggagaaacgcucggcgagaaauggaagagccgccuuaaugcgcuggggaaaucugaauuccaaaucuacaagaaaagcggaauucaggagguggacagaacacuggccaaggagggcaucaaacggggggaaaccgaucaccaugcuguuuccagaggaucugccaagcuccgcugguuuguggagcggaacauggucaccccggaaggcaaggugguugaccugggcugcgggagaggaggcuggagcuauuacugugggggacuuaaaaacgugaaggaggucaaaggccugacaaaggggggaccuggccacgaagagcccauucccauguccaccuauggcuggaaucucgugcgccugcagagcgggguggauguuuucuucacaccucccgagaaaugcgacacgcugcucugugauaucggagaauccucuccuaacccgaccaucgaggcuggccggacacuuagaguccugagccugguggaaaauuggcucaacaaugacacccaauuuugcauuaaggugcugaaccccuacaugccuuccgucaucgagaagauggaaacacuucagcgcaaauacgggggagcccugguucggaauccccucucuagaaacagcacccaugagauguauuggguguccaaugcgacgggcaacauugugucuagcgucaauaugaucucccgcaugcugauuaaccgguucaccaugaagcacaaaaaggccacauacgagccugacguggaucuggggagcggaaccagaaauaucggcaucgaaucugagauucccaaccucgacaucauuggcaaacgcaucgaaaagauuaagcaggagcacgaaacauccuggcauuaugaucaggaccacccguacaaaaccugggcuuaucaugggagcuacgagacaaagcaaaccggaucugccuccagcaugguuaauggcgugguccggcuucugacgaaaccuugggaugugguucccauggugacacagauggcuaugaccgacaccacaccuuuugggcagcagagagucuucaaggagaaaguggauacgcgcacccaagaacccaaggagggaacaaagaaacugaugaagaucaccgccgaauggcucuggaaagagcugggcaagaaaaagacaccuagaauguguacccgggaggaauuuacacgcaaagugagaucuaacgcugcccuuggggcgauuuucaccgacgagaacaaguggaaguccgcccgggaagcugucgaggauagcagauuuugggaacugguugacaaagagcggaaucuccaccuggagggaaagugcgaaacguguguguauaacaugaugggcaaacgcgagaagaaacugggcgaauucgggaaggccaagggauccagagcuaucugguacauguggcucggcgcccgguuucuggaguucgaagcccuuggguuucugaaugaggaucacugguucagccgcgagaacucucucagcggaguggaaggcgaggggcugcauaaacuuggcuacauccugagagacgucggaaagaaagaaggcggggcgauguaugcugacgauaccgccggaugggacacacggauuacccucgaggaucugaagaaugaagagauggugacaaaccacauggagggcgaacauaaaaagcuggccgaggcuaucuuuaagcucaccuaccagaauaaaguugugcgcguccagagacccacgccgcgggggacagugauggacauuaucucccgcagagaucagcggggaucuggccaaguugggaccuauggccugaacacauucaccaauauggaagcccagcuuauucgccagauggagggagagggcaucuucaagagcauccaacaccugacggcuaccgaagagauugccgugcagaacuggcucgcgagagucgggcgggaacgccuguccagaauggccaucucuggagacgauugcgugguuaaaccucuugacgaucgguuugcuagcgcccugacagcucucaaugacaugggcaaggugagaaaagauauucagcagugggagcccucccgcggguggaacgacuggacccaaguccccuucugcucucaucacuuucacgaacugaucaugaaggauggacgggugcuggucgugccuuguagaaaucaggacgagcucauuggccgcgcccggaucagccagggggcgggcuggucccugaaggagacagccugccuuggaaaaagcuacgcucagauguggucucugauguauuuccauagacgcgaccuccggcuggccgcuaacgccaucuguuccgcuguuccgagccacugggugcccaccucuagaacaaccugguccauucaugccaagcacgaauggaugacgacagaggauaugcuuaccgucuggaaucgcguguggauccaagaaaacccuuggauggaggacaaaacccccguggaaagcugggaggagguuccuuaccugggcaagcgggaagaucaguggugcgggucccucauuggacugacaucuagagcgaccugggccaaaaacauccagacagcuauuaaucaggugcgcagccugaucggcaacgaggaauauacggacuacaugcccuccaugaagcgguuuagacgggaggaagaggaggccgggguccucugguga

SEQ ID NO: 19694 - RNA, 9876 nt, Artificial Sequence
  derived and/or modified CDS sequence (opt5) from DENV-2__FJ639697__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaaggaaccugccacgcugagaaaauauugcaucgaggcuaagcucacaaacaccaccacagagagccgguguccgacccagggagaacccucucugaaugaggaacaagacaaacgcuuugugugcaagcauuccaugguggauagaggcuggggcaacggguguggacuguucggcaaggggggaauugucacaugcgccauguuuacgugcaaaaagaauauggagggcaaaaucguucagccugaaaaccucgaguacaccauugugaucacaccccacagcggggaggaacaugcggugggaaaugacaccggcaagcacggcaaagagaucaagauuacaccucagucuuccagcaccgaagccgagcugacgggguauggaaccgucacaauggaauguucuccccggaccggccuugauuucaacgagauggugcugcuccagauggaggacaaagcuuggcugguucaccgccaaugguuucuugaucugccgcucccuuggcugcccggggccgacacacagggauccaauuggauccagaaggaaacccuggugacguucaagaacccucaugcuaaaaagcaggacgucgugguucucggcagccaagagggggccaugcacacagcccugaccggcgcuacagaaauucagauguccucuggaaaucuucuguuuaccggccaucucaaaugcagacugcggauggauaagcuucagcugaaagggaugagcuacuccauguguaccggaaaguucaagaucgugaaagagauugcggagacacaacacggcacgaucgucaucagagugcaguaugaaggggacggaagccccugcaagauucccuucgagaucauggaucucgaaaaacgccauguccugggccggcugauuaccgugaacccuaucguuacagagaaggacucuccggugaacauugaagccgagcccccuuuuggggauuccuacaucauuaucggcgucgagcccggacagcucaaacugaauugguucaagaagggcagcucuaucgggcagauguuugaaaccacaaugagaggagcuaaacgcauggccauucuuggcgacaccgccugggauuucgggagccugggaggcguguuuacguccauggggaaggcucuccaccaaguuuucggcgccaucuacggagcggcuuuuucuggcgugagcuggacaaugaaaauucugaucggggucauuaucaccuggaucggaaugaacucccggagcaccucucuguccgugagccuugugcucguuggcgucauuacacuguaucugggggccauggugcaggccgacucuggauguguggucuccuggaagaauaaagagcucaagugcggcagcgggaucuucauuaccgauaacgugcacacauggacggaacaguacaaguuucagccugagucccccucuaaacuggcuagcgccauccaaaaggcucaugaagagggcauuuguggaaucagauccguuacccgccuugagaaucugauguggaaacagaucacaccggaacucaaccacauucugucugagaaugaagugaagcugaccaucaugacaggcgacauuaaagggaucaugcaggccggaaagcggagccuuagaccucagcccaccgagcucaaauauuccuggaagacguggggcaaggcgaaaaugcugagcaccgaaucucauaaccaaacauuccugauugaugggccugagaccgccgagugccccaauacaaaccgcgcuuggaauucccucgaagucgaggacuacggauuuggcguguucaccacaaacaucuggcugaagcuucgggaaaaacaggacguuuuuugugauagcaagcugaugucugccgcuaucaaagacaauagagccgugcacgcggauaugggcuauuggauugaguccgcccucaacgacaccuggaagauggagaaggcuagcuucaucgaagucaaaucuugccacuggccuaagagccauacgcugugguccaauggggugcuggagagcgaaaugauuauccccaaaucuuucgccggaccgguuucccagcacaacuaccgcccuggcuauuacacacagaccgcugggcccuggcaucuuggaaagcucgagauggauuuugacuucugugaaggcaccacaguggucgugaccgaggauugcgggaaccggggacccagccugagaacgacaaccgccuccggcaaacugauuacagaguggugcugucggucuugcacccucccuccgcugcgcuacagaggcgaagacggguguugguauggaauggagauccggccccuuaaggaaaaggaggaaaaucuggugaacagccucgucacagccggccacgggcaaauugauaauuuuucccugggaguucugggcauggcucuuuuccucgaggagaugcugagaacccgcguggggacgaaacaugcgauccugcucguggccgucucuuuugugacccugaucacaggaaacaugagcuuccgggaccuuggcagaguuauggugauggucggcgcuaccaugacagaugacauugggaugggagugaccuaccuggcccuccuggccgcuuuuaagguucgcccuacguucgccgcgggccugcuucugagaaaacucacauccaaggaacugaugauggcuaccaucgggauugcccuccugucucagagcacaauccccgagaccauucuugaacugaccgaugcccucgcucugggaaugauggugcugaaaaucguccggaauauggagaaguaucagcuugccgugacaaucauggcgauuuccugcguuccuaacgcugugauccugcaaaaugccuggaaggucagcuguacgauucucgccgcugugucuguguccccccugcuccugaccagcucucagcagaaagccgacuggaucccucuugcucugacaauuaagggccucaaccccaccgccaucuuucugacaacccugucccgcacgagcaaaaagagaucuuggccgcuuaaugaagcgaucauggccgucgggaugguuuccauucuggcuagcucccuccugaaaaacgacaucccuaugacaggaccccucguggccggcggccugcuuaccgugugcuacguccugaccgggcggagcgcugaucuggagcucgagcgcgccacagacgugaagugggaagaucaggccgagauuucuggaagcuccccuauccugucuauuaccaucagcgaagacggcuccaugucuauuaaaaaugaggaggaagagcaaacacuuacgauccugaucagaaccgggcuccugguuauuagcggacucuuccccguguccaucccgauuacagcugcggccugguaucugugggaagucaagaagcagcgggcuggcgugcuuugggauguuccuucucccccucccguggggaaagccgagcuggaagacggagccuaccgcaucaagcagaaaggcauucugggcuauagccagaucggggcuggagucuacaaggagggcaccuuucacacaauguggcacgugaccagaggggccguccucaugcaucggggaaaacgcaucgagcccuccugggcggaugugaagaaggaccugauuagcuacggcgggggauggaaacuugaaggcgaguggaaggaaggcgaggaaguucaagugcuggcucucgagccugggaaaaacccgagagccguccagacgaagcccggacuguucaaaaccaauacaggcaccaucggggccgugucucucgauuuuuccccuggaacaagcggcucucccauuguugaccggaaggggaagguggucggacuguauggcaacggcguggugaccagauccggggcuuacguuagcgccaucgcgcagacagagaaauccauugaagauaauccugagaucgaagacgauaucuuccgcaagaaacggcuuacgauuauggaccugcaccccggagcuggcaagaccaaaagauaucugccugccaucguccgcgaggccauuaagcgggggcucagaacacugauccuugcuccgacccgcgugguggccgcugaaauggaggaggcccugcggggacuccccauuagauaccagaccccugcgauccgcgccgaacauacaggccgggagauugucgaccugaugugucacgcuacguucaccaugagacuccugucucccgugcggguuccuaacuauaaccuuaucaucauggaugaagcccauuuuacagaccccgcuagcauugccgcccgcggguacaucuccaccagaguggagaugggcgaggcugcgggaauuuucaugacagccaccccgccuggcagccgggaucccuuuccccaaucuaaugcuccuaucauggacgaagagcgcgaaauucccgagagauccuggaacagcgggcacgaaugggucacggauuucaagggaaaaacagugugguuuguuccuucuaucaaggccggcaaugacaucgccgcuugccugcggaaaaacgggaagaaagugauucagcugagcagaaagaccuucgauuccgaguaugucaagacccgcacaaaugacugggauuuugugguuaccacagacaucucugagaugggagccaacuucaaagcggaacgggugauugauccgagacgcuguaugaagcccgucauccucaccgacggcgaggaacgggugauucuggcugggccuaugcccgugacgcacagcuccgccgcccagagacgcggccggaucggaagaaauccuaaaaacgagaaugaccaauacaucuacaugggcgaaccccuugagaacgaugaggacugcgcucauuggaaggaagccaaaaugcugcucgauaauauuaacacaccggaggggaucauuccuucuauguuugaacccgagcgcgaaaaggucgacgcgaucgauggagaguauagacugcggggcgaggcccgcaaaaccuucguugaccugaugagacggggggaucucccuguguggcuugcuuaccgcguggccgcugaaggaauuaauuaugccgacagacggugguguuuugauggcgucaagaacaaucagauccuggaggaaaacguggagguugagauuuggacaaaggaaggggagagaaaaaagcugaaaccccgcuggcucgacgcucggaucuacagcgauccucuggcccuuaaggaauucaaagaguucgcggccggcagaaagucccugacccucaaccugaucacggaaaugggacgccugcccaccuuuaugacacagaaggcucgggacgcccucgauaaucuugcugugcugcacaccgccgaggccggcgggagagcuuauaaccaugcgcugagcgagcucccggaaacacuggagacccuucugcuccugacacugcucgccaccgucacgggaggcauuuuccuuuuucugaugucugggaaaggagugggcaagaugacacugggcaugugcugcaucauuaccgcuuccauccuccugugguacgcccagauucaaccucacuggaucgccgcuagcaucauucuugaauucuuucugaucguucuccugauucccgagcccgaaaaacagcggaccccucaggacaaucagcugacauauguggucaucgccauucucaccguggucgcggccacaauggcuaacgagaugggguuccuugagaagacgaaaaaggaccugggacugggcuccaucgccacccaagaaccggagucuaauauccucgauauugaccugcgccccgcuagcgccuggacacuuuacgcgguggccaccacauuuguuaccccuaugcugagacacuccaucgaaaacucuagcgugaaugugucccucacggcuauugccaaccaggcuaccguccugauggggcugggaaagggcuggccccucagcaaaauggauaucgggguuccucuucuggccauuggauguuacucucaggugaaucccgugacacugaccgcugcccuccugcuucuggucgcgcauuaugccaucauuggcccuggccuccaggcuaaggccacacgggaggcucaaaaacgcgccgccgcggggaucaugaagaacccgaccguggacggaaucacgguuauugaucuggaccccaucccuuacgaucccaaauucgaaaagcagcugggccaggugaugcuccuuauucugugcgucacacaggugcugaugaugagaaccacaugggcucucugugaggcccugacccuugcuaccgggccuaucuccacacugugggagggaaaucccggccgguuuuggaacacgaccauugccgucagcauggccaauaucuuccgcgggucuuaucucgcuggagccggccugcuguuuuccaucaugaagaacacaaccaauacaagacggggcaccgggaacauuggagaaacgcucggcgagaaauggaagagccgccuuaaugcgcuggggaaaucugaauuccaaaucuacaagaaaagcggaauucaggagguggacagaacacuggccaaggagggcaucaaacggggggaaaccgaucaccaugcuguuuccagaggaucugccaagcuccgcugguuuguggagcggaacauggucaccccggaaggcaaggugguugaccugggcugcgggagaggaggcuggagcuauuacugugggggacuuaaaaacgugaaggaggucaaaggccugacaaaggggggaccuggccacgaagagcccauucccauguccaccuauggcuggaaucucgugcgccugcagagcgggguggauguuuucuucacaccucccgagaaaugcgacacgcugcucugugauaucggagaauccucuccuaacccgaccaucgaggcuggccggacacuuagaguccugagccugguggaaaauuggcucaacaaugacacccaauuuugcauuaaggugcugaaccccuacaugccuuccgucaucgagaagauggaaacacuucagcgcaaauacgggggagcccugguucggaauccccucucuagaaacagcacccaugagauguauuggguguccaaugcgacgggcaacauugugucuagcgucaauaugaucucccgcaugcugauuaaccgguucaccaugaagcacaaaaaggccacauacgagcuggacguggaucucgggagcggaaccagaaauaucggcaucgaaucugagauuccuaaccuugacaucauuggcaaacgcaucgaaaagauuaagcaggagcacgaaacauccuggcauuaugaucaggaccaccccuacaaaaccugggcuuaucaugggagcuacgagacaaagcaaaccggaucugccuccagcaugguuaauggcgugguccggcugcugacgaaaccgugggaugugguuccuauggugacacagauggcuaugaccgacaccacacccuuugggcagcagagagucuucaaggagaaaguggauacgcgcacccaagaaccuaaggagggaacaaagaaacucaugaagaucaccgccgaauggcuguggaaagagcuuggcaagaaaaagacacccagaauguguacccgggaggaauuuacacgcaaagugagaucuaacgcugcccugggggcgauuuucaccgacgagaacaaguggaaguccgcccgggaagcugucgaggauagcagauuuugggaacucguugacaaagagcggaaucugcaccuggagggaaagugcgaaacguguguguauaacaugaugggcaaacgcgagaagaaacucggcgaauucgggaaggccaagggauccagagcuaucugguacauguggcugggcgcccgguuucuugaguucgaagcccugggguuucucaaugaggaucacugguucagccgcgagaacucucugagcggaguggaaggcgaggggcuucauaaacugggcuacauccucagagacgucggaaagaaagaaggcggggcgauguaugcugacgauaccgccggaugggacacacggauuacccuggaggaucugaagaaugaagagauggugacaaaccacauggagggcgaacauaaaaagcucgccgaggcuaucuuuaagcugaccuaccagaauaaaguugugcgcguccagagaccuacgccccgggggacagugauggacauuaucucccgcagagaucagcggggaucuggccaaguugggaccuauggccuuaacacauucaccaauauggaagcccagcugauucgccagauggagggagagggcaucuucaagagcauccaacaccucacggugaccgaagagauugcuguccagaacuggcuggccagaguggggcgggaacgccuuuccagaauggcgaucucuggagacgauugcguugugaaaccgcuggacgaucgguuugccagcgcucucacagcccugaaugacaugggcaaggucagaaaagauauucagcagugggagccuucccgcggguggaacgacuggacccaagugcccuucugcucucaucacuuucacgaacugaucaugaaggauggacggguccucgugguucccuguagaaaucaggacgagcugauuggccgcgcucggaucagccagggggccggcuggucccuuaaggagacagcgugccugggaaaaagcuacgcccagauguggucucucauguauuuccauagacgcgaccugcggcuugcugccaacgcuaucuguuccgccgugccuagccacugggucccgaccucuagaacaaccugguccauucaugcuaagcacgaauggaugacgacagaggauaugcugaccguguggaaucgcguguggauccaagaaaaccccuggauggaggacaaaaccccuguugaaagcugggaggaggugcccuaccucggcaagcgggaagaucaguggugcgggucccugauuggacugacaucuagaaccacaugggccaaaaacauccagacggcgauuaaucagguccgcagccucaucggcaacgaggaauauaccgacuacaugccuuccaugaagcgguuuagacgggaggaagaggaggccggggugcugugguga

SEQ ID NO: 19695 - RNA, 9876 nt, Artificial Sequence
  derived and/or modified CDS sequence (opt5) from DENV-2__FJ639698__SS-prME
accgccggagugaucauuaugcugauccccaccgcuauggccuuccaccucacgacccggaauggggagccucauaugauugucggacggcaggaaaagggcaagagccugcuuuuuaagacggaggacgggguuaauaugugcacccugauggcgaucgaucucggagaacugugugaggacacaauuaccuacaagugcccccuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaaggaaccugcuacgcugagaaaauauugcaucgaggccaagcucacaaacaccaccacagagagccgguguccgacccagggagaacccucucugaaugaggaacaagacaaacgcuuugucugcaagcauuccaugguggauagaggcuggggcaacggguguggacuguucggcaaaggcgggauugugacaugcgcgauguuuagcugcaaaaagaauauggaggggaaaaucguccagccugaaaaccucgaguacacgauuguuaucacaccccacucuggggaggaacaugccgugggaaaugacacaggcaagcacggcaaagagaucaagauuaccccucaguccagcaucacagaagcugagcugaccggguauggaacggugaccauggaauguucuccccggacaggccuugauuucaacgagaugguccugcuccagauggaggacaaagccuggcuggugcaccgccaaugguuucuugaucugccgcucccuuggcugcccggggcugacacccagggauccaauuggauucagaaggaaacacugguuaccuucaagaacccucaugccaaaaagcaggacguggucgugcucggcagccaagagggggccaugcacacggcucugacaggcgcgaccgaaauccagauguccucuggaaaucuucuguuuacaggccaucucaaaugcagacugcggauggauaaacuucagcugaaagggaugagcuacuccauguguaccggaaaguucaagauuguuaaagagaucgccgagacccaacacggcacaaucgugauuagaguccaguaugaaggggacggaagccccugcaagauccccuucgagauuauggaucucgaaaaacgccaugugcugggccggcugaucacggucaacccuauuaucaccgagaaggacucuccggugaacauugaagcugagcccccuuuuggggauuccuacaucaucauuggcguugagcccggacagcucaaacugaauugguucaagaagggcagcucuaucgggcagauguuugaaacaaccaugagaggagccaaacgcauggccauucuuggcgacacagcuugggauuucgggagccugggaggcguguuuaccuccaucgggaaggcccuccaccaagucuucggcgcgauuuacggagcugccuuuucuggcgugagcuggacgaugaaaauccugaucgggguuauuaucacauggauuggaaugaacucccggagcaccucucuguccgugagccuuguccucgugggcgugaucacccuguaucugggggccaugguucaggcugacucuggaugugucguguccuggaagaauaaagagcucaagugcggcagcgggauuuucaucacagauaacgugcacaccuggacagaacaguacaaguuucagccugagucccccucuaaacuggccagcgcuauccaaaaggcccaugaagagggcauuuguggaaucagauccgucacgcgccuugagaaucugauguggaaacagauuaccccggaacucaaccacauccugucugagaaugaagugaagcugacaauuaugaccggcgacaucaaagggaucaugcaggcgggaaagcggagccuuagaccucagcccacagagcucaaauauuccuggaagaccuggggcaaggccaaaaugcugagcacggaaucucauaaccaaaccuuccugauugaugggccugagacagcugagugccccaauaccaaccgcgccuggaacucccucgaaguugaggacuacggauuuggcguguucacaaccaacaucuggcugaaacuuaaagaaaagcaggacgucuuuugugauccuaaacugaugagcgcugccauuaaggacaaucgggcggugcacgccgauaugggcuauuggaucgagucugcucucaacgacacauggaagauggagaaagccuccuucauugaaguuaagagcugccacuggcccaaaucucauacccuguggagcaauggggugcuggaguccgaaaugaucauuccgaagggauucgcuggcccugucagccagcacaacuacagacccggguauuacacgcagacagccggacccuggcaucuuggcaaacucgagauggauuuugacuucugugaagggaccaccgugguugugacagaggauugcggaaaccgcggcccuucucugcggaccacgacagccuccggcaagcugaucaccgaguggugcuguagaagcugcacacucccgccccugcgguaccgcggggaagacggauguugguauggcauggagaucagaccucuuaaggaaaaagaggaaaaucuggucaacucccucgugaccgcugggcacggacaaauugauaauuuuucucugggcgugcuggggauggcgcuuuuccucgaggagaugcugcggacaagagucggaaccaagcaugccauccugcucguugcugugagcuuugugacgcugauuaccggcaacauguccuuccgcgaccuuggccgggucauggugaugguuggggccacaaugaccgaugacaucggaaugggcgugacauaccuggcccuccuggcugccuuuaaagucagacccaccuucucugcggggcugcuucugcgcaagcucacgagcaaagaacugaugauggcuacaauuggaaucgcccuccugucccagucuaccaucccugagacaauucuugaacugaccgaugcccucgcucugggcaugauggugcugaagaucguuagaaauauggagaaguaucagcuugccgugaccauuauggcgaucagcugcguccccaacgcugugauucugcaaaaugccuggaaaguuuccuguacaauccucgccgcugugagcgucucuccucugcuccugacguccagccagcagaaggccgacuggaucccccuugcucugaccauuaaagggcucaacccgacagccaucuuucugaccacacugucucggaccuccaagaaacgcagcuggccucuuaaugaagcgauuauggccgugggaauggugucuauccuggcuuccagccuccugaagaacgacauucccaugacgggcccucucgucgccggcgggcugcuuacaguuugcuacgugcugaccggaagauccgcugaucuggagcucgagcgggccaccgacgugaaaugggaagaucaggccgagaucagcggcucuagccccauucuguccaucacaaucucugaagacgggagcauguccauuaagaaugaggaggaggaacaaacccuuacaauccugauucgcacgggacuccuggucaucucuggccucuucccggugagcauuccuaucaccgcugcggccugguaucugugggaaguuaagaaacagagagcuggggugcuuugggauguccccuccccuccgcccgugggaaaggccgagcuggaagacggcgccuaccggaucaaacagaagggcauucugggguauucucagaucggagcuggcguuuacaaagaggggacauuucacaccauguggcacgugacacgcggagccguccucaugcauagaggcaagcggauugagccuagcugggcggaugugaagaaagaccugaucuccuacgggggaggcuggaaacuugaaggcgaguggaaagaaggggaggaaguccaagugcuggcucucgagccgggaaagaacccccgcgccguucagaccaaaccuggccuguucaagacgaauaccgggacaauuggagccgugagccucgauuuuucucccggcaccuccgggagcccuaucgucgacagaaagggaaaagugguuggccuguauggcaacgggguggucacacggucuggagcuuacguguccgccaucgcgcagaccgaaaagagcauugaagauaaucccgagaucgaagacgauauuuuccgcaagaagcgccuuacaaucauggaccugcacccuggcgcugggaaaacgaagcgguaucugccggccauugugagagaggccaucaagcgcggacuccggacccugauucuugcucccacaagaguugucgccgcugaaauggaggaggcccugcgcggccucccuauccgguaccagacccccgcgaucagagccgaacauaccgggcgcgagauuguggaccugaugugucacgcuacauucacgaugcggcuccuguccccugugagaguccccaacuauaaccuuaucauuauggaugaagcccauuuuaccgacccggcuucuaucgccgcccggggcuacauuagcacacgcguggagaugggagaggcugcgggcaucuucaugaccgccacaccucccggguccagagaucccuuuccucaaagcaaugcucccaucauggacgaagaacgggaaauuccugagcgcucuuggaacuccggacacgaauggguuaccgauuucaaaggcaagacggugugguuugucccgagcaucaaagccgggaaugacauugccgcuugccugagaaagaacggcaagaaggugauccagcugucucggaagacauucgauagcgaguauguuaaaaccagaaccaaugacugggauuuuguggucacaaccgacauuuccgagaugggcgccaacuucaaggcggaacgcgugaucgauccccggagauguaugaaaccuguuauccucacagacggggaggaacgcgugauucuggcuggccccaugccugucacccacucuagcgccgcccagcggagaggacgcaucggccggaaucccaagaacgagaaugaccaauacauuuacaugggggaaccgcuugagaacgaugaggacugcgcucauuggaaagaagccaagaugcugcucgauaauaucaacacgccugagggaauuauccccuccauguuugaaccugagagagaaaaaguggacgcgauugauggcgaguaucgccugagaggggaggcccggaagacauucguggaccugaugcgcagaggagaucuccccgucuggcuugcuuaccggguugccgcugaaggcaucaauuaugccgaccgcagaugguguuuugauggggugaagaacaaucagauccuggaggaaaacguggaggucgagauuuggaccaaagaaggcgagcggaagaaacugaagccuagauggcucgacgcucgcaucuacucugauccccuggcccuuaaagaguucaaggaguucgcggccggaagaaagagccugacacucaaccugauuaccgaaaugggcagacugccgacguuuaugacccagaaagcucgcgacgcccucgauaaucuugcugugcugcacacagccgagguugggggacgggccuauaaccaugcucuguccgagcucccugaaacccuggagacacuucugcuccugacccugcucgcgacagugaccggcgggaucuuccuuuuucugaugagcggaaagggcgucggcaaaaugacgcuggggaugugcugcauuaucacagccucuauccuccugugguacgcucagauucaaccccacuggaucgccgccuccauuauccuugaguucuuucugauugugcuccugauccccgagccugaaaagcagagaaccccgcaggacaaucagcugaccuauguugugaucgcuauucucacagucguggccgcgaccauggccaacgagaugggauuccuugagaaaacaaagaaggaccugggccuggggagcaucgcuacgcaagaacccgaguccaauauucucgauaucgaccugcggccugccucugcuuggacccuuuacgccgucgcgacaaccuuugugacacccaugcugcgccacagcauugaaaacuccucuguuaaugugagccucaccgccaucgcuaaccaggccacggugcugaugggacugggcaaaggguggccucucuccaagauggauauuggagucccccuucuggcuaucggcuguuacagccagguuaauccuaucacccugacagccgcucuccugcuucugguggcccauuaugcgauuaucggcccggggcuccaggccaaagcuaccagagaggcccaaaagcgggcugccgccggaauuaugaaaaaccccacaguggacggcaucaccgucauugaucuggacccuauccccuacgauccuaaguucgaaaagcagcugggacaggugaugcuccuuauccugugcguuacacaggugcugaugaugcgcacaaccugggcgcucugugaggcucugacacuugccaccggacccauuucuacccugugggagggcaauccggggagauuuuggaacacaacgaucgcugucuccauggccaauauuuuccggggaagcuaucucgccggcgcuggccugcuguuuucuaucaugaaaaacaccacaaauacccgcagagggacaggaaacauuggcgaaacccucggggagaaguggaaaucccggcuuaaugcccugggaaagaacgaguuccaaaucuacaaaaagagcggcauccaggagguggaccgcacgcuggcgaaagaggggauuaagagaggagaaacagaucaccaugccgucucucggggcagcgcuaagcucagaugguuuguggagcgcaacaugguuaccccugaaggcaaaguggucgaccuggggugcggacggggcgggugguccuauuacuguggaggccuuaagaaugugagagagguuaaagggcugaccaagggaggccccggccacgaagaacccaucccuaugucuacauauggguggaaccucgugcgccugcagagcggagucgauguguucuucacacccccugagaaaugcgacacccugcucugugauauuggcgaauccagcccgaaucccacgaucgaggccgggcggacccuuagagugcugucccugguugaaaacuggcucaauaacgacacacaauuuugcauuaagguccugaauccuuacaugcccucugugaucgagaagauggaaacccuucagcgcaaauacggaggcgcucuggugcggaacccucucagcagaaauuccacacaugagauguauugggucucuaacgccaccgggaauaucguuagcuccgugaacaugauuucucgcaugcugaucaaucgguucacgaugaagcacaaaaaggcgaccuacgagcccgacguggaucugggaagcggcacaagaaacauuggcaucgaauccgagauuccgaaucucgacaucauugggaaacgcaucgaaaagaucaagcaggagcacgaaaccagcuggcauuaugaucaggaccacccuuacaaaacaugggccuaucauggaucuuacgagaccaagcaaacaggcuccgcuagcucuauggucaacggggugguucggcuucugaccaaacccugggauguggucccuauggugacgcagauggccaugacagacaccacccccuuuggacagcagagaguuuucaaggagaaaguggauacacgcacgcaagaaccuaaggagggcaccaagaaacugaugaagauuacagcuaaauggcucuggaaggaacuggggaaaaagaaaacccccagaaucuguacacgggaggaguuuaccaagaagguccgcuccaacgccgcucuuggagccauuuucacagacgaaaauaaauggaaaagcgcgagagaggccguggaagauucucgguuuugggagcugguggacaaagaaagaaaccuccaccuggagggcaagugcgagaccugugucuauaauaugaugggcaaacgggaaaagaagcugggggaguucggaaaagcuaagggcucccgcgccaucugguacauguggcucggggcuagauuucuggaguucgaggcccuuggauuucugaacgaagaucacugguucagccgggaaaauucccucagcggcguugagggggaaggccugcauaaacuuggauacauucugcgcgacgugucuaagaaagagggcggggccauguaugcggacgauacggcuggaugggacaccagaaucacacucgaagaucugaagaacgaggaaauggugaccaaucacauggagggcgagcauaagaaacuggccgaagccaucuuuaagcucacauaccagaacaaagucgugcggguucagcgcccgaccccuagagggacggugauggacauuaucagccggcgcgaucagagaggauccggccaagucgggacauauggccugaauaccuucacaaacauggaggcucagcuuauucggcagauggaaggagagggcaucuucaagucuauucaacaccugaccgugacggaggaaguugccgugcagaauuggcucgcucgcgucgggagagagcggcugagccgcauggccaucuccggagacgauugcgugguuaaaccccuugacgauagauuugcgucugcccugaccgcucucaacgacaugggcaaggugcggaaggauauccagcagugggaacccagcagaggguggaaugacuggacacaagucccuuucugcucccaucacuuucacgagcugauuaugaaagauggacgcgugcuggucgugccgugucggaaccaggacgaacucaucggcagagcccgcauuucucagggggcuggcuggagccugaaggagaccgccugccuuggaaaauccuacgcgcagauguggagccugauguauuuccaucggagagaccuccgccuggccgcuaaugccaucuguucugcuguucccucccacugggugccuacaagccggaccacauggucuauucaugccaagcacgaguggaugaccacggaagauaugcuuacagucuggaacagaguguggauccaagagaaccccuggauggaagacaaaaccccuguggaguccugggaagagguucccuaccugggcaagcgcgaggaucaguggugcgggagccucauuggacugaccucccgggcuacaugggccaagaauauccagaccgcgaucaaccaggugagaucucugauuggcaaugaagaguauacagacuacaugccuagcaugaaacgcuuucggagagaagaggaagaggccgggguccucugguga

SEQ ID NO: 19696 - RNA, 9876 nt, Artificial Sequence
  derived and/or modified CDS sequence (opt5) from DENV-2__FJ639699__SS-prME
accgccggagugaucauuaugcugauccccaccgcuauggccuuccaccucacgaccagaaauggggagccucauaugauugugggacggcaggaaaagggcaagagccugcuuuuuaagacagaggacgggguuaauaugugcacccugauggcgaucgaucucggagaacugugugaggacacaauuaccuacaagugcccgcuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaaggaaccugcuacgcugagaaaauauugcaucgaggccaagcucacaaacaccaccacagagagccgguguccgacccagggagaacccucucugaaugaggaacaagacaaacgcuuugucugcaagcauuccaugguggauagaggcuggggcaacggguguggacuguucggcaaagggggaauugugacaugcgcgauguuuagcugcaaaaagaauauggagggcaaaaucguccagccugaaaaccucgaguacacgauuguuaucacaccccacucuggggaggaacaugccgugggaaaugacacaggcaagcacggcaaagagaucaagauuaccccucaguccagcaucacagaagcugagcugaccggguauggaacggugaccauggaauguucuccccggacaggccuugauuucaacgagaugguccugcuccagauggaggacaaagccuggcuggugcaccgccaaugguuucuugaucugccgcucccuuggcugcccggggcugacacccagggauccaauuggauucagaaggaaacacugguuaccuucaagaacccucaugccaaaaagcaggacguggucgugcucggcagccaagagggggccaugcacacggcucugacaggcgcgaccgaaauccagauguccucuggaaaucuucuguuuacaggccaucucaaaugcagacugcggauggauaaacuucagcugaaagggaugagcuacuccauguguaccggaaaguucaagauuguuaaagagaucgccgagacccaacacggcacaaucgugauuagaguccaguaugaaggggacggaagccccugcaagauccccuucgagauuauggaucucgaaaaacgccaugugcugggccggcugaucacggucaacccuauuaucaccgagaaggacucuccggugaacauugaagcugagcccccuuuuggggauuccuacaucaucauuggcguugagcccggacagcucaaacugaauugguucaagaagggcagcucuaucgggcagauguuugaaacaaccaugagaggagccaaacgcauggccauucuuggcgacacagcuugggauuucgggagccugggaggcguguuuaccuccaucgggaaggcccuccaccaagucuucggcgcgauuuacggagcugccuuuucuggcgugagcuggacgaugaaaauccugaucgggguuauuaucacauggauuggaaugaacucccggagcaccucucuguccgugagccuuguccucgugggcgugaucacccuguaucugggggccaugguucaggcugacucuggaugugucguguccuggaagaauaaagagcucaagugcggcagcgggauuuucaucacagauaacgugcacaccuggacagaacaguacaaguuucagccugagucccccucuaaacuggccagcgcuauccaaaaggcccaugaagagggcauuuguggaaucagauccgucacgcgccuugagaaucugauguggaaacagauuaccccggaacucaaccacauccugucugagaaugaagugaagcugacaauuaugaccggcgacaucaaagggaucaugcaggcgggaaagcggagccuuagaccucagcccacagagcucaaauauuccuggaagaccuggggcaaggccaaaaugcugagcacggaaucucauaaccaaaccuuccugauugaugggccugagacagcugagugccccaauaccaaccgcgccuggaacucccucgaaguugaggacuacggauuuggcguguucacaaccaacaucuggcugaaacuuaaagaaaagcaggacgucuuuugugauagcaaacugaugucugcugccauuaaggacaaucgggcggugcacgccgauaugggcuauuggaucgaguccgcucucaacgacacauggaagauggagaaagccagcuucauugaaguuaagucuugccacuggccuaaaagccauacccugugguccaauggggugcuggagagcgaaaugaucauucccaagggauucgcuggcccggucucucagcacaacuacagaccuggguauuacacgcagacagccggacccuggcaucuuggcaaacucgagauggauuuugacuucugugaagggaccaccgugguugugacagaggauugcggaaaccgcggccccucccugcggaccacgacagccagcggcaagcugaucaccgaguggugcuguagauccugcacacucccuccgcugcgguaccgcggggaagacggauguugguauggcauggagaucagaccccuuaaggaaaaagaggaaaaucuggucaacucucucgugaccgcugggcacggacaaauugauaauuuuagccugggcgugcuggggauggcgcuuuuccucgaggagaugcugcggacaagagucggaaccaagcaugccauccugcucguugcuguguccuuugugacgcugauuaccggcaacaugucuuuccgcgaccuuggccgggucauggugaugguuggggccacaaugaccgaugacaucggaaugggcgugacauaccuggcccuccuggcugccuuuaaagucagaccuaccuucgcggcugggcugcuucugcgcaagcucacgagcaaagaacugaugauggccacaauuggaaucgcccuccugucccagucuaccauccccgagacaauucuugaacugaccgaugcucucgcccugggcaugaugauccugaagauugugagaaauauggagaaguaucagcuugcgguuaccaucauggcuauuagcugcgugccuaacgccgucauccugcaaaaugccuggaaaguguccuguacaauccucgcugccguuagcgugucuccccugcuccugacguccagccagcagaaggcugacuggauuccucuugcccugaccaucaaagggcucaaccccacagcgauuuuucugaccacacugucucggaccuccaagaaacgcagcuggccgcuuaaugaagccaucauggcugucggaauggugucuauucuggccuccagccuccugaagaacgacaucccuaugacgggcccccucguggcuggcgggcugcuuacagucugcuacguucugaccggaagauccgccgaucuggagcucgagcgggccaccgacgugaaaugggaagaucaggcugagauuagcggcucuagcccuauccuguccaucacaauuucugaagacgggagcauguccaucaagaaugaggaggaggaacaaacccuuacaauucugauccgcacgggacuccuggugauuucuggccucuuccccgucagcaucccgaucaccgcggccgcuugguaucugugggaagugaagaaacagagagccgggguucuuugggaugugccuucucccccucccgucggaaaggccgagcuggaagacggcgcuuaccggauuaaacagaagggcauccugggguauagccagauuggagccggcguguacaaagaggggacauuucacaccauguggcacguuacacgcggagcggugcucaugcauagaggcaagcggaucgagcccagcugggcugaugucaagaaagaccugauuuccuacgggggaggcuggaaacuugaaggcgaguggaaagaaggggaggaagugcaaguccuggcccucgagccuggaaagaacccgcgcgccgugcagaccaaacccggccuguucaagacgaauaccgggacaaucggagcuguuagccucgauuuuucuccuggcaccuccgggagccccaucguggacagaaagggaaaagucgugggccuguauggcaacgggguugugacacggucuggagccuacgucuccgcgauugcucagaccgaaaagagcaucgaagauaauccugagauugaagacgauaucuuccgcaagaagcgccuuacaauuauggaccugcaccccggcgccgggaaaacgaagcgguaucugccugccaucgugagagaggcuauuaagcgcggacuccggacccugauccuugccccgacaagagugguugcugccgaaauggaggaggcgcugcgcggccuccccauccgguaccagaccccugccauuagagcugaacauaccgggcgcgagaucgucgaccugaugugucacgccacauucacgaugcggcuccugucccccgugagagugccuaacuauaaccuuauuaucauggaugaagcucauuuuaccgaccccgccucuauugccgcucggggcuacaucagcacacgcgucgagaugggagaggcggccggcaucuucaugaccgcuacaccgccuggguccagagaucccuuuccccaaagcaaugccccuauuauggacgaagaacgggaaauccccgagcgcucuuggaacuccggacacgaaugggugaccgauuucaaaggcaagacgguuugguuugugccuagcauuaaagccgggaaugacaucgcugccugccugagaaagaacggcaagaaggucauucagcugucucggaagacauucgauagcgaguaugugaaaaccagaaccaaugacugggauuuuguugugacaaccgacaucuccgagaugggcgcgaacuucaaggcugaacgcgucaucgauccgcggagauguaugaaacccgugauucucacagacggggaggaacgcguuauccuggccggcccuaugcccgugacccacucuagcgccgcucagcggagaggacgcauuggccggaauccuaagaacgagaaugaccaauacaucuacaugggggaaccccuugagaacgaugaggacugcgcccauuggaaagaagcgaagaugcugcucgauaauauuaacacgccggagggaaucauuccuuccauguuugaacccgagagagaaaaagucgacgccaucgauggcgaguaucgccugagaggggaggcucggaagacauucguggaccugaugcgcagaggagaucucccuguguggcuugccuaccgggucgcugccgaaggcaucaauuaugcugaccgcagaugguguuuugaugggguuaagaacaaucagauucuggaggaaaacguggagguggagaucuggaccaaagaaggcgagcggaagaaacugaagcccagauggcucgacgcccgcauuuacucugauccucuggcgcuuaaagaguucaaggaguucgccgcuggacggaagucccugacacucaaccugaucaccgaaaugggcagacugcccacguuuaugacccagaaagcccgcgacgcucucgauaaucuugccguccugcacacagccgaggucgggggacgggcuuauaaccaugcgcuguccgagcucccggaaacccuggagacacuucugcuccugacccugcucgccacaguuaccggcgggauuuuccuuuuucugaugagcggaaagggcgugggcaaaaugacgcuggggaugugcugcaucaucacagcuucuauucuccugugguacgcccagauccaaccucacuggauugccgcuuccaucauucuugaguucuuucugaucguccuccugauccccgagcccgaaaagcagagaaccccucaggacaaucagcugaccuaugugguuauugccauccucacaguggucgcggccaccauggcuaacgagaugggauuccuugagaaaacaaagaaggaccugggccuggggagcauugccacgcaagaaccggaguccaauauccucgauauugaccugcggcccgcuucugccuggacccuuuacgcgguggccacaaccuuugucacaccuaugcugcgccacagcaucgaaaacuccucugugaauguuagccucaccgcuauugccaaccaggcuacggugcugaugggacugggcaaaggguggccccucuccaagauggauaucggagugccucuucuggccaucggcuguuacagccaggucaaucccauuacccugacagcugcccuccugcuucugguugcgcauuaugccaucauuggcccugggcuccaggcuaaagccaccagagaggcucaaaagcgggccgccgcgggaaucaugaaaaacccgacaguggacggcauuaccgugaucgaucuggaccccaucccuuacgaucccaaguucgaaaagcagcuggggcaggucaugcuccuuauucugugcgugacgcagguucugaugaugcgcacaaccugggcucucugugaggcccugacacuugcuaccggaccuaucucuacccugugggagggcaaucccgggagauuuuggaacacaacgauugccguguccauggccaauaucuuccggggaagcuaucucgcuggcgccggccugcuguuuucuauuaugaaaaacaccacaaauacccgcagagggacaggaaacaucggcgaaacccucggggagaaguggaaaucccggcuuaaugcgcugggaaagaacgaguuccaaaucuacaaaaagagcggcauucaggaggucgaccgcacgcuggccaaagaggggaucaagagaggagaaacagaucaccaugcugugucucggggcagcgccaagcucagaugguuugucgagcgcaacauggugaccccggaaggcaaaguuguggaccuggggugcggacggggcgggugguccuauuacuguggaggccuuaagaaugucagagaggugaaagggcugaccaagggaggcccuggccacgaagaacccauucccaugucuacauauggguggaaccucguucgccugcagagcggaguggaugucuucuucaccccucccgagaaaugcgacacacugcucugugauaucggcgaauccagcccuaauccgacgauugaggcugggcggacccuuagagugcugucccugguggaaaacuggcucaauaacgacacacaauuuugcaucaagguucugaaucccuacaugccuucugucaucgagaagauggaaacccuucagcgcaaauacggaggcgcccuggugcggaacccccucagcagaaauuccacacaugagauguauugggugucuaacgcgaccgggaauauugucagcuccguuaacaugaucucucgcaugcugauuaaucgguucacgaugaagcacaaaaaggccaccuacgagccugacguggaucugggaagcggcacaagaaacaucggcauugaauccgagauccccaaucucgacauuaucgggaaacgcaucgaaaagauuaagcaggagcacgaaaccagcuggcauuaugaucaggaccacccguacaaaacaugggcuuaucauggaucuuacgagaccaagcaaacaggcuccgccagcucuauggugaacggggucgugcggcuucugaccaaaccuugggauguugugcccauggucacgcagauggcuaugacagacaccaccccuuuuggacagcagagaguguucaaggagaaaguugauacacgcacgcaagaacccaaggagggcaccaagaaacugaugaagaucacagccaaauggcucuggaaggaacuggggaaaaagaaaaccccuagaauuuguacacgggaggaguuuaccaagaaggugcgcuccaacgcugcccuuggagcgaucuucacagacgaaaauaaauggaaaagcgccagagaggcugucgaagauucucgguuuugggagcugguggacaaagaaagaaaccuccaccuggagggcaagugcgagaccuguguguauaauaugaugggcaaacgggaaaagaagcugggggaguucggaaaagccaagggcucccgcgcuauuugguacauguggcucggggccagauuucuggaguucgaggcccuuggauuucugaacgaagaucacugguucagccgggaaaauucccucagcggcgucgagggggaaggccugcauaaacuuggauacauccugcgcgacguuucuaagaaagagggcggggcgauguaugcugacgauacggccggaugggacaccagaaucacacucgaagaucugaagaacgaggaaauggugaccaaucacauggagggcgagcauaagaaacuggccgaagcuauuuuuaagcucacauaccagaacaaagugguccgggugcagcgccccaccccgagagggacgguuauggacaucauuagccggcgcgaucagagaggauccggccaaguggggacauauggccugaauaccuucacaaacauggaggcccagcuuauccggcagauggaaggagagggcauuuucaagucuauccaauaccugaccgucacggaggaaguggcuguucagaauuggcucgcccgcguggggagagagcggcugagccgcauggcgaucuccggagacgauugcgucgugaaaccucuugacgauagauuugccucugcucugaccgcccucaacgacaugggcaagguucggaaggauauucagcagugggaacccagcagaggguggaaugacuggacacaagugcccuucugcucccaccauuuucacgagcugaucaugaaagauggacgcguccugguggucccuugucggaaccaggacgaacucauuggcagagcucgcaucucucagggggccggcuggagccugaaggagaccgcgugccuuggaaaauccuaugcccagauguggagccugauguacuuccaccggagagaccuccgccuggcugccaaugcuauuuguucugccgugccgucccauuggguucccacaagccggaccacauggucuauccacgcuaagcaugaguggaugaccacggaagauaugcuuacaguguggaacagagucuggauucaagagaacccuuggauggaagacaaaacccccguggaguccugggaagaggugccuuaucugggcaagcgcgaggaucaguggugcgggagccucaucggacugaccucccgggccacaugggcgaagaauauccagaccgccauuaaccagguuagaucucugaucggcaaugaagaguacacagacuacaugcccagcaugaaacgcuuucggagagaagaggaagaggcuggggugcucugguga

SEQ ID NO: 19697 - RNA, 9876 nt, Artificial Sequence
  derived and/or modified CDS sequence (opt5) from DENV-2__FJ639700__SS-prME
accgccggagugaucauuaugcugauccccaccgcuauggccuuccaccucacgaccagaaauggggagccucauaugauugucggacggcaggaaaagggcaagagccugcuuuuuaagacggaggacgggguuaauaugugcacccugauggcgaucgaucucggagaacugugugaggacacaauuaccuacaagugcccgcuucugagacaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaagcacgcccagcggaucgagaccuggauucugcgccaucccggguucacaaucauggcugccauucucgcuuacaccaucggaaccacacacuuucagagagcccugauuuucauccuucugacggcgguugccccuagcaugaccaugcggugcauuggcaucuccaaccgcgauuuuguggaaggggucucuggaggcagcuggguggacaucguucucgagcacggguccugugugacaaccauggcuaagaauaagcccacacuggauuucgaacuuauuaaaaccgaggccaaggaaccugcuacgcugagaaaauauugcaucgaggccaagcucacaaacaccaccacagagagccgguguccgacccagggagaacccucucugaaugaggaacaagacaaacgcuuugucugcaagcauuccaugguggauagaggcuggggcaacggguguggacuguucggcaaaggcgggauugugacaugcgcgauguuuagcugcaaaaagaauauggaggggaaaaucguccagccugaaaaccucgaguacacgauuguuaucacaccccacucuggggaggaacaugccgugggaaaugacacaggcaagcacggcaaagagaucaagauuaccccucaguccagcaucacagaagcugagcugaccggguauggaacggugaccauggaauguucuccccggacaggccuugauuucaacgagaugguccugcuccagauggaggacaaagccuggcuggugcaccgccaaugguuucuugaucugccgcucccuuggcugcccggggcugacacccagggauccaauuggauucagaaggaaacacugguuaccuucaagaacccucaugccaaaaagcaggacguggucgugcucggcagccaagagggggccaugcacacggcucugacaggcgcgaccgaaauccagauguccucuggaaaucuucuguuuacaggccaucucaaaugcagacugcggauggauaaacuucagcugaaagggaugagcuacuccauguguaccggaaaguucaagauuguuaaagagaucgccgagacccaacacggcacaaucgugauuagaguccaguaugaaggggacggaagccccugcaagauccccuucgagauuauggaucucgaaaaacgccaugugcugggccggcugaucacggucaacccuauuaucaccgagaaggacucuccggugaacauugaagcugagcccccuuuuggggauuccuacaucaucauuggcguugagcccggacagcucaaacugaauugguucaagaagggcagcucuaucgggcagauguuugaaacaaccaugagaggagccaaacgcauggccauucuuggcgacacagcuugggauuucgggagccugggaggcguguuuaccuccaucgggaaggcccuccaccaagucuucggcgcgauuuacggagcugccuuuucuggcgugagcuggacgaugaaaauccugaucgggguuauuaucacauggauuggaaugaacucccggagcaccucucuguccgugagccuuguccucgugggcgugaucacccuguaucugggggccaugguucaggcugacucuggaugugucguguccuggaagaauaaagagcucaagugcggcagcgggauuuucaucacagauaacgugcacaccuggacagaacaguacaaguuucagccugagucccccucuaaacuggccagcgcuauccaaaaggcccaugaagagggcauuuguggaaucagauccgucacgcgccuugagaaucugauguggaaacagauuaccccggaacucaaccacauccugucugagaaugaagcgaagcugacaauuaugaccggcgacaucaaagggaucaugcaggccggaaagcggagccuuagaccucagcccacagagcucaaauauuccuggaagaccuggggcaaggcuaaaaugcugagcacggaaucucauaaccaaaccuuccugauugaugggccugagacagccgagugccccaauaccaaccgcgcuuggaacucccucgaaguggaggacuacggauuuggcguuuucacaaccaacaucuggcugaaacuuaaagaaaagcaggacguguuuugugauagcaaacugaugucugccgcgauuaaggacaaucgggccguccacgcugauaugggcuauuggaucgaguccgcccucaacgacacauggaagauggagaaagcuagcuucauugaagugaagucuugccacuggccuaaaagccauacccugugguccaaugggguucuggagagcgaaaugaucauucccaagggauucgccggcccggugucucagcacaacuacagaccuggguaucauacgcagacagccggacccuggcaccuuggcaaacucgagauggauuuugacuucugugaagggaccaccgucgugguuacagaggauugcggaaaccgcggccccucccugcggaccacgacagcuagcggcaagcugaucaccgaguggugcuguagauccugcacacucccuccgcugcgguaccgcggggaagacggauguugguacggcauggagaucagaccccuuaaggaaaaagaggaaaaucuggugaacucucucgucaccgcggggcauggacaaauugauaauuuuagccugggcgugcuggggauggcccuuuuccucgaggagaugcugcggacaagagugggaaccaagcacgcuauccugcucgucgccguuuccuuugugacgcugauuaccggcaacaugucuuuccgcgaccuuggccgggugauggucauggugggggccacaaugaccgaugacaucggaaugggcguuacauaucuggcucuccuggccgcguuuaaagugagaccuaccuucgcugccgggcugcuucugcgcaagcucacgagcaaagaacugaugauggccacaauuggaaucgcucuccugucccagucuaccauccccgagacaauucuugaacugaccgaugcccucgcgcugggcaugaugauccugaagauugucagaaauauggagaaguaccagcuugcugugaccaucauggccauuagcugcguuccuaacgccgugauccugcaaaaugcuuggaaagucuccuguacaauccucgccgcugugagcguuucuccccugcuccugacguccagccagcagaaggccgacuggauuccucuugcgcugaccaucaaagggcucaaccccacagccauuuuucugaccacacugucucggaccuccaagaaacgcagcuggccgcuuaaugaagcuaucauggccgugggaauggucucuauucuggcuuccagccuccugaagaacgacaucccuaugacgggcccccucguggccggcgggcugcuuacagugugcuauguccugaccggaagauccgccgaucuggagcucgagcgggcuaccgacguuaaaugggaagaucaggcggagauuagcggcucuagcccuauccuguccaucacaauuucugaagacgggagcauguccaucaagaaugaggaggaggaacaaacccuuacaauucugauccgcacgggacuccuggugauuucuggccucuuccccgugagcaucccgaucaccgccgcugccugguaccugugggaagucaagaaacagagagccggggugcuuugggauguuccuucucccccucccgugggaaaggcugagcuggaagacggcgccuaucggauuaaacagaagggcauccugggguacagccagauuggagcgggcgucuauaaagaggggacauuucacaccauguggcaugugacacgcggagcuguucucaugcacagaggcaagcggaucgagcccagcugggccgaugugaagaaagaccugauuuccuacgggggaggcuggaaacuugaaggcgaguggaaagaaggggaggaaguccaagugcuggcccucgagccuggaaagaacccgcgcgcuguccagaccaaacccggccuguucaagacgaauaccgggacaaucggagccgugagccucgauuuuucuccuggcaccuccgggagccccaucguugacagaaagggaaaaguggucggccuguacggcaacggggugguuacacggucuggagcguauguguccgcuauugcccagaccgaaaagagcaucgaagauaauccugagauugaagacgauaucuuccgcaagaagcgccuuacaauuauggaccugcaucccggcgccgggaaaacgaagcgguaccugccugcuaucgucagagaggccauuaagcgcggacuccggacccugauccuugcuccgacaagagugguggccgcggaaauggaggaggcccugcgcggccuccccauccgguaucagaccccugcuauuagagccgaacacaccgggcgcgagaucguugaccugaugugucaugcuacauucacgaugcggcuccugucccccgucagagugccuaacuacaaccuuauuaucauggaugaagcccacuuuaccgaccccgccucuauugcugcgcggggcuauaucagcacacgcguggagaugggagaggccgcuggcaucuucaugaccgccacaccgccuggguccagagaucccuuuccccaaagcaaugccccuauuauggacgaagaacgggaaauccccgagcgcucuuggaacuccggacacgaaugggucaccgauuucaaaggcaagacggugugguuuguuccuagcauuaaagcugggaaugacaucgccgcgugccugagaaagaacggcaagaaggugauucagcugucucggaagacauucgauagcgaguacgucaaaaccagaaccaaugacugggauuuugugguuacaaccgacaucuccgagaugggcgcuaacuucaaggccgaacgcgugaucgauccgcggagauguaugaaacccgucauucucacagacggggaggaacgcgugauccuggccggcccuaugcccguuacccauucuagcgcugcccagcggagaggacgcauuggccggaauccuaagaacgagaaugaccaauauaucuacaugggggaaccccuugagaacgaugaggacugcgcgcacuggaaagaagccaagaugcugcucgauaauauuaacacgccggagggaaucauuccuuccauguuugaacccgagagagaaaaaguggacgcuaucgauggcgaguaccgccugagaggggaggcccggaagacauucgucgaccugaugcgcagaggagaucucccuguguggcuugcuuaucggguggccgcugaaggcaucaauuacgccgaccgcagaugguguuuugauggggucaagaacaaucagauucuggaggaaaacguugagguggagaucuggaccaaagaaggcgagcggaagaaacugaagcccagauggcucgacgcgcgcauuuauucugauccucuggcccuuaaagaguucaaggaguucgcugccggacggaagucccugacacucaaccugaucaccgaaaugggcagacugcccacguuuaugacccagaaagcucgcgacgcccucgauaaucuugccgugcugcauacagcugaggucgggggacgggcguacaaccacgcccuguccgagcucccggaaacccuggagacacuucugcuccugacccugcucgcuacagugaccggcgggauuuuccuuuuucugaugagcggaaagggcguuggcaaaaugacgcuggggaugugcugcaucaucacagccucuauucuccugugguaugcccagauccaaccucacuggauugcugccuccaucauucuugaguucuuucugaucgugcuccugauccccgagcccgaaaagcagagaaccccucaggacaaucagcugaccuacgucgugauugcgauccucacaguuguggccgcuaccauggccaacgagaugggauuccuugagaaaacaaagaaggaccugggccuggggagcauugcuacgcaagaaccggaguccaauauccucgauauugaccugcggcccgccucugcguggacccuuuaugccgucgcuacaaccuuugugacaccuaugcugcgccauagcaucgaaaacuccucugucaaugugagccucaccgccauugcuaaccaggccacgguucugaugggacugggcaaaggguggccccucuccaagauggauaucggagugccucuucuggcuaucggcuguuacagccaggugaaucccauuacccugacagccgcgcuccugcuucuggucgcccacuacgcuaucauuggcccugggcuccaggccaaagcuaccagagaggcccaaaagcgggccgcggcuggaaucaugaaaaacccgacaguugacggcauuaccgugaucgaucuggaccccaucccuuaugaucccaaguucgaaaagcagcugggacaggugaugcuccuuauucugugcgucacacaggugcugaugaugcgcacaaccugggcccucugugaggcucugacacuugccaccggaccuaucucuacccugugggagggcaaucccgggagauuuuggaacacaacgauugccguuuccauggcuaauaucuuccggggaagcuaccucgccggcgcgggccugcuguuuucuauuaugaaaaacaccacaaauacccgcagagggacaggaaacaucggcgaaacccucggggagaaguggaaaucccggcuuaaugcccugggaaagaacgaguuccaaaucuauaaaaagagcggcauucaggagguggaccgcacgcuggcuaaagaggggaucaagagaggagaaacagaucaucacgccgucucucggggcagcgcuaagcucagaugguuuguggagcgcaacauggucaccccggaaggcaaagugguugaccuggggugcggacggggcgggugguccuacuauuguggaggccuuaagaaugugagagaggucaaagggcugaccaagggaggcccuggccaugaagaacccauucccaugucuacauacggguggaaccucgugcgccugcagagcggaguugauguguucuucaccccucccgagaaaugcgacacacugcucugugauaucggcgaauccagcccuaauccgacgauugaggccgggcggacccuuagaguccugucccugguggaaaacuggcucaauaacgacacacaauuuugcaucaaggugcugaaucccuauaugccuucuguuaucgagaagauggaaacccuucagcgcaaauacggaggcgcgcugguccggaacccccucagcagaaauuccacacacgagauguacugggugucuaacgccaccgggaauauugugagcuccgucaacaugaucucucgcaugcugauuaaucgguucacgaugaagcacaaaaaggcuaccuaugagccugacguugaucugggaagcggcacaagaaacaucggcauugaauccgagauccccaaucucgacauuaucgggaaacgcaucgaaaagauuaagcaggagcaugaaaccagcuggcacuacgaucaggaccauccguauaaaacaugggccuaccacggaucuuaugagaccaagcaaacaggcuccgcuagcucuauggugaacggggugguccggcuucugaccaaaccuugggaugugguucccauggugacgcagauggccaugacagacaccaccccuuuuggacagcagagagucuucaaggagaaaguggauacacgcacgcaagaacccaaggagggcaccaagaaacugaugaagaucacagcuaaauggcucuggaaggaacuggggaaaaagaaaaccccuagaauuuguacacgggaggaguuuaccaagaagguucgcuccaacgccgcgcuuggagccaucuucacagacgaaaauaaauggaaaagcgcuagagaggccguggaagauucucgguuuugggagcuggucgacaaagaaagaaaccuccaccuggagggcaagugcgagaccuguguguacaauaugaugggcaaacgggaaaagaagcugggggaguucggaaaagcuaagggcucccgcgccauuugguauauguggcucggggccagauuucuggaguucgaggcgcuuggauuucugaacgaagaucauugguucagccgggaaaauucccucagcggcguggagggggaaggccugcacaaacuuggauacauccugcgcgacgucucuaagaaagagggcggggcuauguacgccgacgauacggccggaugggacaccagaaucacacucgaagaucugaagaacgaggaaaugguuaccaaucauauggagggcgagcacaagaaacuggcugaagccauuuuuaagcucacauaucagaacaaaguggugcggguccagcgccccaccccgagagggacggugauggacaucauuagccggaaggaucagcgcggauccggccaaguugggacauacggccugaauaccuucacaaacauggaggcucagcuuaucagacagauggaaggagagggcauuuucaaaucuauccaauaucugaccgugacggaggaagucgccgugcagaauuggcucgcgcggguugggcgcgagagacugagccggauggccaucuccggagacgauugcguggucaagccucuugacgaucgcuuugcuucugcccugaccgcucucaacgacaugggcaaggugagaaaagauauucagcagugggaacccagccggggguggaaugacuggacacaaguucccuucugcucccaucacuuucacgagcugaucaugaaggauggaagagugcuggucgugccuugucgcaaccaggacgaacucauuggccgggccagaaucucucagggggcgggcuggagccugaaagagaccgccugccuuggaaaguccuacgcucagauguggagccugauguauuuccaucgccgggaccucagacuggccgcuaaugccauuuguucugcugucccgucccacugggugcccacaagccgcaccacauggucuauccaugccaaacacgaguggaugaccacggaagauaugcuuacaguuuggaaccggguguggauucaagagaacccuuggauggaagacaagacccccgucgaguccugggaagaggugccuuaccugggcaagagagaggaucaguggugcgggagccucaucggacugaccucccgcgcgacaugggccaaaaauauccagaccgcuauuaaccaggugcggucucugaucggcaaugaagaguauacagacuacaugcccagcaugaagagauuucgccgggaagaggaagaggccgggguucucugguga

SEQ ID NO: 19698 - RNA, 9876 nt, Artificial Sequence
  derived and/or modified CDS sequence (opt5) from DENV-2__GQ868620__SS-prME
agcgcuggaaugaucauuaugcugauccccaccgugauggcuuuccaccucaccacgagaaauggggagccucauaugauugucgggauccaggaaaagggaaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucguuccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcagggauccaauuggauucagaaagagacccuggucacauucaagaacccucaugcuaaaaagcaagacgugguugugcucggcagccaggaaggggccaugcacaccgcccugacgggcgcuacagagauccagauguccucuggaaaucuucuguuuaccggccaucucaaaugccgccugagaauggacaaacuucaacugaaggggaugagcuacuccauguguacaggaaaauucaaggucgugaaagaaauugcggagacccagcacggcaccaucgucauucgggugcaguaugagggggauggaagccccugcaagauccccuucgaaaucauggaccucgagaaaagauacguucugggccgccugauuacagugaacccuaucgucacggaaaaggauucuccggugaacauugaggccgaacccccuuuuggggacuccuacaucauuaucggcguugagcccggacagcucaagcugaauugguucaaaaagggcagcucuauugggcaaauguuugagaccacaaugcggggagcuaaaagaauggccauccuuggcgauaccgccugggacuucgggagccugggaggcguguuuacauccaucgggaaggcucuccaucaggucuucggcgccauuuauggagcggcuuuuucuggcgugagcuggaccaugaaaauccugauuggggugaucauuacguggaucggaaugaacucccgcagcacaucucuguccguuagccuuguccucgugggcaucgugacccuguaccugggggucauggugcaggccgauucuggauguguuguguccuggaagaauaaggaacucaaaugcggcagcgggauuuucaucaccgacaacguccacacauggaccgagcaguauaaguuucaaccugaaucccccucuaaacuggccagcgcuauucagaaggcccaggaggaaggcaucuguggcauucgguccgugacaagacuugagaaucugauguggaaacagaucacgccggagcucaaccacauccuggcugaaaaugagguuaagcugaccauuaugacaggcgauaucaaagggauuaugcaagccggaaagcgcucucuucggccucagcccaccgaacucaaguacagcuggaaaacauggggcaaggcgaaaaugcuguccaccgagagccauaaccagacguuccugaucgacgggccugaaaccgccgagugccccaauacaaacagagcuuggaacucucucgagguggaagauuauggauuuggcgucuucaccacaaacauuuggcugaaacuuaaagagaagcaggacgccuuuugugacuccaagcugaugagcgcugccaucaaagauaaucgcgcggugcacgccgacaugggcuacuggaucgaaucugcucucaacgauaccuggaagauugagaaagccuccuucaucgagguuaagaauugccauuggccuaaaagccacacacuguggucuaacggggugcuggaaagcgagaugauuauccccaagaaccuugcuggaccggucucccaacacaauuaucggccuggcuaccauacccagauugccgggcccuggcaccucggaaagcuggaaauggacuucgauuuuugugacggcacgacagugaucgugaccgaggauugcgggaacagaggacccagccugcgcaccacaaccgccucuggcaaacucauuacggaauggugcugucgguccugcacacugccuccgcuuagauaccggggcgaggacggguguugguauggaauggagauccgcccccugaaggaaaaagaggaaaaucucgucaacagccugguuaccgcuggccauggacagguggauaauuucucccugggagugcuuggcauggcgcucuuucuggaggaaaugcugagaacacgggucgggaccaagcacgccauccuccugguggcuguuucuuucgugacacuuauuaccggaaacaugagcuuuaaagaccugggcagagucgugguuauggugggcgccacgaugaccgaugacaucgggaugggagucacauaccucgcccugcuggcugccuucaaggugcgcccuaccuuugcggcuggccuucugcuccggaagcugacauccaaagagcucaugaugaccacgauugggaucguucugcuuucucaaagcacaauucccgagaccauccuggaacucacagaugcccuggcccugggaaugauggugcuuaagaucgucagaaauauggagaaauaucagcuggcugugaccauuauggccauccucugcgugccuaacgcggucauucugcagaaugcuuggaagguuuccuguaccauccucgccguggugucugucagcccccugcuucugacauccagccagcagaagacggacuggauuccucucgcccugaccaucaagggccugaaccccacagcuaucuuccuuaccacacugucucgcaccaauaaaaagagauccuggccgcucaacgaagccauuauggcuguggggaugguuagcauccuggccucuucccuccugaagaaugacauuccuaugacgggaccccuuguggcgggcggccugcugacagucugcuacgugcucaccgggcggagcgccgaucuggagcuugaacgcgcuaccgacguuaaaugggaggaucaggccgagaucucuggauccagcccuauucuguccaucacaauuagcgaagacggcucuaugagcaucaagaacgaggaagaggagcagacccucacaauccugauuagaacggggcuccuggugaucuccggacuuuuucccgucucuauuccgaucaccgcugccgccugguaucugugggaagugaaaaagcagcgggcuggcguccugugggaugugccuucucccccucccauggggaaagcggagcucgaagacggagccuaccgcauuaagcaaaagggcauccugggcuauucccagaucggggcuggaguuuacaaagagggcacauuccauaccauguggcacgugacaagaggggccguccuuaugcacaagggaaaacggauugaacccuccugggccgaugugaagaaagaccugaucagcuacggcgggggauggaagcucgagggcgaguggaaggaaggcgaggaaguucaggugcuggcucucgagccugggaaaaauccgcgcgucgugcagaccaagcccggacuguuuaaaacgaacaccggcacaauuggggccgugucccuugauuucucuccuggaaccagcggcucccccaucauugacaagaaagggaagguugucggacuguauggcaacggcguggugacaagaagcggggcguacgucucugcuaucgcccaaaccgaaaaguccaucgaggauaauccugagauugaagacgauaucuuucggaaacgcagacugacaauuauggaccuccaucccggagccggcaagacgaaacgguaucugccugcuaucgugagagaggccauuaagcgcgggcuucggacccugauccucgcgccgacaagaguuguggcugccgaaauggaggaagcccugcgcggacuccccauucgguaccagaccccugcuaucagagccgagcacaccggccgcgagaucgucgaccugaugugucaugcuacauucacgaugcggcuucugagccccgugagaguuccuaacuauaaucugauuaucauggaugaagcccacuucaccgaccccgcgucuauugccgcucgcggguacaucuccacacggguggagaugggcgaagccgcuggaauuuuuaugaccgccacaccgccuggcagcagagaucccuucccccaguccaacgccccuaucaucgacgaggagcgggaaauucccgagcgcucuuggaauagcgggcaugaaugggucaccgauuuuaaaggaaagacggugugguucguuccuuccaucaaggcuggcaacgacauugcggccugccuccgcaagaaugggaagaaagugauccaacugagccggaagacauuugauucugaguaugucaaaacccgcaccaacgacugggauuucguggugacaaccgacauuuccgaaaugggagcuaauuuuaaggccgagagagucaucgauccgcggagauguaugaaacccguuauccuuacagacggcgaggaacgcgugauucuggccgggccuaugcccgugacccacagcucugcugcccagcggagaggccgcaucggacggaacccuaagaaugagaacgaccaguacauuuacaugggcgaaccccucgagaaugaugaagacugcgcgcacuggaaggaggcuaaaaugcugcuggauaacaucaauacgccggaggggauuaucccuagcauguucgaacccgagagagaaaaggucgacgccauugauggagaguaucgccuccggggcgaagccagaaaaacauuuguggaccuuaugcgcagaggggaucugccuguuuggcuggcuuacaagguggccgcggagggaaucaacuaugccgaccggcgcugguguuucgauggcaucaaaaacaaucagauucucgaggaaaacgucgagguggaaaucuggaccaaggagggggagagaaagaaacugaagccccgguggcuugacgcucgcauuuacuccgauccucuggcccucaaagaauuuaaggaguucgcugccggcagaaaaucucugacacugaaucucaucaccgaaaugggacggcuucccacguucaugacccaaaagacaagagacgcucuggauaaccuggccguucuccauaccgcggaggccggcgggcgcgcuuauaaucacgcccugagcgaacuuccggagacacuggagacccuccugcugcucacacuucuggcuaccgugacgggaggcauuuuucuguuccucauguccgggcggggaaucggcaagaugacacugggcaugugcugcaucauuaccgccucuauccuucugugguacgcccagauucagccucauuggaucgcugcgagcauuauccucgaauuuuuccugaucguccugcucauucccgagcccgaaaaacagagaaccccucaagacaaccagcuuacauauguggucaucgccauucugaccgugguugcugccacaauggccaaugagaugggguuucuggaaaagacgaaaaaggaccucggacugggcuccaucgcuacccagcagccggagagcaacauucuugauaucgaccugcgccccgccucugcguggacacucuacgccguggcuaccacauucgugaccccuaugcugcggcacuccauugagaauagcuccgucaacguuucucugacggccaucgcuaaucaagccaccgugcucauggggcuuggaaaaggcuggccccugagcaagauggauaucggggugccucugcucgcgauuggauguuacucccaggucaaccccaucacacugaccgccgcccuucugcuccugauugcccacuaugcuaucauuggcccuggccugcaggccaaggcuacaagagaagcccagaaacgggcggccgcugggaucaugaagaauccgaccguggacggaaucacgguuauugaucucgaccccaucccuuacgaucccaaauuugagaagcaacuuggccaggugaugcugcugauucucugcgucacacaggugcugaugaugcgcaccacaugggcccuuugugaagcucugacccucgccaccgggccuaucucuacacugugggagggaaaccccggcagauucuggaauacgaccauugccgucagcauggcgaacaucuuucggggguccuaucuggcuggagccggccuccuuuucagcaucaugaaaaaugcuaacaacacacgcagaggcaccgggaauauuggagaaacacugggcgagaaguggaaaucucggcugaacgcccucgggaaguccgaguuucaaaucuacaagaaaagcggcauucaggaaguggaccgcacccuggccaaggagggcaucaaaagaggggaaacggaucaucacgcuguuucucggggauccgccaaacuucgcugguucguggagagaaauauggucacaccggagggcaaagugguugaccugggcugcgggcggggaggcuggagcuauuacugugggggacucaagaacgugagagaagucaagggccugaccaaagggggaccuggccaugaggaacccauucccaugucuaccuauggcuggaaucuggugcgccuccagagcgggguggaugucuuuuucaucccucccgagaagugcgacacacuucugugugauaucggagaauccucuccuaacccgaccgucgaggcgggccggacacugagagugcucaaucugguggagaacuggcuuaauaacgacacgcaguucugcauuaaaguccugaaucccuacaugccuagcguuaucgaaaagauggaggcccuccaacgcaaauacgggggagcucuggugcggaacccccuguccagaaauagcacccacgaaauguauuggguguccaacgccucuggcaauauugucagcuccgugaacaugaucucucgcaugcucauuaaccgguuuacaaugagacauaagaaggcuaccuacgagccugacguugaucuugggagcggaacacgcaauaucggcauugaauccgagauccccaaccuggacaucauuggcaaacggaucgagaagauuaaacaggaacacgagaccucuugguauuacgaucaggaccacccguauaagacgugggccuaccaugggagcuaugaaaccaaacagacaggauccgcgagcucuauggugaauggcgucgugagacugcucaccaagccuugggauguucugcccacagugacccaaauggccaugacagacaccacgccuuucgggcagcagcgcgucuuuaaggagaaaguggauacacggacccaggaacccaaggagggaaccaagaaacuuaugaaaaucacagcugaguggcuguggaaagaacucggcaaaaagaagacgccuagaauguguacccgcgaggaguucauuagaaaagugcgguccaacgccgcucugggggccaucuuuacagacgagaauaaguggaaaagcgcucgcgaggccgucgaagauucuagauucugggagcugguugacaaggaacggaaccuccaccuggagggaaaaugcgaaaccuguguguacaauaugaugggcaagagagagaagaaacuuggcgaguuugggaaggcgaaaggaucccgggccaucugguacauguggcugggcgcucgcuuccucgaauuugaggcccugggguuccuuaacgaagaucauugguuuagcagagaaaauucucuguccggaguggaaggcgaggggcuccacaagcugggcuauauucugcgggacgucagcaaaaaggagggaggcgcuauguacgccgacgauacagccgggugggacacccgcaucacacucgaagaucugaagaacgaggaaauggugaccaaucacauggagggagaacauaagaaacuugcggaggcuauuuucaaacugacguaucaaaacaaaguugugagaguccagcggcccaccccgcgcggcacagugauggacaucauuuccagacgggaucagcgcgggagcggacaaguuggcaccuacgggcucaauacauuuaccaacauggaggcccagcugaucagacagauggaaggcgagggaguguucgaaaauauccagcaccuuacggucacagaggagguggccguucaaaacuggcuggcucgggugggccgcgaaagacucucucggauggccauuagcggggacgauugcgucgugaaaccucuggacgaucgcuucgcuaacgcccugaccgcgcucaaugacaugggaaagaucagaaaggauauucagcagugggagcccuccaaaggcuggaacgacuggacacagguccccuuuugcucucaucacuuccaugaacugaucaugaaggaugggcgggugcuuguugugccuuguagaaaucaagacgagcugauuggacgcgcccggaucagccagggcgcuggguggucccucagagaaaccgccugccugggcaaaucuuaugcucagauguggagccuuauguacuuucaccgccgggaccugagacucgccgcgaacgccauuuguuccgcugucccgucucacugggugcccacgagccgcaccacaugguccauccaugccaagcacgaguggaugaccacagaggauaugcugaccguguggaaucggguuuggaucagagaaaacccuuggauggaggacaaaacacccguggaaagcugggaggaaauuccuuaucugggaaagcgcgaggaucaguggugcggcucucucaucgggcugaccucccgggcuacgugggccaagaauauucaagcugccaucaaccaggucagaagccuuauuggaaaugaggaauacacagacuacaugcccucuaugaaacgcuuccggagagaggaagaggaagcgggcgugcugugguga

SEQ ID NO: 19699 - RNA, 9876 nt, Artificial Sequence
  derived and/or modified CDS sequence (opt5) from DENV-2__FJ639702__SS-prME
accgccggcgugaucauuaugcugauccccacagcuauggccuuccaccucacgaccagaaacggggagccucauaugauugucggacggcaggaaaagggcaaaagccugcuuuuuaagacagaggacgggguuaauaugugcacccugauggcgaucgaucucggagaacugugugaggacacaauuaccuacaaaugcccgcuucugcgccaaaacgaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaaggaaccugccacgcugagaaaauauugcaucgaggcuaagcucacaaacaccaccacagagagccgguguccgacccagggagaacccucucugaaugaggaacaagacaaacgcuuugugugcaagcauuccaugguggauagaggcuggggcaacggguguggacuguucggcaaggggggaauugucacaugcgccauguuuacgugcaaaaagaauauggagggcaaaaucguucagccugaaaaccucgaguacaccauugugaucacaccccacagcggggaggaacaugcggugggaaaugacaccggcaagcacggcaaagagaucaagauuacaccucagucuuccagcaccgaagccgagcugacgggguauggaaccgucacaauggaauguucuccccggaccggccuugauuucaacgagauggugcugcuccagauggaggacaaagcuuggcugguucaccgccaaugguuucuugaucugccgcucccuuggcugcccggggccgacacacagggauccaauuggauccagaaggaaacccuggugacguucaagaacccucaugcuaaaaagcaggacgucgugguucucggcagccaagagggggccaugcacacagcccugaccggcgcuacagaaauucagauguccucuggaaaucuucuguuuaccggccaucucaaaugcagacugcggauggauaagcuucagcugaaagggaugagcuacuccauguguaccggaaaguucaagaucgugaaagagauugcggagacacaacacggcacgaucgucaucagagugcaguaugaaggggacggaagccccugcaagauucccuucgagaucauggaucucgaaaaacgccauguccugggccggcugauuaccgugaacccuaucguuacagagaaggacucuccggugaacauugaagccgagcccccuuuuggggauuccuacaucauuaucggcgucgagcccggacagcucaaacugaauugguucaagaagggcagcucuaucgggcagauguuugaaaccacaaugagaggagcuaaacgcauggccauucuuggcgacaccgccugggauuucgggagccugggaggcguguuuacguccauggggaaggcucuccaccaaguuuucggcgccaucuacggagcggcuuuuucuggcgugagcuggacaaugaaaauucugaucggggucauuaucaccuggaucggaaugaacucccggagcaccucucuguccgugagccuugugcucguuggcgucauuacacuguaucugggggccauggugcaggccgacucuggauguguggucuccuggaagaauaaagagcucaagugcggcagcgggaucuucauuaccgauaacgugcacacauggacggaacaguacaaguuucagccugagucccccucuaaacuggcuagcgccauccaaaaggcucaugaagagggcauuuguggaaucagauccguuacccgccuugagaaucugauguggaaacagaucacaccggaacucaaccacauucugucugagaaugaagugaagcugaccaucaugacaggcgacauuaaagggaucaugcaggccggaaagcggagccuuagaccucagcccaccgagcucaaauauuccuggaagacguggggcaaggcgaaaaugcugagcaccgaaucucauaaccaaacauuccugauugaugggccugagaccgccgagugccccaauacaaaccgcgcuuggaauucccucgaagucgaggacuacggauuuggcguguucaccacaaacaucuggcugaagcuucgggaaaaacaggacguuuuuugugauagcaagcugaugucugccgcuaucaaagacaauagagccgugcacgcggauaugggcuauuggauugaguccgcccucaacgacaccuggaagauggagaaggcuagcuucaucgaagucaaaucuugccacuggccuaagagccauacgcugugguccaauggggugcuggagagcgaaaugauuauccccaaaucuuucgccggaccgguuucccagcacaacuaccgcccuggcuauuacacacagaccgcugggcccuggcaucuuggaaagcucgagauggauuuugacuucugugaaggcaccacaguggucgugaccgaggauugcgggaaccggggacccagccugagaacgacaaccgccuccggcaaacugauuacagaguggugcugucggucuugcacccucccuccgcugcgcuacagaggcgaagacggguguugguauggaauggagauccggccccuuaaggaaaaggaggaaaaucuggugaacagccucgucacagccggccacgggcaaauugauaauuuuucccugggaguucugggcauggcucuuuuccucgaggagaugcugagaacccgcguggggacgaaacaugcgauccugcucguggccgucucucuggugacccuuaucacaggaaacaugagcuuucgggaccugggcagaguuauggugauggucggcgcuaccaugacagaugacauugggaugggagugaccuaccucgcccugcuggccgcuuucaagguucgcccuacguuugccgcgggccuucugcucagaaaacugacauccaaggaacucaugauggcuaccaucgggauugcccugcuuucucagagcacaauccccgagaccauucuggaacucaccgaugcccuggcucugggaaugauggugcuuaaaaucguccggaauauggagaaguaucagcuggccgugacaaucauggcgauuuccugcguuccuaacgcugugauccuccaaaaugccuggaaggucagcuguacgauucuggccgcugugucuguguccccccuccugcuuaccagcucucagcagaaagccgacuggaucccucuggcucucacaauuaagggccugaaccccaccgccaucuuccugacaacccuuucccgcacgagcaaaaagagaucuuggccgcugaaugaagcgaucauggccgucgggaugguuuccauucucgcuagcucccugcucaaaaacgacaucccuaugacaggaccccugguggccggcggccuucugaccgugugcuacguccugaccgggcggagcgcugaucucgagcuggagcgcgccacagacgugaagugggaagaucaggccgagauuucuggaagcuccccuauccuuucuauuaccaucagcgaagacggcuccaugucuauuaaaaaugaggaggaagagcaaacacugacgauccucaucagaaccgggcugcucguuauuagcggacuguuucccguguccaucccgauuacagcugcggccugguaucuuugggaagucaagaagcagcgggcuggcgugcugugggauguuccuucucccccucccguggggaaagccgagcuggaagacggagccuaccgcaucaagcagaaaggcauucucggcuauagccagaucggggcuggagucuacaaggagggcaccuuccacacaauguggcacgugaccagaggggccguccugaugcaucggggaaaacgcaucgagcccuccugggcggaugugaagaaggaccuuauuagcuacggcgggggauggaaacuggaaggcgaguggaaggaaggcgaggaaguucaagugcucgcucuggagccugggaaaaacccgagagccguccagacgaagcccggacucuuuaaaaccaauacaggcaccaucggggccgugucucuggauuucuccccuggaacaagcggcucucccauuguugaccggaaggggaagguggucggacuuuauggcaacggcguggugaccagauccggggcuuacguuagcgccaucgcgcagacagagaaauccauugaagauaauccugagaucgaagacgauaucuuucgcaagaaacggcugacgauuauggaccugcaccccggagcuggcaagaccaaaagauaucucccugccaucguccgcgaggccauuaagcgggggcugagaacacuuauccuggcuccgacccgcgugguggccgcugaaauggaggaggcccuccggggacugcccauuagauaccagaccccugcgauccgcgccgaacauacaggccgggagauugucgaccucaugugucacgcuacguucaccaugagacugcuuucucccgugcggguuccuaacuauaaccugaucaucauggaugaagcccauuucacagaccccgcuagcauugccgcccgcggguacaucuccaccagaguggagaugggcgaggcugcgggaauuuuuaugacagccaccccgccuggcagcaaggaucccuucccccaaucuaaugcuccuaucauggacgaagagcgggaaauucccgagcgcuccuggaacagcgggcacgaaugggucacggauuuuaaaggaaagacagugugguucguuccuucuaucaaagccggcaaugacaucgccgcuugccugagaaagaacgggaaaaaggugauucagcucagccggaagaccuuugauuccgaguaugucaaaaccagaacaaaugacugggauuucgugguuaccacagacaucucugagaugggagccaacuuuaaggcggaacgcgugauugauccgcggagauguaugaaacccgucauccugaccgacggcgaggaacgcgugauucuugcugggccuaugcccgugacgcacagcuccgccgcccagcggagaggccgcaucggacggaauccuaagaacgagaaugaccaauacaucuacaugggcgaaccccuggagaacgaugaggacugcgcucauuggaaagaagccaagaugcuccuggauaauauuaacacaccggaggggaucauuccuucuauguucgaacccgagagagaaaaagucgacgcgaucgauggagaguaucgccugagaggcgaggcccggaagaccuuuguugaccucaugcgcagaggggaucuuccuguguggcuggcuuaccggguggccgcugaaggaauuaauuaugccgaccgcagaugguguuucgauggcgucaagaacaaucagauccuggaggaaaacguggagguugagauuuggacaaaagaaggggagcggaagaaacucaagcccagauggcuggacgcucgcaucuacagcgauccucuugcccugaaagaauuuaaggaguucgcggccggccggaagucccucacccugaaccugaucacggaaaugggaagacuccccaccuucaugacacagaaagcucgcgacgcccuugauaaucuggcugugcugcacaccgccgaggccggcgggcgggcuuauaaccaugcgcucagcgagcugccggaaacacuugagacccugcuccugcugacacuccuugccaccgucacgggaggcguguuucuguuccugaugucugggaagggaguuggcaaaaugacacucggcaugugcugcauuaucaccgcuuccauucugcuuugguacgcccagauccaaccucacuggauugccgcuagcaucauccuggaauuuuuccucauugugcugcugauccccgagcccgaaaagcagagaaccccucaggacaaucagcucacauaugucgugauugccauccuuaccgucguggcggccacaauggcuaacgagaugggguuucuggagaaaacgaagaaggaccugggacucggcuccauugccacccaagaaccggagucuaauauccuggauaucgaccuucggcccgcuagcgccuggacacuguacgcgguugccaccacauucgugaccccuaugcuccgccacuccauugaaaacucuagcgugaaugucucccugacggcuaucgccaaccaggcuaccguucugauggggcucggaaaaggcuggccccuuagcaagauggauauuggggugccucugcuggccaucggauguuacucucaggugaaucccgucacacucaccgcugcccugcuucugcucguggcgcauuaugccauuaucggcccuggccugcaggcuaaagccacaagagaggcucaaaagcgggccgccgcggggauuaugaaaaacccgaccguugacggaaucacggugaucgaucuggaccccauuccuuacgaucccaaguuugaaaagcagcucggccaggucaugcuucugauccugugcgugacacagguccucaugaugcgcaccacaugggcucugugugaggcccuuacccuggcuaccgggccuauuuccacacucugggagggaaaucccggcagauucuggaacacgaccaucgccgugagcauggccaauauuuuucgggggucuuaucuggcuggagccggccugcucuucuccaucaugaaaaacacaaccaauacacgcagaggcaccgggaacaucggagaaacgcuuggcgagaaguggaaaagccggcugaaugcgcuggggaagucugaauuucaaauuuacaaaaagagcggaauccaggagguugaccgcacacucgccaaagagggcauuaagagaggggaaaccgaucaccaugcugugucccggggaucugccaagcugagaugguucgucgagcgcaacauggugaccccggaaggcaaaguuguggaccuuggcugcgggcggggaggcuggagcuauuacugugggggacugaagaacgucaaagaggugaagggccucacaaaagggggaccuggccacgaagagcccauccccauguccaccuauggcuggaaucuggugagacugcagagcgggguugaugucuuuuucacaccucccgagaagugcgacacgcuccuuugugauauuggagaauccucuccuaacccgaccaucgaggcuggccgcacacugcgggugcugagccucguggaaaauuggcugaacaaugacacccaauucugcaucaagguccuuaaccccuacaugccuuccguuauugagaaaauggaaacacugcagagaaaguacgggggagcccucgugcgcaauccccugucucggaacagcacccaugagauguauuggguguccaaugcgacgggcaacaucgucucuagcgugaauaugauuuccagaaugcugaucaaccgcuuuaccaugaaacacaagaaagccacauacgagccugacguugaucucgggagcggaacccggaauauuggcaucgaaucugagauccccaaccuugacauuaucggcaagagaauugaaaagaucaaacaggagcacgaaacauccuggcauuaugaucaggaccacccguacaagaccugggcuuaucaugggagcuacgagacaaaacaaaccggaucugccuccagcauggugaauggcgucgugcgccugcugacgaagccuugggauguugugcccauggucacacagauggcuaugaccgacaccacaccuuucgggcagcagcggguguuuaaagagaagguggauacgagaacccaagaacccaaggagggaacaaaaaagcucaugaaaauuaccgccgaauggcuguggaaggagcuuggcaaaaagaaaacaccucgcauguguaccagagaggaauucacacggaagguccgcucuaacgcugcccugggggcgaucuuuaccgacgagaacaaguggaaauccgccagagaagcuguugaggauagccgguucugggaacucguggacaaggagagaaaucugcaccuggagggaaaaugcgaaacguguguguauaacaugaugggcaagcgggagaaaaagcucggcgaauuugggaaggccaaaggaucccgcgcuauuugguacauguggcugggcgccagauuccuugaguuugaagcccugggguuccucaaugaggaucacugguuuagccgggagaacucucugagcggagucgaaggcgaggggcuucauaagcugggcuacauccuccgcgacgugggaaaaaaggaaggcggggcgauguaugcugacgauaccgccggaugggacacaagaaucacccuggaggaucugaaaaaugaagagaugguuacaaaccacauggagggcgaacauaagaagcucgccgaggcuauuuucaaacugaccuaccagaauaaggugguccgggugcagcgccccacgccgagagggacaguuauggacaucauuucccggcgcgaucagagaggaucuggccaaguggggaccuauggccuuaacacauuuaccaauauggaagcccagcugauccggcagauggagggagagggcauuuucaaaagcauccaacaccucacggcuaccgaagagaucgccguccagaacuggcuggcgcgcguggggagagaacggcuuucccgcauggccauuucuggagacgauugcguugugaagccucuggacgauagauucgcuagcgcccucacagcucugaaugacaugggcaaaguccggaaggauauccagcagugggagcccuccagaggguggaacgacuggacccaagugcccuuuugcucucaucacuuccacgaacugauuaugaaggauggacgcguccucgugguuccuugucggaaucaggacgagcugaucggcagagcccgcauuagccagggggcgggcuggucccuuaaagagacagccugccugggaaagagcuacgcucagauguggucucucauguauuuucaucggagagaccugcgccuugccgcuaacgccaucuguuccgcugugccgagccacuggguccccaccucucggacaaccugguccauccaugccaaacacgaauggaugacgacagaggauaugcugaccguguggaauagaguguggauucaagaaaacccuuggauggaggacaagacccccguugaaagcugggaggaggugccuuaccucggcaaacgcgaagaucaguggugcgggucccugaucggacugacaucucgggcgaccugggccaagaacauucagacagcuaucaaucaggucagaagccucauuggcaacgaggaauauacggacuacaugcccuccaugaagcgcuuccggagagaggaagaggaggccggggugcugugguga

SEQ ID NO: 19700 - RNA, 9876 nt, Artificial Sequence
  derived and/or modified CDS sequence (opt5) from DENV-2__GQ868621__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacauucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggagucuucaccacaaacaucuggcugaaacuuaaagaaaagcaggacgcuuuuugugacuccaagcugaugagcgccgcuaucaaagauaaucgcgccgugcaugcggacaugggcuauuggauugagucugcccucaacgauaccuggaagaucgagaaggcuagcuucauugaaguuaagaauugccacuggccuaaaagccauacacuguggucuaacggcgugcuggagagcgaaaugaucauucccaagaaccuugccgggccggucucccaacacaauuaccggccuggauaccacacccagaucgcuggccccuggcaucucgggaagcuggagauggacuucgauuuuugugacggaacgacagugauugugaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauccgcccccugaaggagaaagaagagaaucucgucaacagccugguuaccgccggacacggccagguggauaauuucucccugggggugcuuggaauggcucucuuucuggaagagaugcugagaacacgggucggcaccaagcaugcgauucuccugguggccguuucuuucaugacacuuaucaccgggaacaugagcuuuaaagaccugggaagaguggucgugaugguuggcgcuacgauggccgaugacauuggcaugggggugaccuaucucgcccugcuggcugccuucaagguccgcccuacauuugcggcuggacuucugcuccggaagcugaccuccaaagagcucaugaugacaaccaucggcauugugcugcuuucucaaagcacgauccccgaaacaguucuggagcucaccgaugcccuggcccuggggaugauggugcuuaagaucgucagaaauauggaaaaauaccagcuggcugugacaauuauggccauccucugcgugccuaacgcggucauucugcagaaugcuuggaagguuuccuguaccauccucgccguggugucugucagcccccugcuucugaccuccagccagcagaagacagacuggauuccucucgcccugacgaucaagggacugaaccccaccgcuaucuuccuuacaacccugucucgcacaaauaaaaagagauccuggccgcucaacgaggccauuauggcugugggcaugguuagcauccuggccucuucccuccugaagaaugacauuccuaugaccgggccccuuguggcgggaggccugcugacggucugcuaugugcucacaggccggagcgccgaucuggaacuugagcgcgcuaccgacguuaaaugggaggaucaggccgaaaucucuggguccagcccuauucuguccaucaccauuagcgaggacggaucuaugagcaucaagaacgaagaggaggaacacacacucaccauccugauuagaacaggccuccuggugaucuccgggcuuuuucccauuucuaucccgauuacggcugccgccugguaccugugggaggucaaaaagcagcgggcuggagugcugugggaugucccuucucccccucccaugggcaaagcggaacucgaggacggggccuaucgcaucaagcagaagggaauccugggcuacucccaaauuggcgcugggguguacaaagaaggaaccuuccauacaauguggcacguuaccagaggcgccgugcuuaugcacaaggggaaacggaucgagcccuccugggccgaugucaagaaagaccugauuagcuauggaggcggguggaagcucgagggagaauggaaggagggcgaagaggugcagguucuggcucucgaaccuggcaaaaauccgcgcgccgugcagacaaagcccgggcuguuuaaaaccaacacgggaaccaucggcgcggucucccuugauuucucuccugggacaagcggaucccccauuaucgacaagaaaggcaaggugguggggcuguacggaaacggcguugucaccagaagcggcgcuuaugugucugccaucgcccagacagagaaguccauugaggauaauccugaaaucgaggacgauauuuuucggaaacgcagacugaccaucauggaccuccaucccggggcuggaaagacaaaacgguaccugccugccauugugagagaagcgaucaagcgcggccuucggacgcugauucucgcuccgaccagagucguggccgccgagauggaagaggcucugcgcgggcuccccauccgguaucaaaccccugccaucagagcugagcacaccggacgcgaaauuguugaccugaugugucaugccaccuucacaaugcggcuucugagccccgugagagucccuaacuacaaucugaucauuauggaugaggcgcacuucacggaccccgccucuaucgcugcccgcggcuauauuuccacccggguggaaaugggggaggcugccggcaucuuuaugacagccaccccgccuggaagcagagaucccuucccccaguccaacgcuccuaucauugacgaggaacgggagauccccgaacgcucuuggaauagcggccaugaguggguuacagauuuuaaagggaagaccgugugguucgucccuuccauuaaggcgggaaacgacaucgccgcuugccuccgcaaaaauggcaagaaagugauucagcugagccggaagacguuugauucugaauacguuaaaacacgcaccaacgacugggauuucguggucaccacagacaucuccgagaugggggccaauuuuaaggccgagagagugaucgauccgcggagauguaugaaacccgugauucuuaccgacggagaggaacgcgucauccuggcuggcccuaugcccguuacacacagcucugccgcgcaacggagagggcgcauuggccggaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaccgccuccggggagaggcuagaaaaacguuuguggaccuuaugcgcagaggcgaucugccugucuggcuggccuauaagguggcggccgaggggaucaacuacgcugaccggcgcugguguuucgauggaauuaaaaacaaucagauccucgaagagaacguugaaguggagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacagagaugggccggcuucccaccuucaugacgcagaagaccagagacgcccuggauaaccuggcgguccuccauacagccgaagcuggaggccgcgccuacaaucacgcucugagcgagcuuccggagacccuggaaacacuccugcugcucacccuucuggccacagugaccgggggaaucuuucuguuccucauguccggccgggggaucggaaagaugacgcugggcaugugcugcauuaucacagccucuauucuucugugguaugcucaaauccagccucauuggauugcggccagcaucauccucgaguuuuuccugauuguucugcucauccccgaacccgagaaacagagaaccccucaggacaaccaacuuaccuacguggucauugcuauccugacaguggucgccgccaccauggcuaaugaaaugggcuuucuggagaagaccaagaaggaccucgggcugggauccauugccacgcagcagccggagagcaacauccuugauauugaccugcgccccgcgucugccuggacccucuacgcuguggccacaaccuucguuacaccuaugcugcggcacuccaucgaaaauagcuccgugaacgugucucugaccgcuaucgccaaucaggcgacgguccucaugggccuugggaaaggauggccccugagcaagauggauauuggcguuccucugcucgccaucggguguuauucccaagugaaccccauuacccugacagcugcccuucugcuccugguggcucacuacgccaucauuggaccuggccugcaggcuaaggccaccagagaggcgcagaaacgggccgcugccggcaucaugaagaauccgacagucgacgggaucaccgugauugaucucgaccccaucccuuaugaucccaaauuugaaaagcagcuuggacaaguuaugcugcugauucucugcgugacgcagguccugaugaugcgcacaaccugggcucuuugugaggcccugacacucgccaccggcccuaucucuacccugugggaagggaaccccggaagauucuggaauacaacgauugcggugagcauggcuaacaucuuucggggcuccuaccuggccggggcuggacuccuuuucagcaucaugaaaaauaccacaaacacccgcagaggcacaggcaacauuggggagacccugggagagaaguggaaaucucggcugaaugcccucggcaaguccgaauuucagaucuauaagaaaagcgggauucaagaggucgaccgcacgcuggccaaggaaggaaucaaaagaggcgagacagaucaucacgcugugucucggggguccgccaaacuucgcugguucguugagagaaacauggugaccccggaaggaaaagucguggaccugggcugcggcagagggggauggagcuacuauuguggcgggcucaagaauguucgggaggugaagggacugaccaaaggcgggccuggacaugaagaacccauucccaugucuacauacggcuggaaccugguccgccuccagagcggcguggauguguuuuucaucccucccgaaaagugcgacacccuucugugugauaucggggaguccucuccuaauccgacaguugaggcgggacggacgcugagaguccucaaccugguggaaaauuggcuuaacaauaacacccaguucugcauuaaagugcugaaucccuacaugccuagcgucaucgagaagauggaagcccuccagcgcaaauauggcggggcucugguucggaacccccuguccagaaauagcacacacgagauguacuggguguccaacgccucuggaaauauugugagcuccgucaacaugaucucucgcaugcucauuaaccgguuuaccaugagacauaagaaggcuacauaugaaccugacguggaccuuggcagcgggacccgcaauaucggaauugaguccgagguucccaaccuggauaucaucggcaaacggauugaaaagaucaaacaagagcacgaaacgucuuggcacuacgaccaggaucauccguauaagaccugggccuaccacggcagcuaugagacaaaacagaccggguccgcgagcucuauggugaauggagucgugagacugcucacaaagccuugggacguucugcccaccgugacacagauggccaugaccgauacgacaccuuucggccaacagcgcgucuuuaaggaaaaaguggacacccggacccaggagcccaaggaggggaccaagaaacuuaugaaaauuacggcugaauggcuguggaaggagcucggcaaaaagaagaccccuagaauguguacacgcgaagaguucaccagaaaagugcgguccaacgccgcucugggcgccaucuuuacagaugagaauaaguggaaaagcgcucgcgaagccgucgaggacucuagauucugggaacugguugauaaggagcggaaccuccaucuggaagggaaaugcgagaccuguguguacaauaugaugggaaagagagagaagaaacuuggcgaauuuggcaaggcgaaagggucccgggccauuugguacauguggcugggagcucgcuuccucgaguuugaagcccugggcuuccuuaacgaggaccacugguuuagcagagaaaauucucuguccgggguggagggagagggccuccacaagcugggguauauccugcgggaugucagcaaaaaggaaggcggagcuauguacgccgacgacacagccggcugggauacccgcaucacgcucgaggaccugaagaacgaagagauggugaccaaucauauggaaggggagcacaagaaacuugcggaggcuauuuucaaacugacauaucagaacaaaguugugagaguccaacggcccaccccgcgcggaacagugauggauaucauuuccagacgggaccagcgcggcagcgggcagguuggaaccuacggccucaauacguuuacaaacauggaagcccaacugaucagacagauggagggggaaggcguguucaaaaauauucagcaucuuaccgucacagaggagguggccguucagaacuggcuggcucgggugggacgcgaaagacucucucggauggccaucagcggcgaugacugcgucgugaagccucuggaugaccgcuucgcuaacgcccugaccgcgcucaaugauauggggaagaucagaaaagacauucaacagugggagcccuccaagggauggaacgauuggacgcagguccccuuuugcucucaccauuuccacgaacugaucaugaaagacggccgggugcuuguugugccuuguagaaaucaggaugagcugauugggcgcgcccggaucagccaaggagcuggcuggucccucagagaaaccgccugccuggggaagucuuaugcucagauguggagccuuauguacuuucaccgccgggaccugagacucgccgcgaacgccauuuguuccgcugucccgucucauugggugcccacaagccgcaccacaugguccauccacgccaaacaugaguggaugaccacagaggacaugcugaccguguggaaucggguuuggauuagagaaaacccuuggauggaggauaagacgcccguggaaagcugggaggaaaucccuuaucugggcaagcgcgaggaccaguggugcggaucucucaucggccugacaucccgggcuaccugggccaaaaauauucaggcugccaucaaccaagucagaagccuuauugggaaugaggaauacaccgauuacaugcccucuaugaagcgcuuccggagagaggaagaggaagcgggagugcugugguga

SEQ ID NO: 19701 - RNA, 9876 nt, Artificial Sequence
  derived and/or modified CDS sequence (opt5) from DENV-2__FJ639704__SS-prME
agcgccggcaugaucauuaugcugauccccaccgucgucgcuuuccaccugaccacgagaaauggggagccucauaugauuguuggaauccaggaaaagggcaagagccugcuuuuuaagaccgaggacggggugaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccgucgcgcucgugccucauguuggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguggcgccuuccaugacgaugagaugcauuggcaucucuaaccgggauuuugucgaaggggugagcggaggcuccuggguugacaucgugcucgagcacgggagcugugucaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugugaccugcgccauguuuacaugcaagaaaaacauggaaggcaagaucguucagccugagaaucucgaauacacgauuguggugacaccccacucuggggaggagcaugcggucggaaacgacacaggcaaacacggcaaggaaaucaaagugaccccucaguccagcaucacagaggccgaacugaccggguauggaacgguuaccauggaguguucucccagaacaggccuugauuucaaugaaauggugcugcuccaaauggagaacaaggcuuggcugguccaccggcagugguuucuugaccugccgcucccuuggcugcccggggccgauaagcaggaguccaauuggauucagaaagaaacccuggugacauucaagaacccucaugcuaaaaagcaagacguugugguccucggaagccaggagggcgccaugcacaccgcccugacgggggcuacagaaauccagauguccucuggcaaucuucuguuuaccggacaucucaaaugccgccugagaauggacaaacuucaacugaagggcaugagcuacuccauguguacagggaaauucaagguggucaaagagauugcggagacccagcacggaaccaucgugauucggguucaguaugaaggcgaugggagccccugcaagauccccuucgagaucauggaccucgagaagcgguacgugcugggacgccugauuacagucaacccuaucgugacggagaaggauucuccgguuaacauugaagccgagcccccuuuuggcgacuccuacaucauuaucgggguggagcccggccagcucaagcugaauugguucaaaaagggaagcucuauuggccaaauguuugaaaccacaaugagaggggcuaaaagaauggccauccuuggagauaccgccugggacuucggcagccucgggggagucuuuacauccaucggcaaggcucuccaucagguguucggggccauuuauggcgcggcuuuuucuggagugagcuggaccaugaaaauccugauuggcguuaucauuacguggaucgggaugaacucccgcagcacaucucuguccgucagccuugugcucgugggaaucgucacccuguaccugggcgugaugguucaggccgauucuggguguguggucuccuggaagaauaaggagcucaaaugcggaagcggcauuuucaucaccgacaacgugcacacauggaccgaacaguauaaguuucaaccugagucccccucuaaacuggccagcgcuauucagaaggcccaggaagaggggaucuguggcauucgguccguuacaagacuugagaaucugauguggaaacagaucacgccggaacucaaccacauccuggcugagaaugaagugaagcugaccauuaugacaggagauaucaaaggcauuaugcaagccgggaagcgcucucuucggccucagcccaccgagcucaaguacagcuggaaaacauggggaaagaccaaaaugcuguccacggaaagcuauaaccagaccuuccugaucgacggcccugagacaaccgagugccccaauacaaacagagcguggaacucucucgaagucgaggauuacggguuuggaguguucaccacaaacauuuggcugaaacuuaaagaaaagcaggacgccuuuugugacuccaagcugaugagcgcugccaucaaagauaaucgcgcuguucaugccgacaugggcuauuggaucgagucugcgcucaacgauaccuggaagauugagaaagccuccuucaucgaagugaagaauugccacuggccuaaaagccauacgcuguggucuaacggcguccuggagagcgaaaugauuauccccaagaaccuugcugggccggugucccaacacaauuaccggccuggauaccacacacagauugccggccccuggcaucucgggaagcuggagauggacuucgauuuuugugacggaaccaccgugaucgucacagaagauugcggcaacagagggcccagccugcgcaccacgacagcuucuggaaaacucauuaccgaguggugcugucgguccugcacacugccuccgcuuagauaucggggcgaggacggcuguugguacgggauggaaauccgcccccugaaggagaaagaagagaaucucguuaacagccuggugaccgccggacacggccagguggauaauuucucccuggggguccuuggaauggcccucuuucuggaagagaugcugagaacacgggugggcaccaagcaugcuauccuccugguugcggugucuuucgucacgcuuauuaccgggaacaugagcuuuaaagaccugggaagagugguugugauggucggcgccacaauggcugaugacaucggcaugggggugaccuaucucgcccugcuggccgcuuucaagguucgcccuacauuugccgcgggacuucugcuccggaagcugaccuccaaagagcucaugaugacgacaauuggcaucgugcugcuuucucaaagcaccauucccgaaacaauccuggagcucaccgaugcucuggcccuggggaugaugguccuuaagaucgugagaaauauggaaaaauaccagcuggccgugaccauuauggcuauccucugcgucccuaacgccguuauucugcagaaugcguggaagguguccuguacaauccucgcuguggucucugugagcccccugcuucugacguccagccagcaaaaagccgacuggauuccucucgcccugaccaucaagggacugaaccccacagcuaucuuccuuaccacacugucucgcaccaauaaaaagagauccuggccgcucaacgaggccauuauggcuguuggcauggugagcauccuggccucuucccuccugaagaaugacauuccuaugacggggccccuugucgcgggaggccugcugacagugugcuauguucucaccggccggagcgccgaucuggaacuugagcgcgcuaccgacgugaaaugggaggaacaggccgagaucucuggguccagcccuauucuguccaucacaauuagcgaagauggaucuaugagcaucaagaacgaggaggaagaacagacccucacaauccugauuagaacgggccuccuggucaucuccgggcuuuuucccauuucuaucccgauuaccgcugccgccugguaccugugggaagugaaaaagcagcgggcuggaguccugugggacgugccuucucccccucccaugggcaaagcggagcucgaagauggggccuaucgcaucaagcaaaagggaauccugggcuacucccagauuggcgcugggguuuacaaagagggaacauuccacaccauguggcaugugacaagaggcgccguccuuaugcacaaggggaaacggaucgagcccuccugggccgacgugaagaaagaucugauuagcuauggaggcggguggaagcucgaaggagaguggaaggaaggcgaggaaguucaggugcuggcucucgagccuggcaaaaauccgcgcgccguccagaccaagcccgggcuguuuaaaacgaacaccggaacaaucggcgcggugucccuugacuucucuccugggaccagcggaucccccauuaucgauaagaaaggcaaggugguugggcuguacggaaacggcgucgugacaagaagcggcgcuuaugugucugccaucgcccaaaccgagaaguccauugaagacaauccugagaucgaagaugacauuuuucggaaacgcagacugacaaucauggaucuccaccccggggcuggaaagacgaaacgguaccugccugccauugucagagaggcgaucaagcgcggccuucggacccugauucucgcuccgacaagagugguugccgccgaaauggaggaggcucugcgcgggcuccccauccgguaucagaccccugccaucagagcugaacauaccggacgcgagauuguggaccugaugugucacgccacauucacgaugcggcuucugagccccgucagagugccuaacuacaaucugaucauuauggacgaagcgcauuucaccgaucccgccucuaucgcugcccgcggcuauauuuccacacggguugagaugggggaggcugccggcaucuuuaugaccgccacaccgccuggaagcagagaccccuucccccaguccaacgcuccuaucauugaugaggaacgggaaauccccgagcgcucuuggaauagcggccacgaaugggugaccgacuuuaaagggaagacggucugguucgugccuuccauuaaggcgggaaacgauaucgccgcuugccuccgcaaaaauggcaagaaaguuauucaacugagccggaagacauuugacucugaguacgugaaaacccgcaccaacgauugggacuucgucgugacaaccgauaucuccgagaugggggccaauuuuaaggccgaaagagugaucgacccgcggagauguaugaaacccgucauucuuacagauggagaggaacgcguuauccuggcuggcccuaugcccgugacccauagcucugccgcgcagcggagagggcgcauuggccggaacccuaagaaugagaacgaccaguacaucuauaugggagaaccccucgagaaugacgaggauugcgcucacuggaaggaagccaaaaugcugcuggacaacauuaauacgccggagggcaucauuccuagcauguucgaacccgagagagaaaagguggaugccaucgacggggaguaccgccuccggggagaggcuagaaaaacauuugucgaucuuaugcgcagaggcgaccugccuguguggcuggccuauaagguugcggccgaagggaucaacuacgcugaucggcgcugguguuucgacggaauuaaaaacaaucagauccucgaggaaaacguggaggucgagauuuggaccaaggaaggcgagagaaagaaacugaagccccgguggcuugaugcccgcaucuauuccgacccucuggcucucaaagaauuuaaggaguucgccgcugggagaaaaucucugacacugaaucucauuaccgaaaugggccggcuucccacguucaugacccaaaagacaagagaugcccuggacaaccuggcggugcuccacaccgccgaggcuggaggccgcgccuacaaucaugcucugagcgagcuuccggaaacacuggagacccuccugcugcucacacuucuggccaccguuacagggggaaucuuucuguuccucauguccggccgggggaucggaaagaugacacugggcaugugcugcauuaucaccgccucuauucuucugugguaugcucagauccagccucacuggauugcggccagcaucauccucgaauuuuuccugauugugcugcucauccccgagcccgaaaaacagagaaccccucaagauaaccagcuuacauacgucgugauugcuauccugaccgucguggccgccacaauggcuaaugagaugggcuuucuggagaagacgaaaaaggaccucgggcugggauccauugccacccagcagccggaaagcaacauccuugacauugaucugcgccccgcgucugccuggacacucuacgcuguugccaccacauucaucaccccuaugcugcggcauuccaucgagaauagcuccgugaacauuucucugacggcuaucgccaaucaagcgaccgugcucaugggccuugggaaaggauggccccugagcaagauggacauuggcgucccucugcucgccaucggguguuauucccagguuaaccccauuacacugaccgcugcccuucugcuccugguggcucacuacgccaucaucggaccuggccugcaggcuaaggccacaagagaagcgcagaaacgggccgcugccggcauuaugaagaauccgaccguggaugggaucacggucauugaccucgaucccaucccuuaugaccccaaauuugagaagcaacuuggacaggugaugcugcugauucucugcguuacacaggugcugaugaugcgcaccacaugggcucuuugugaagcccugacccucgccaccggcccuaucucuacacugugggaggggaaccccggaagauucuggaauacgaccaucgcggucagcauggcuaacauuuuucggggcuccuaccuggccggggcuggacuccuuuucagcaucaugaaaaauacaaccaacacacgcagaggcaccggcaacauuggggagacgcugggagaaaaguggaaaucucggcugaaugcccucggcaaguccgaguuucaaaucuauaagaaaagcgggauucaggaaguggaucgcacacuggccaaggagggaaucaaaagaggcgagaccgaccaccaugcugucucucggggguccgccaaacuucgcugguucguggaaagaaacaugguuaccccggagggaaaaguggucgaucugggcugcggcagagggggauggagcuacuauuguggcgggcucaagaaugugaaggaaguuaaaggacugacaaagggcgggccuggacacgaggaacccauccccaugucuaccuacggcuggaaccuggugcggcuccagagcggcgucgacguguuuuucauuccucccgagaaaugcgauacacuucugugugacaucggggaguccucuccuaauccgacgguggaagcgggacgcacccugcggguucucaaccuggucgagaauuggcuuaacaauaacacacaguucugcauuaaggugcugaaucccuacaugccuagcgugaucgagaagauggaggcccuccaaagaaaguauggcggggcucugguccgcaacccccugucccggaauagcacccaugaaauguacuggguuuccaacgccucuggaaauauugugagcuccgugaacaugaucucuagaaugcucauuaaccgcuuuacaaugcggcacaagaaagcuaccuaugagccugaugucgaccuuggcagcgggacgagaaauaucggaaucgaguccgaagugcccaaccuggacauuaucggcaagcgcauugagaaaaucaagcaggaacaugagaccucuuggcacuacgaucaggaccacccguauaaaacaugggccuaccauggcagcuaugaaaccaagcagacaggguccgcgagcucuaugguuaauggagugguccggcugcucaccaagccuugggaugugcugcccacaguuacccaaauggccaugacggacacaaccccuuucggccagcagagaguguuuaaagagaaggucgauacccgcacacaggagcccaaagaagggacgaagaaacuuaugaagauuaccgcugaguggcuguggaaagaacucggaaagaagaaaacaccucggauguguaccagagaggaguucacacgcaaggugagauccaacgccgcucugggcgccaucuuuaccgacgaaaauaaauggaaaagcgcucgggaggccguggaagauucucgcuucugggagcuggucgacaaagaaagaaaccuccaccuggaggggaagugcgagacauguguuuacaauaugaugggaaagcgggagaagaaacuuggcgaguuuggcaaagcgaagggguccagagccaucugguacauguggcugggagcucgguuccucgaauuugaggcccugggcuuccuuaacgaagaucauugguuuagccgcgaaaauucucuguccgggguggagggagaaggccuccacaaacugggguauauucugagagacgugagcaagaaggagggcggagcuauguacgccgaugacaccgccggcugggacacgcggaucacccucgaagaucugaaaaacgaggaaauggucacaaaucacauggagggggagcauaagaaacuugcggaagcuauuuucaagcugaccuaucaaaacaaagugguucgcgugcagagacccacaccgcggggaaccgucauggacaucauuucccgcagagaucagcggggcagcgggcaagugggaacguacggccucaauacauuuaccaacauggaggcccagcugauccgccagauggaaggggagggcguuuucaagaauauccagcaccuuacagugaccgaggaagucgccgugcaaaacuggcuggcuagaguuggacgggagcgccucucuagaauggccauuagcggcgacgauugcguggucaagccucuggacgaucgguucgcuaacgcccugacggcgcucaaugacauggggaaaauccgcaaggauauucagcagugggaacccuccaaaggauggaacgacuggacccaggugcccuuuugcucucaucacuuccaugagcugaucaugaaggauggcagaguccuugugguuccuugucggaaucaagacgaacugauugggagagcccgcaucagccagggagcuggcuggucccuccgggagacagccugccuggggaaaucuuaugcucagauguggagccuuauguacuuucacagacgcgaucugcggcucgccgcgaacgccauuuguuccgcugugccgucucacuggguccccaccagcagaacaaccugguccauccaugccaagcacgaguggaugacaaccgaagacaugcugacgguguggaaucgcguguggauccgggagaacccuuggauggaagacaagacacccguugagagcugggaagagauuccuuaucugggcaaaagagaggaucaguggugcggaucucucaucggccugaccucccgcgcuaccugggccaagaauauucaagcugccaucaaccaggugcggagccuuauugggaaugaagaguacacagacuacaugcccucuaugaaaagauuccgccgggaagaggaagaggcgggaguccugugguga

SEQ ID NO: 19702 - RNA, 9876 nt, Artificial Sequence
  derived and/or modified CDS sequence (opt5) from DENV-2__GQ868622__SS-prME
agcgccggaaugaucauuaugcugauccccaccgugauggcuuuccaccucacaacgcggaauggggaaccucauaugauugucggaauccaggaaaagggcaagagccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgccgggaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcucgccagccugccacccugagaaaguauugcaucgaagcuaaacucacgaacacaaccaccgagucucgguguccgacacaaggagagcccucccugaaggaagaacaagacaaacgcuuugucugcaagcauagcaugguggauagaggcuggggcaauggguguggacuguucggcaaaggcgggauugugaccugcgccauguuuacaugcaaaaagaacauggaagggaaaaucguccagccugagaaucucgaauacacgauuguugugacaccccacucuggggaggagcaugcggugggaaacgacacaggcaagcacggcaaagaaaucaaggucaccccucaguccagcaucacagaggccgaacugaccggguauggaacggugaccauggaguguucuccccggacaggccuugauuucaaugaaaugguucugcuccaaauggagaacaaggcuuggcuggugcaccgccagugguuucuugaccugccgcucccuuggcugcccggggccgauaagcagggauccaauuggauucagaaggagacccuggucacauucaaaaacccucaugcuaagaaacaagacgugguugugcucggcagccaggaaggggccaugcacaccgcccugacgggcgcuacagagauccagauguccucuggaaaucuucuguuuaccggccaucucaagugcagacugcggauggacaaacuucaacugaaggggaugagcuacuccauguguacaggaaaguucaaagucgugaaggaaauugcggagacccagcacggcaccaucgucauuagagugcaguaugagggggauggaagccccugcaaaauccccuucgaaaucauggaccucgagaagcgcuacguucugggccggcugauuacagugaacccuaucgucacggaaaaagauucuccggugaacauugaggccgaacccccuuuuggggacuccuacaucauuaucggcguugagcccggacagcucaagcugaauugguucaagaaaggcagcucuauugggcaaauguuugagaccacaaugagaggagcuaagcgcauggccauccuuggcgauaccgccugggacuucgggagccugggaggcguguuuacauccaucgggaaagcucuccaucaggucuucggcgccauuuauggagcggcuuuuucuggcgugagcuggaccaugaagauccugauuggggugaucauuacguggaucggaaugaacucccggagcacaucucuguccguuagccuuguccucgugggcaucgugacccuguaccugggggucauggugcaggccgauucuggauguguuguguccuggaaaaauaaggaacucaagugcggcagcgggauuuucaucaccgacaacguccacacauggaccgagcaguauaaauuucaaccugaaucccccucuaagcuggccagcgcuauucagaaagcccaggaggaaggcaucuguggaauuagauccgugacacgccuugagaaucugauguggaagcagaucacgccggagcucaaccacauccuggcugaaaaugagguuaaacugaccauuaugacaggcgauaucaaggggauuaugcaagccggaaaacggucucuuagaccucagcccaccgaacucaaguacagcuggaagacauggggcaaagcgaagaugcuguccaccgagagccauaaccagacguuccugaucgacgggccugaaaccgccgagugccccaauacaaaccgcgcuuggaacucucucgagguggaagauuauggauuuggcgucuucaccacaaacauuuggcugaaacuuaaggagaaacaggacgccuuuugugacuccaagcugaugagcgcugccaucaaggauaaucgggcggugcacgccgacaugggcuacuggaucgaaucugcucucaacgauaccuggaaaauugagaaggccuccuucaucgagguuaaaaauugccauuggccuaagagccacacacuguggucuaacggggugcuggaaagcgagaugauuauccccaaaaaccuugcuggaccggucucccaacacaauuauagaccuggcuaccauacccagauugccgggcccuggcaccucggaaagcuggaaauggacuucgauuuuugugacggcacgacagugaucgugaccgaggauugcgggaaccgcggacccagccugcggaccacaaccgccucuggcaagcucauuacggaauggugcuguagauccugcacacugccuccgcuucgguaccgcggcgaggacggguguugguauggaauggagaucagaccccugaaagaaaaggaggaaaaucucgucaacagccugguuaccgcuggccauggacagguggauaauuucucccugggagugcuuggcauggcgcucuuucuggaggaaaugcugcggacaagagucgggaccaaacacgccauccuccugguggcuguuucuuucgugacacuuauuaccggaaacaugagcuuuaaggaccugggccgcgucgugguuauggugggcgccacgaugaccgaugacaucgggaugggagucacauaccucgcccugcuggcugccuucaaagugcggccuaccuuugcggcuggccuucugcucagaaagcugacauccaaggagcucaugaugaccacgauugggaucguucugcuuucucaaagcacaauucccgagaccauccuggaacucacagaugcccuggcccugggaaugauggugcuuaaaaucguccgcgacauggagaaguaucagcuggcugugaccauuauggccauccucugcgugccuaaugcggucauucugcagaacgcuuggaaaguuuccuguaccauccucgccguggugucugucagcccccugcuucugacauccagccagcaaaagacggacuggauuccucucgcccugaccaucaaaggccugaaucccacagcuaucuuccuuaccacacugucuagaaccaacaagaaacgguccuggccgcucaaugaagccauuauggcuguggggaugguuagcauccuggccucuucccuccugaagaacgauauuccuaugacgggaccccuuguggcgggcggccugcugacagucugcuacgugcucaccgggcgcagcgccgaccuggagcuugaaagagcuaccgauguuaagugggaggaccaggccgagaucucuggauccagcccuauucuguccaucacaauuagcgaagauggcucuaugagcaucaaaaaugaggaagaggagcagacccucacaauccugauucggacggggcuccuggugaucuccggacuuuuucccgucucuauuccgaucaccgcugccgccugguaucugugggaagugaagaaacagcgcgcuggcguccugugggacgugccuucucccccucccauggggaaggcggagcucgaagauggagccuacagaauuaaacaaaagggcauccugggcuauucccagaucggggcuggaguuuacaaggagggcacauuccauaccauguggcacgugacaagaggggccguccuuaugcacaaaggaaagcgcauugaacccuccugggccgacgugaaaaaggaucugaucagcuacggcgggggauggaaacucgagggcgaguggaaggaaggcgaggaaguucaggugcuggcucucgagccugggaagaacccgagagccguccagaccaaacccggacuguuuaagacgaauaccggcacaauuggggcggugucccuugacuucucuccuggaaccagcggcucccccaucauugauaaaaaggggaaagugguuggacuguauggcaacggcgucgugacacggagcggggcuuacgugucugccaucgcccaaaccgaaaaguccaucgaggacaacccugagauugaagaugacaucuuucgcaagagacggcugacaauuauggaccuccaucccggagcuggcaaaacgaagagauaucugccugccaucguccgcgaggcgauuaaacgggggcuuagaacccugauccucgcuccgacacgcgugguugccgccgaaauggaggaagcucugcggggacuccccauuagauaccagaccccugccauccgcgcugagcacaccggccgggagaucguggaucugaugugucaugccacauucacgaugagacuucugagccccguccgcgugccuaauuauaaccugauuaucauggacgaagcgcacuucaccgaucccgccucuauugcugcccggggguacaucuccacaagaguugagaugggcgaagcugccggaauuuuuaugaccgccacaccgccuggcagccgggaccccuucccccaguccaaugcuccuaucaucgaugaggagcgcgaaauucccgagagaucuuggaacagcgggcaugaaugggugaccgacuuuaagggaaaaacggucugguucgugccuuccaucaaggcgggcaaugauauugccgcuugccuccggaagaacgggaaaaagguuauccaacugagccgcaaaacauuugacucugaguaugugaagaccagaaccaaugauugggacuucgucgugacaaccgauauuuccgaaaugggagccaacuuuaaagccgagcgggugaucgacccgagacgcuguaugaagcccgucauccuuacagacggcgaggaacggguuauucuggcugggccuaugcccgugacccacagcucugccgcgcagagacgcggccggaucggaagaaauccuaaaaacgagaaugaucaguacauuuacaugggcgaaccccucgagaacgacgaagauugcgcucacuggaaggaggccaagaugcugcuggacaauaucaacacgccggaggggauuaucccuagcauguucgaacccgagcgcgaaaaaguggaugccauugacggagaguaucggcucagaggcgaagcucgcaagacauuugucgaucuuaugagaagaggggaccugccuguguggcuggccuacaaaguugcggccgagggaaucaauuaugcugaucgcagaugguguuucgacggcaucaagaacaaccagauucucgaggaaaauguggaggucgaaaucuggaccaaagagggggagcggaagaagcugaaaccccgcuggcuugaugccagaauuuacuccgacccucuggcucucaaggaauuuaaagaguucgccgcuggccggaagucucugacacugaaccucaucaccgaaaugggaagacuucccacguucaugacccagaagacccgcgaugcccuggacaaucuggcggugcuccauaccgccgaggcuggcgggcgggccuauaaccacgcucugagcgaacuuccggagacacuggagacccuccugcugcucacacuucuggccaccguuacgggaggcauuuuucuguuccucauguccgggagaggaaucggcaagaugacacugggcaugugcugcaucauuaccgccucuauccuucugugguacgcucagauucagccucauuggaucgcggccagcauuauccucgaauuuuuccugaucgugcugcucauucccgagcccgaaaagcagcgcaccccucaagacaaucagcuuacauaugucgugaucgcuauucugaccgucguggccgccacaauggcuaacgagaugggguuucuggagaagacgaagaaagaucucggacugggcuccaucgccacccagcagccggagagcaauauucuugacaucgaucugcggcccgcgucugccuggacacucuacgcuguugccaccacauucgugaccccuaugcugagacacuccauugagaacagcuccgugaaugucucucugacggcuaucgccaaccaagcgaccguucucauggggcuuggaaagggcuggccccugagcaaaauggacaucggggugccucugcucgccauuggauguuacucccaggugaaucccaucacacugaccgcugcccuucugcuccuggucgcucacuaugccauuaucggcccuggccugcaggcuaaggccacacgggaagcgcagaagcgcgccgcugccgggauuaugaaaaacccgaccguggauggaaucacgguuaucgaccucgaucccauuccuuacgaccccaaguuugagaaacaacuuggccaggugaugcugcugauccucugcgucacacaggugcugaugaugagaaccacaugggcucuuugugaagcccugacccucgccaccgggccuauuucuacacugugggagggaaaucccggccgguucuggaacacgaccaucgcggucagcauggcuaauauuuuucgcggguccuaucuggccggagcuggccuccuuuucagcaucaugaagaacacaaccaauacaagacggggcaccgggaacaucggagaaacgcugggcgagaaauggaagucucgccugaacgcccucgggaaauccgaguuucaaacauacaaaaagagcggcauucaggaaguggauagaacccuggccaaagagggcaucaagagaggggaaaccgaccaucacgcuguuucucgcggauccgccaaacuuagaugguucguggagcggaauauggucacaccggagggcaaggugguugaucugggcugcgggagaggaggcuggagcuauuacugugggggacucaaaaacgugcgcgaagucaagggccugaccaaagggggaccuggccaugaggaacccauucccaugucuacauauggcuggaaucuggugcggcuccagagcgggguggacgucuuuuucaucccucccgagaaaugcgauacgcuucugugugacauuggagaauccucuccuaacccgaccgucgaggcgggcagaacacugcgcgugcucaaucugguggagaacuggcuuaauaacaauacccaguucugcaucaagguccugaaccccuacaugccuagcguuaucgagaagauggaggcccuccaacggaaguacgggggagcucuggugagaaauccccugucccgcaacagcacacacgaaauguauuggguguccaaugccucuggcaacauugucagcuccgugaauaugaucucucggaugcucauuaacagauuuaccaugcgccauaaaaaggcuacguacgagccugacguugaucuugggagcggaacccggaacaucggcauugaauccgagauccccaaucuggacauuaucggcaagagaaucgagaaaauuaagcaggaacacgagacaucuuggcacuaugaucaggaccauccguacaaaaccugggccuaucacgggagcuacgaaacaaagcagaccggauccgcgagcucuauggugaacggcgucgugcgccugcucacaaaaccuugggauguucugcccaccgugacgcaaauggccaugacagacaccaccccuuucgggcagcagcgggucuuuaaggagaagguggauacaagaacgcaggaacccaaagagggaaccaagaaacuuaugaagaucacagcugaguggcuguggaaagaacucggcaagaaaaagaccccucgcauguguacaagagaggaguucacccggaaggugcgcuccaaugccgcucugggggccauuuuuacagacgagaacaaauggaaaagcgcuagagaggccgucgaagaucggagauucugggagcugguugacaaagaacggaaucuccaucuggagggaaagugcgaaaccuguguguauaacaugaugggcaaacgcgagaagaaacuuggcgaguuugggaaagcgaagggaucuagagccaucugguacauguggcugggcgcucgguuccucgaauuugaggcccugggguuccuuaaugaagaucacugguuuucccgcgagaacagccugucuggaguggaaggcgaggggcuccacaaacugggcuacauucugagagacgucuccaagaaagagggaggcgcuauguaugccgacgauacggccgggugggacacccggaucacacucgaagaucugaagaaugaggaaauggugaccaaccauauggagggagaacacaagaaacuugcggaggcuaucuucaagcugacauaccaaaauaaaguugugcgcguccagagacccaccccgcggggcacggugauggacauuaucagccgcagagaucagcggggguccggacaaguuggcacauaugggcucaacaccuuuacaaauauggaggcccagcugauucgccagauggaaggcgagggaguguucaagaacauccagcaucuuaccgccacggaagaggucgcugugcaaaauuggcuggccagaguuggccgggagcgccucagcagaauggcuauuucuggggacgauugcguggucaaaccucuggacgaucgguucgccaacgcgcugaccgcccucaacgacaugggaaagaucagaaaggauauccagcagugggaacccagcaaaggcuggaaugacuggacacaggugcccuuuugcucccaccauuuccacgagcugauuaugaaggaugggcgcguccuugugguuccuugucggaaccaagacgaacugaucggacgggcucgcauuucucagggcgccggguggagccuccgggagaccgcuugccugggcaaauccuacgcccagauguggucucuuauguauuuucacagacgcgaccugcggcucgcggccaaugcuaucuguagcgccgugccgucccauuggguccccacaucuagaaccacauggagcauucacgcuaagcaugaauggaugaccacggaggauaugcugacaguguggaaccgcguguggauccgggagaauccuuggauggaagacaaaacccccguugaguccugggaagagauuccuuaccugggaaagagagaagaucaguggugcggcagccucaucgggcugaccucucgcgccacaugggcuaagaacauccaagccgcgauuaaucaggugcggucccuuaucggaaacgaggaguauaccgacuacaugcccagcaugaaaagauuccggagagaagaggaagaggccggcguccugugguga

SEQ ID NO: 19703 - RNA, 9876 nt, Artificial Sequence
  derived and/or modified CDS sequence (opt5) from DENV-2__FJ639705__SS-prME
agcgccggaaugaucauuaugcugauccccaccgugauggcuuuccaccucacaacgcggaauggggaaccucauaugauugucggaauccaggaaaagggcaaaagccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgccgggaaaagcgguccguggcgcucguuccucaugugggaaugggccuggagacacgcaccgaaacguggaugucuagcgagggcgcuuggaaacacgcccagcggaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcucgccagccugccacccugagaaaguauugcaucgaagcuaaacucacgaacacaaccaccgagucucgguguccgacacaaggagagcccucccugaaggaagaacaagacaaacgcuuugucugcaagcauagcaugguggauagaggcuggggcaauggguguggacuguucggcaaaggcgggauugugaccugcgccauguuuacaugcaaaaagaacauggaagggaaaaucguccagccugagaaucucgaauacacgauuguugugacaccccacucuggggaggagcaugcggugggaaacgacacaggcaagcacggcaaagaaaucaaggucaccccucaguccagcaucacagaggccgaacugaccggguauggaacggugaccauggaguguucuccccggacaggccuugauuucaaugaaaugguucugcuccaaauggagaacaaggcuuggcuggugcaccgccagugguuucuugaccugccgcucccuuggcugcccggggccgauaagcagggauccaauuggauucagaaggagacccuggucacauucaaaaacccucaugcuaagaaacaagacgugguugugcucggcagccaggaaggggccaugcacaccgcccugacgggcgcuacagagauccagauguccucuggaaaucuucuguuuaccggccaucucaagugcagacugcggauggacaaacuucaacugaaggggaugagcuacuccauguguacaggaaaguucaaagucgugaaggaaauugcggagacccagcacggcaccaucgucauuagagugcaguaugagggggauggaagccccugcaaaauccccuucgaaaucauggaccucgagaagcgcuacguucugggccggcugauuacagugaacccuaucgucacggaaaaagauucuccggugaacauugaggccgaacccccuuuuggggacuccuacaucauuaucggcguugagcccggacagcucaagcugaauugguucaagaaaggcagcucuauugggcaaauguuugagaccacaaugagaggagcuaagcgcauggccauccuuggcgauaccgccugggacuucgggagccugggaggcguguuuacauccaucgggaaagcucuccaucaggucuucggcgccauuuauggagcggcuuuuucuggcgugagcuggaccaugaagauccugauuggggugaucauuacguggaucggaaugaacucccggagcacaucucuguccguuagccuuguccucgugggcaucgugacccuguaccugggggucauggugcaggccgauucuggauguguuguguccuggaaaaauaaggaacucaagugcggcagcgggauuuucaucaccgacaacguccacacauggaccgagcaguauaaauuucaaccugaaucccccucuaagcuggccagcgcuauucagaaagcccaggaggaaggcaucuguggaauuagauccgugacacgccuugagaaucugauguggaagcagaucacgccggagcucaaccacauccuggcugaaaaugagguuaaacugaccauuaugacaggcgauaucaaggggauuaugcaagccggaaaacggucucuuagaccucagcccaccgaacucaaguacagcuggaagacauggggcaaagcgaagaugcuguccaccgagagccauaaccagacguuccugaucgacgggccugaaaccgccgagugccccaauacaaaccgcgcuuggaacucucucgagguggaagauuauggauuuggcgucuucaccacaaacauuuggcugaaacuuaaggagaaacaggacgccuuuugugacuccaagcugaugagcgcugccaucaaggauaaucgggcggugcacgccgacaugggcuacuggaucgaaucugcucucaacgauaccuggaaaauugagaaggccuccuucaucgagguuaaaaauugccauuggccuaagagccacacacuguggucuaacggggugcuggaaagcgagaugauuauccccaaaaaccuugcuggaccggucucccaacacaauuauagaccuggcuaccauacccagauugccgggcccuggcaccucggaaagcuggaaauggacuucgauuuuugugacggcacgacagugaucgugaccgaggauugcgggaaccgcggacccagccugcggaccacaaccgccucuggcaagcucauuacggaauggugcuguagauccugcacacugccuccgcuucgguaccgcggcgaggacggguguugguauggaauggagaucagaccccugaaagaaaaggaggaaaaucucgucaacagccugguuaccgcuggccauggacagguggauaauuucucccugggagugcuuggcauggcgcucuuucuggaggaaaugcugcggacaagagucgggaccaaacacgccauccuccugguggcuguuucuuucgugacacuuauuaccggaaacaugagcuuuaaggaccugggccgcgucgugguuauggugggcgccacgaugaccgaugacaucgggaugggagucacauaccucgcccugcuggcugccuucaaagugcggccuaccuuugcggcuggccuucugcucagaaagcugacauccaaggagcucaugaugaccacgauugggaucguucugcuuucucaaagcacaauucccgagaccauccuggaacucacagaugcccuggcccugggaaugauggugcuuaaaaucguccgcgacauggagaaguaucagcuggcugugaccauuauggccauccucugcgugccuaaugcggucauucugcagaacgcuuggaaaguuuccuguaccauccucgccguggugucugucagcccccugcuucugacauccagccagcaaaagacggacuggauuccucucgcccugaccaucaaaggccugaaucccacagcuaucuuccuuaccacacugucuagaaccaacaagaaacgguccuggccgcucaaugaagccauuauggcuguggggaugguuagcauccuggccucuucccuccugaagaacgauauuccuaugacgggaccccuuguggcgggcggccugcugacagucugcuacgugcucaccgggcgcagcgccgaccuggagcuugaaagagcuaccgauguuaagugggaggaccaggccgagaucucuggauccagcccuauucuguccaucacaauuagcgaagauggcucuaugagcaucaaaaaugaggaagaggagcagacccucacaauccugauucggacggggcuccuggugaucuccggacuuuuucccgucucuauuccgaucaccgcugccgccugguaucugugggaagugaagaaacagcgcgcuggcguccugugggacgugccuucucccccucccauggggaaggcggagcucgaagauggagccuacagaauuaaacaaaagggcauccugggcuauucccagaucggggcuggaguuuacaaggagggcacauuccauaccauguggcacgugacaagaggggccguccuuaugcacaaaggaaagcgcauugaacccuccugggccgacgugaaaaaggaucugaucagcuacggcgggggauggaaacucgagggcgaguggaaggaaggcgaggaaguucaggugcuggcucucgagccugggaagaacccgagagccguccagaccaaacccggacuguuuaagacgaauaccggcacaauuggggcggugucccuugacuucucuccuggaaccagcggcucccccaucauugauaaaaaggggaaagugguuggacuguauggcaacggcgucgugacacggagcggggcuuacgugucugccaucgcccaaaccgaaaaguccaucgaggacaacccugagauugaagaugacaucuuucgcaagagacggcugacaauuauggaccuccaucccggagcuggcaaaacgaagagauaucugccugccaucguccgcgaggcgauuaaacgggggcuuagaacccugauccucgcuccgacacgcgugguugccgccgaaauggaggaagcucugcggggacuccccauuagauaccagaccccugccauccgcgcugagcacaccggccgggagaucguggaucugaugugucaugccacauucacgaugagacuucugagccccguccgcgugccuaauuauaaccugauuaucauggacgaagcgcacuucaccgaucccgccucuauugcugcccggggguacaucuccacaagaguugagaugggcgaagcugccggaauuuuuaugaccgccacaccgccuggcagccgggaccccuucccccaguccaaugcuccuaucaucgaugaggagcgcgaaauucccgagagaucuuggaacagcgggcaugaaugggugaccgacuuuaagggaaaaacggucugguucgugccuuccaucaaggcgggcaaugauauugccgcuugccuccggaagaacgggaaaaagguuauccaacugagccgcaaaacauuugacucugaguaugugaagaccagaaccaaugauugggacuucgucgugacaaccgauauuuccgaaaugggagccaacuuuaaagccgagcgggugaucgacccgagacgcuguaugaagcccgucauccuuacagacggcgaggaacggguuauucuggcugggccuaugcccgugacccacagcucugccgcgcagagacgcggccggaucggaagaaauccuaaaaacgagaaugaucaguacauuuacaugggcgaaccccucgagaacgacgaagauugcgcucacuggaaggaggccaagaugcugcuggacaauaucaacacgccggaggggauuaucccuagcauguucgaacccgagcgcgaaaaaguggaugccauugacggagaguaucggcucagaggcgaagcucgcaagacauuugucgaucuuaugagaagaggggaccugccuguguggcuggccuacaaaguugcggccgagggaaucaauuaugcugaucgcagaugguguuucgacggcaucaagaacaaccagauucucgaggaaaauguggaggucgaaaucuggaccaaagagggggagcggaagaagcugaaaccccgcuggcuugaugccagaauuuacuccgacccucuggcucucaaggaauuuaaagaguucgccgcuggccggaagucucugacacugaaccucaucaccgaaaugggaagacuucccacguucaugacccagaagacccgcgaugcccuggacaaucuggcggugcuccauaccgccgaggcuggcgggcgggccuauaaccacgcucugagcgaacuuccggagacacuggagacccuccugcugcucacacuucuggccaccguuacgggaggcauuuuucuguuccucauguccgggagaggaaucggcaagaugacacugggcaugugcugcaucauuaccgccucuauccuucugugguacgcucagauucagccucauuggaucgcggccagcauuauccucgaauuuuuccugaucgugcugcucauucccgagcccgaaaagcagcgcaccccucaagacaaucagcuuacauaugucgugaucgcuauucugaccgucguggccgccacaauggcuaacgagaugggguuucuggagaagacgaagaaagaucucggacugggcuccaucgccacccagcagccggagagcaauauucuugacaucgaucugcggcccgcgucugccuggacacucuacgcuguugccaccacauucgugaccccuaugcugagacacuccauugagaacagcuccgugaaugucucucugacggcuaucgccaaccaagcgaccguucucauggggcuuggaaagggcuggccccugagcaaaauggacaucggggugccucugcucgccauuggauguuacucccaggugaaucccaucacacugaccgcugcccuucugucucucgucgcucacuaugccauuaucggcccuggccugcaggcuaaggccacacgggaagcgcagaagcgcgccgcugccgggauuaugaaaaacccgaccguggauggaaucacgguuaucgaccuggaucccauuccuuacgaccccaaguuugagaaacaacucggccaggugaugcuucugauccugugcgucacacaggugcucaugaugagaaccacaugggcucugugugaagcccuuacccuggccaccgggccuauuagcacacucugggagggaaaucccggccgguucuggaacacgaccaucgcggucuccauggcuaauauuuuucgcgggagcuaucuggccggagcuggccuccuguucucuaucaugaagaacacaaccaauacaagacggggcaccgggaacaucggagaaacgcuuggcgagaaauggaagucccgccugaacgcccuggggaaaagcgaguuucaaacauacaagaagucuggcauucaggaaguggauagaacccucgccaaagagggcaucaagagaggggaaaccgaccaucacgcuguuucccgcggaagcgccaaacugagaugguucguggagcggaauauggucacaccggagggcaaggugguugaucuuggcugcgggagaggaggcuggucuuauuacugugggggacugaaaaacgugcgcgaagucaagggccucaccaaagggggaccuggccaugaggaacccauucccaugagcacauauggcuggaaucuggugcggcugcaguccgggguggacgucuuuuucaucccucccgagaaaugcgauacgcuccuuugugacauuggagaaucuagcccuaacccgaccgucgaggcgggcagaacacugcgcgugcugaaucucguggagaacuggcugaauaacaauacccaguucugcaucaagguccuuaaccccuacaugccuuccguuaucgagaaaauggaggcccugcaacggaaguacgggggagcucucgugagaaauccccugagccgcaacuccacacacgaaauguauugggugucuaaugccagcggcaacauugucuccucugugaauaugaucagccggaugcugauuaacagauuuaccaugcgccauaaaaaggcuacguacgagccugacguugaucucggguccggaacccggaacaucggcauugaaucugagauccccaaucuugacauuaucggcaagagaaucgagaaaauuaagcaggaacacgagacaagcuggcacuaugaucaggaccauccguacaaaaccugggccuaucacggguccuacgaaacaaagcagaccggaagcgcgucuuccauggugaacggcgucgugcgccugcugacaaaaccuugggauguucuccccaccgugacgcaaauggccaugacagacaccaccccuuucgggcagcagcgggucuuuaaggagaagguggauacaagaacgcaggaacccaaagagggaaccaagaaacugaugaagaucacagcugaguggcuuuggaaagaacugggcaagaaaaagaccccucgcauguguacaagagaggaguucacccggaaggugcgcagcaaugccgcucucggggccauuuuuacagacgagaacaaauggaagucugcuagagaggccgucgaagauucccgguucugggagcugguugacaaagaaagaaaucugcaucucgagggaaagugcgaaaccuguguguauaacaugaugggcaaacgggagaagaagcugggcgaguuugggaaagcgaagggaagccgcgccaucugguacauguggcuuggcgcuagauuccuggaauuugaggcccucggguuccugaaugaagaucacugguuuucucgggagaacucccuuagcggaguggaaggcgaggggcugcacaaacucggcuacauucugcgcgacgucuccaagaaagagggaggcgcuauguaugccgacgauacggccgggugggacaccagaaucacacuggaagaucucaagaaugaggaaauggugaccaaccauauggagggagaacacaagaaacuggcggaggcuaucuucaaacuuacauaccaaaauaaaguugugcggguccagcgccccaccccgagaggcacggugauggacauuaucagccggcgcgaucagagagggucuggacaaguuggcacauaugggcugaacaccuuuacaaauauggaggcccagcucauucggcagauggaaggcgagggaguguucaagaacauccagcaucugaccgccacggaagaggucgcugugcaaaauuggcuugcccgcguuggcagagagcggcugagccgcauggcuauuuccggggacgauugcguggucaaaccucucgacgauagauucgccaacgcgcugaccgcccugaacgacaugggaaagauccggaaggauauccagcagugggaacccucuaaaggcuggaaugacuggacacaggugcccuuuugcagccaccauuuccacgagcucauuaugaaggaugggagaguccuggugguuccuugucgcaaccaagacgaacuuaucggacgggcuagaauuucccagggcgccggguggucucugcgcgagaccgcuugccucggcaaaagcuacgcccagauguggucccugauguauuuucaccggagagaccuucgccuggcggccaaugcuaucuguucugccgugccgagccauuggguccccacaucccggaccacauggagcauucacgcuaagcaugaauggaugaccacggaggauaugcucacaguguggaacagaguguggauccgcgagaauccuuggauggaagacaaaacccccguugagucuugggaagagauuccuuaccugggaaagcgggaagaucaguggugcggcucccugaucgggcucaccagcagagccacaugggcuaagaacauccaagccgcgauuaaucaggugcgcucucugaucggaaacgaggaguauaccgacuacaugcccuccaugaaacgguucagacgggaagaggaagaggccggcguccuuugguga

SEQ ID NO: 19704 - RNA, 9876 nt, Artificial Sequence
  derived and/or modified CDS sequence (opt5) from DENV-2__FJ639706__SS-prME
agcgccggaaugaucauuaugcugauccccaccgugauggcuuuccaccucaccacgagaaacggggagccucauaugauugucggaauccaggaaaagggaaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaagcacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcagggauccaauuggauucagaaagagacccuggucacauucaagaacccucaugcuaaaaagcaagacgugguugugcucggcagccaggaaggggccaugcacaccgcccugacgggcgcuacagagauccagauguccucuggaaaucuucuguuuaccggccaucucaaaugccgccugagaauggacaaacuucaacugaaggggaugagcuacuccauguguacaggaaaauucaaggucgugaaagaaauugcggagacccagcacggcaccaucgucauucgggugcaguaugagggggauggaagccccugcaagauccccuucgaaaucauggaccucgagaaaagauacguucugggccgccugauuacagugaacccuaucgucacggaaaaggauucuccggugaacauugaggccgaacccccuuuuggggacuccuacaucauuaucggcguugagcccggacagcucaagcugaauugguucaaaaagggcagcucuauugggcaaauguuugagaccacaaugcggggagcuaaaagaauggccauccuuggcgauaccgccugggacuucgggagccugggaggcguguuuacauccaucgggaaggcucuccaucaggucuucggcgccauuuauggagcggcuuuuucuggcgugagcuggaccaugaaaauccugauuggggugaucauuacguggaucggaaugaacucccgcagcacaucucuguccguuagccuuguccucgugggcaucgugacccuguaccugggggucauggugcaggccgauucuggauguguuguguccuggaagaauaaggaacucaaaugcggcagcgggauuuucaucaccgacaacguccacacauggaccgagcaguauaaguuucaaccugaaucccccucuaaacuggccagcgcuauucagaaggcccaggaggaaggcaucuguggcauucgguccgugacaagacuugagaaucugauguggaaacagaucacgccggagcucaaccacauccuggcugaaaaugagguuaagcugaccauuaugacaggcgauaucaaagggauuaugcaagccggaaagcgcucucuucggccucagcccaccgaacucaaguacagcuggaaaacauggggcaaggcgaaaaugcuguccaccgagagccauaaccagacguuccugaucgacgggccugaaaccgccgagugccccaauacaaacagagcuuggaacucucucgagguggaagauuauggauuuggcgucuucaccacaaacauuuggcugaaacuuaaagagaagcaggacgccuuuugugacuccaagcugaugagcgcugccaucaaagauaaucgcgcggugcacgccgacaugggcuacuggaucgaaucugcucucaacgauaccuggaagauugagaaagccuccuucaucgagguuaagaauugccauuggccuaaaagccacacacuguggucuaacggggugcuggaaagcgagaugauuauccccaagaaccuugcuggaccggucucccaacacaauuaucggccuggcuaccauacccagauugccgggcccuggcaccucggaaagcuggaaauggacuucgauuuuugugacggcacgacagugaucgugaccgaggauugcgggaacagaggacccagccugcgcaccacaaccgccucuggcaaacucauuacggaauggugcugucgguccugcacacugccuccgcuuagauaccggggcgaggacggguguugguauggaauggagauccgcccccugaaggaaaaagaggaaaaucucgucaacagccugguuaccgcuggccauggacagguggauaauuucucccugggagugcuuggcauggcgcucuuucuggaggaaaugcugagaacacgggucgggaccaagcacgccauccuccugguggcuguuucuuucgugacacuuauuaccggaaacaugagcuuuaaagaccugggcagagucgugguuauggugggcgccacgaugaccgaugacaucgggaugggagucacauaccucgcccugcuggcugccuucaaggugcgcccuaccuuugcggcuggccuucugcuccggaagcugacauccaaagagcucaugaugaccacgauugggaucgcccugcuuucucaaagcacaauucccgagaccauccuggaacucacagaugcccuggcucugggaaugaugguucuuaagaucgugagagacauggagaaauaucagcuggccgucaccauuauggcgauccucugcgugccuaaugcugugauucugcagaacgccuggaaggucuccuguaccauccucgccguugugucugugagcccccugcuucugacauccagccagcagaagacggacuggauuccucucgcucugaccaucaagggccugaaucccacagccaucuuccuuaccacacugucucgcaccaacaaaaagagauccuggccgcucaaugaagcuauuauggccgucgggauggugagcauccuggcgucuucccuccugaagaacgauauuccuaugacgggaccccuuguugccggcggccugcugacagugugcuacguccucaccgggcggagcgcugaccuggagcuugaacgcgccaccgaugugaaaugggaggaccaggcugagaucucuggauccagcccuauucuguccaucacaauuagcgaagauggcucuaugagcaucaagaaugaggaagaggagcagacccucacaauccugauuagaacggggcuccugguuaucuccggacuuuuucccgugucuauuccgaucaccgccgccgcuugguaucugugggaagucaaaaagcagcgggcgggcgugcugugggacgucccuucucccccucccauggggaaagccgagcucgaagauggagcuuaccgcauuaagcaaaagggcauccugggcuauucccagaucggggccggaguguacaaagagggcacauuccauaccauguggcacguuacaagaggggccgugcuuaugcacaagggaaaacggauugaacccuccugggcugacgucaagaaagaucugaucagcuacggcgggggauggaagcucgagggcgaguggaaggaaggcgaggaagugcagguucuggcccucgagccugggaaaaacccgcgcgcggugcagaccaagcccggacuguuuaaaacgaauaccggcacaauuggggcugucucccuugacuucucuccuggaaccagcggcucccccaucauugauaagaaagggaagguggugggacuguauggcaacggcguugucacaagaagcggggccuacgugucugccaucgcucaaaccgaaaaguccaucgaggacaacccugagauugaagaugacaucuuucggaaacgcagacugacaauuauggaccuccaucccggagccggcaagacgaaacgguaucugccugcgaucgugagagaggcuauuaagcgcgggcuucggacccugauccucgccccgacaagagucguggccgcugaaauggaggaagcccugcgcggacuccccauucgguaccagaccccugcuaucagagccgagcacaccggccgcgagaucguugaucugaugugucaugcgacauucacgaugcggcuucugagccccgugagagucccuaauuauaaccugauuaucauggacgaagcccacuucaccgaucccgcuucuauugccgcucgcggguacaucuccacacggguggagaugggcgaagccgccggaauuuuuaugaccgcuacaccgccuggcagcagagaccccuucccccaguccaaugcgccuaucaucgaugaggagcgggaaauucccgagcgcucuuggaacagcgggcaugaauggguuaccgacuuuaaaggaaagacggugugguucgucccuuccaucaaggccggcaaugauauugcugccugccuccgcaagaaugggaagaaagugauccaacugagccggaagacauuugacucugaguauguuaaaacccgcaccaaugauugggacuucguggucacaaccgauauuuccgaaaugggagccaacuuuaaggcugagagagugaucgacccgcggagauguaugaaacccgugauccuuacagacggcgaggaacgcgucauucuggccgggccuaugcccguuacccacagcucugcggcucagcggagaggccgcaucggacggaauccuaagaacgagaaugaucaguacauuuacaugggcgaaccccucgagaacgacgaagauugcgcccacuggaaggaggccaaaaugcugcuggacaauaucaacacgccggaggggauuaucccuagcauguucgaacccgagagagaaaagguggaugcuauugacggagaguaucgccuccggggcgaagccagaaaaacauuuguggaucuuaugcgcagaggggaccugccugucuggcuggcguacaagguggccgcugagggaaucaauuaugccgaucggcgcugguguuucgacggcaucaaaaacaaccagauucucgaggaaaauguugagguggaaaucuggaccaaggagggggagagaaagaaacugaagccccgguggcuugaugcucgcauuuacuccgacccucuggcccucaaagaauuuaaggaguucgcugccggcagaaaaucucugacacugaaccucaucaccgaaaugggacggcuucccacguucaugacccaaaagacaagagaugcgcuggacaaucuggccguccuccauaccgcugaggccggcgggcgcgcuuauaaccacgcccugagcgaacuuccggagacacuggagacccuccugcugcucacacuucuggccaccgugacgggaggcauuuuucuguuccucauguccgggcggggaaucggcaagaugacacugggcaugugcugcaucauuaccgcuucuauccuucugugguacgcgcagauucagccucauuggaucgccgcuagcauuauccucgaauuuuuccugaucguucugcucauucccgagcccgaaaaacagagaaccccucaagacaaucagcuuacauauguggucaucgccauucugaccguggucgccgcuacaauggccaacgagaugggguuucuggaaaagacgaaaaaggaucucggacugggcuccaucgcgacccagcagccggagagcaauauucuugacaucgaucugcgccccgccucugcuuggacacucuacgccguggcuaccacauucguuaccccuaugcugcggcacuccauugagaacagcuccgugaaugugucucugacggccaucgcgaaccaagccaccguccucauggggcuuggaaaaggcuggccccugagcaagauggacaucgggguuccucugcucgcuauuggauguuacucccaggugaaucccaucacacugaccgccgcccuucugcuccugguggcccacuaugcuauuaucggcccuggccugcaggccaaggcgacaagagaagcccagaaacgggcugccgcugggauuaugaagaacccgaccgucgauggaaucacggugaucgaccucgaucccauuccuuacgaccccaaauuugagaagcaacuuggccagguuaugcugcugauccucugcgugacacagguccugaugaugcgcaccacaugggcccuuugugaagcccugacccucgcgaccgggccuauuucuacacugugggagggaaaucccggcagauucuggaacacgaccaucgcugugagcauggccaauauuuuucggggguccuaucuggcuggagccggccuccuuuucagcaucaugaaaaacacaaccaauacacgcagaggcaccgggaacaucggagaaacgcugggcgagaaguggaaaucucggcugaacgcccucgggaaguccgaguuucaaacauacaagaaaagcggcauucaggaagucgaucgcacccuggcuaaggagggcaucaaaagaggggaaaccgaccaucacgccgugucucggggauccgcgaaacuucgcugguucguugagagaaauauggugacaccggagggcaaagucguggaucugggcugcgggcggggaggcuggagcuauuacugugggggacucaagaacguuagagaagugaagggccugaccaaagggggaccuggccaugaggaacccauucccaugucuacauauggcuggaaucugguccgccuccagagcgggguggacguguuuuucaucccucccgagaagugcgauacgcuucugugugacauuggagaauccucuccuaacccgaccguugaggccggccggacacugagaguccucaaucugguggagaacuggcuuaauaacaauacccaguucugcaucaaagugcugaaccccuacaugccuagcgucaucgaaaagauggaggcucuccaacgcaaauacgggggagcccugguucggaauccccuguccagaaacagcacacacgaaauguauuggguguccaaugcuucuggcaacauugugagcuccgucaauaugaucucucgcaugcucauuaaccgguuuaccaugagacauaagaaggccacguacgagccugacguggaucuugggagcggaacccgcaacaucggcauugaauccgagauccccaaucuggacauuaucggcaaacggaucgagaagauuaaacaggaacacgagacaucuuggcacuaugaucaggaccauccguacaagaccugggcguaucacgggagcuacgaaacaaaacagaccggauccgccagcucuaugguuaacggcguggucagacugcucacaaagccuugggaugugcugcccaccguuacgcaaauggcuaugacagacaccaccccuuucgggcagcagcgcguguuuaaggagaaagucgauacacggacgcaggaacccaaggagggaaccaagaaacuuaugaaaaucacagccgaguggcuguggaaagaacucggcaaaaagaagaccccuagaauguguacacgcgaggaguucaccagaaaagugcgguccaaugcugcccugggggcuauuuuuacagacgagaacaaguggaaaagcgcccgcgaggcgguggaagauucuagauucugggagcuggucgacaaggaacggaaucuccaucuggagggaaaaugcgaaaccuguguuuauaacaugaugggcaagagagagaagaaacuuggcgaguuugggaaggccaaaggaucccgggcuaucugguacauguggcugggcgcccgcuuccucgaauuugaggcucugggguuccuuaaugaagaucacugguuuagcagagagaacucucuguccggaguggaaggcgaggggcuccacaagcugggcuacauucugcgggacgugagcaaaaaggagggaggcgccauguaugccgacgauacggcggggugggacacccgcaucacacucgaagaucugaagaaugaggaaauggucaccaaccauauggagggagaacacaagaaacuugcugaggccaucuucaaacugacauaccaaaauaaagugguuagagugcagcggcccaccccgcgcggcacggucauggacauuaucuccagaaaagaucagcgggggagcggacaagugggcacauaugggcucaacaccuuuacaaauauggaggcccagcugauucgccagauggaaggcgagggaguuuucaagaacauccagcaucuuaccgcuacggaagagguggccguccaaaauuggcuggcuagagugggccgggagcgccucucuagaauggccauuagcggggacgauugcguugugaagccucuggacgaucgguucgcgaacgcccugaccgcucucaacgacaugggaaaaauccgcaaggauauccagcagugggaacccuccaaaggcuggaaugacuggacacagguccccuuuugcucucaccauuuccacgagcugauuaugaaggaugggagagugcuugucgugccuugucggaaccaagacgaacugaucgggagagcucgcauuagccagggcgcuggguggucccuccgggagaccgccugccugggcaaaucuuacgcgcagauguggagccuuauguauuuucacagacgcgaccugcggcucgccgcuaaugccaucuguuccgcuguuccgucucauugggugcccacaagcagaaccacaugguccauucacgccaagcaugaauggaugaccacggaggauaugcugacagucuggaaccgcguguggauccgggagaauccuuggauggaagacaagacccccguggagagcugggaagagauuccuuaccugggaaaaagagaagaucaguggugcggcucucucaucgggcugaccucccgcgcuacaugggccaagaacauccaagcggccauuaaucagguucggagccuuaucggaaacgaggaguauaccgacuacaugcccucuaugaaaagauuccgccgggaagaggaagaggcuggcgugcugugguga

SEQ ID NO: 19705 - RNA, 9876 nt, Artificial Sequence
  derived and/or modified CDS sequence (opt5) from DENV-2__FJ639707__SS-prME
agcgccggaaugaucauuaugcugauccccaccgucauggcuuuccaccugaccacgagaaauggggagccucauaugauugucggaauccaggaaaagggcaagagccugcuuuuuaagaccgaggacgggguuaauaugugcacgcugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacauucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucggcgggguguuuacauccauugggaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccacagagugccccaauaccaacagagcguggaacucucucgaaguggaggauuacggguuuggagucuucacaaccaacaucuggcugaaacuuaaagaaaagcaggacgccuuuugugacuccaagcugaugagcgcugccaucaaagauaaucgcgcugugcaugccgacaugggcuauuggauugagucugcgcucaacgauacauggaagaucgagaaagccuccuucauugaaguuaagaauugccacuggccuaaaagccauacccuguggucuaacggcgugcuggagagcgaaaugaucauucccaagaaccuugcugggccggucucccaacacaauuaccggccuggauaccacacgcagaucgccggccccuggcaucucgggaagcuggagauggacuucgauuuuugugacggaacaaccgugauugugaccgaagauugcggcaacagagggcccagccugcgcacaaccacggcuucuggaaaacucaucacagaguggugcugucgguccugcacccugccuccgcuuagauaucggggcgaggacggcuguugguacgggauggaaauccgcccccugaaggagaaagaagagaaucucgucaacagccugguuacagccggacacggccagguggauaauuucucccugggggugcuuggaauggcccucuuucuggaagagaugcugagaacccgggucggcacaaagcaugcuauucuccugguggcgguuucuuucaugacccuuaucacggggaacaugagcuuuaaagaccugggaagaguggucgugaugguuggcgccaccauggcugaugacauuggcaugggggugacauaucucgcccugcuggccgcuuucaagguccgcccuaccuuugccgcgggacuucugcuccggaagcugacauccaaagagcucaugaugaccacgaucggcauugugcugcuuucucaaagcacaauccccgaaaccguucuggagcucacagaugcucuggcccuggggaugauggugcuuaagaucgucagaaauauggaaaaauaccagcuggccgugaccauuauggcuauccucugcgugccuaacgccgucauucugcagaaugcguggaagguuuccuguaccauccucgcuguggugucugucagcccccugcuucugacauccagccagcagaagacggacuggauuccucucgcccugaccaucaagggacugaaccccacagccaucuuccuuaccacacugucucgcaccaauaaaaagagauccuggccgcucaacgaggcuauuauggccgugggcaugguuagcauccuggcuucuucccuccugaagaaugacauuccuaugacggggccccuugccgcgggaggccugcugacagugugcuauguccucaccggccggagcgccgaucuggaacuugagcgcgcuaccgacgugaaaugggaggaucaggccgaaaucucuggguccagcccuauucuguccaucacaauuagcgaggacggaucuaugagcaucaagaacgaagaggaggaacagacccucacaauccugauuagaacgggccuccugguuaucuccgggcuuuuucccauuucuaucccgauuaccgcugccgccugguaccugugggaggugaaaaagcagcgggcuggaguccugugggaugugccuucucccccucccaugggcaaagcggaacucgaggacggggccuaucgcaucaagcaaaagggaauccugggcuacucccagauuggcgcuggggucuacaaagaaggaacauuccacaccauguggcaugugacaagaggcgccguucuuaugcacaaggggaaacggaucgagcccuccugggccgaugugaagaaagaccugauuagcuauggaggcggguggaagcucgagggagaauggaaggagggcgaagagguccaggugcuggcucucgaaccuggcaaaaauccgcgcgccguucagaccaagcccgggcuguuuaaaacgaacaccggaacaaucggcgcggugucccuugauuucucuccugggaccagcggaucccccauuaucgacaagaaaggcaaggucguggggcuguacggaaacggcgugguuacaagaagcggcgcuuaugucucugccaucgcccaaaccgagaaguccauugaggauaauccugaaaucgaggacgauauuuuucggaaacgcagacugacaaucauggaccuccaccccggggcuggaaagacgaaacgguaccugccugccauugugagagaagcgaucaagcgcggccuucggacccugauucucgcuccgacaagaguggucgccgccgagauggaagaggcucugcgcgggcuccccauccgguaucagaccccugccaucagagcugagcauaccggacgcgaaauuguggaccugaugugucacgccacauucacgaugcggcuucugagccccguuagagugccuaacuacaaucugaucauuauggaugaggcgcauuucaccgaccccgccucuaucgcugcccgcggcuauauuuccacacgggucgaaaugggggaggcugccggcaucuuuaugaccgccacaccgccuggaagcagagaucccuucccccaguccaacgcuccuaucauugacgaggaacgggagauccccgaacgcucuuggaauagcggccacgagugggugaccgauuuuaaagggaagacgguuugguucgugccuuccauuaaggcgggaaacgacaucgccgcuugccuccgcaaaaauggcaagaaagucauucaacugagccggaagacauuugauucugaauacgccaaaacccgcaccaacgacugggauuucgugguuacaaccgacaucuccgagaugggggccaauuuuaaggcugagagagugaucgauccgcggagauguaugaaacccgucauucuuacagacggagaggaacgcgugauccuggccggcccuaugcccgugacccauagcucugcggcucagcggagagggcgcauuggccggaacccuaagaaugaaaacgaccaguacaucuauaugggagagccccucgaaaaugaugaggacugcgcccacuggaaggaggccaaaaugcugcuggauaacauuaauacgccggaaggcaucauuccuagcauguucgagcccgaaagagagaaggucgacgcuaucgauggggaauaccgccuccggggagaggccagaaaaacauuuguugaccuuaugcgcagaggcgaucugccuguguggcuggcguauaagguggccgcugaggggaucaacuacgccgaccggcgcugguguuucgauggaauuaaaaacaaucagauccucgaagagaacgucgaaguggagauuuggaccaaggagggcgaaagaaagaaacugaagccccgguggcuugacucccgcaucuauucugauccucuggcucucaaagaguuuaaggaguucgccgcugggagaaaaagccugacacugaaucucauuaccgagaugggccggcuucccacguucaugacccaaaagacaagagacgcccuggauaaccuggcgguucuccacaccgccgaagcuggaggccgcgccuacaaucaugcucuguccgagcuuccggagacacuggaaacccuccugcugcucacacuucuggccaccgugacagggggaaucuuucuguuccucaugucuggccgggggaucggaaagaugacacugggcaugugcugcauuaucaccgccagcauucuucugugguaugcucagauccagccucacuggauugcggccuccaucauccucgaguuuuuccugauuguccugcucauccccgaacccgagaaacagagaaccccucaagacaaccagcuuacauacgugguuauugcuauccugaccguggucgccgccacaauggcuaaugaaaugggcuuucuggagaagacgaaaaaggaccucgggcugggaagcauugccacccagcagccggagucuaacauccuugauauugaccugcgccccgcguccgccuggacacucuacgcuguggccaccacauucgucaccccuaugcugcggcauagcaucgaaaauuccucugugaacguuagccugacggcuaucgccaaucaagcgaccgugcucgugggccuugggaaaggauggccccuguccaagauggauauuggcgucccucugcucgccaucggguguuauucucagguuaaccccauuacacugaccgcugcccuucugcuccugguggcucacuacgccaucauuggaccuggccugcaggcuaaggccacaagagaggcgcagaaacgggccgcugccggcaucaugaagaauccgaccguggacgggaucacggucauugaucucgaccccaucccuuaugaucccaaauuugaaaagcaacuuggacaggugaugcugcugauucucugcguuacacaggugcugaugaugcgcaccacaugggcucuuugugaggcccugacccucgccaccggcccuaucagcacacugugggaagggaaccccggaagauucuggaauacgaccauugcggucuccauggcuaacaucuuucggggcagcuaccuggccggggcuggacuccuuuucucuaucaugaaaaauacaaccaacacacgcagaggcaccggcaacauuggggagacgcugggagagaaguggaaaucccggcugaaugcccucggcaagagcgaauuucaaaucuauaagaaaucugggauucaggagguggaccgcacacuggccaaggaaggaaucaaaagaggcgagaccgaucaccaugcugucucccgggggagcgccaaacuucgcugguucguggagagaaacaugguuaccccggaaggaaaaguggucgaccugggcugcggcagagggggauggucuuacuauuguggcgggcucaagaaugugcgggagguuaagggacugacaaaaggcgggccuggacacgaagaacccauucccaugagcaccuacggcuggaaccuggugcgccuccaguccggcgucgauguguuuuucaucccucccgaaaagugcgacacacuucugugugauaucggggagucuagcccuaauccgacgguggaggcgggacggacccugagaguucucaaccuggucgaaaauuggcuuaacaauaacacacaguucugcauuaaagugcugaaucccuacaugccuuccgugaucgagaagauggaagcccuccaacgcaaauauggcggggcucugguccggaacccccugagcagaaauuccacccaugagauguacuggguuucuaacgccagcggaaauauuguguccucugugaacaugaucagccgcaugcucauuaaccgguuuacaaugagacacaagaaggcuaccuaugaaccugacgucgaccuuggcuccgggacgcgcaauaucggaauugagucugaggugcccaaccuggauaucaucggcaaacggauugaaaagaucaaacaggagcaugaaaccagcuggcacuacgaccaggaucacccguauaagacaugggccuaccauggcuccuaugagaccaaacagacagggagcgcgucuuccaugguuaauggaguggucagacugcucaccaagccuugggacgugcugcccacaguuacccaaauggccaugacggauacaaccccuuucggccagcagcgcguguuuaaggaaaaagucgacacccggacacaggagcccaaggaggggacgaagaaacuuaugaaaauuaccgcugaauggcuguggaaagagcucggcaagaagaagacaccuagaauguguacccgcgaagaguucacaagaaaagugcggagcaacgccgcucugggcgccaucuuuaccgaugagaauaaguggaaaucugcucgcgaagccguggaggacuccagauucugggaacuggucgauaaggagcggaaccuccaccuggaagggaaaugcgagacauguguuuacaauaugaugggaaagagagagaagaaacuuggcgaauuuggcaaggcgaaagggagccgggccauuugguacauguggcugggagcucgcuuccucgaguuugaagcccugggcuuccuuaacgaggaccauugguuuucuagagaaaauucccugagcgggguggagggagagggccuccacaagcugggguauauccugcgggauguguccaaaaaggaaggcggagcuauguacgccgacgacaccgccggcugggauacgcgcaucacccucgaggaccugaagaacgaagagauggucacaaaucacauggaaggggagcauaagaaacuugcggaggcuauuuucaaacugaccuaucaaaacaaagugguuagagugcagcggcccacaccgcgcggaaccgucauggauaucauuagcagacgggaccagcgcggcucugggcaagugggaacguacggccucaauacauuuaccaacauggaagcccagcugaucagacagauggagggggaaggcguuuucaaaaauauucagcaccuuacagugaccgaggaggucgccgugcaaaacuggcuggcucggguuggacgcgaaagacucagccggauggccaucuccggcgaugacugcguggucaagccucuggaugaccgcuucgcuaacgcccugacggcgcucaaugauauggggaagaucagaaaagacauucagcagugggagcccucuaagggauggaacgauuggacccaggugcccuuuugcagccaucacuuccaugaacugaucaugaaagacggccggguccuugugguuccuuguagaaaucaagaugagcugauugggcgcgcccggaucucccagggagcuggcuggucucucagagaaacagccugccugggaaagagcuaugcucagauguggucccuuauguacuuucaccgccgggaccugagacucgccgcgaacgccauuuguucugcugugccgagccacuggguccccaccucccgcacaaccuggagcauccaugccaaacacgaguggaugacaaccgaggacaugcugacgguguggaaucggguguggauuagagaaaacccuuggauggaggauaagacacccguugaaucuugggaggaaaucccuuaucugggcaagcgcgaggaccaguggugcggaucccucaucggccugaccagccgggcuaccugggccaaaaauauucaagcugccaucaaccaggugagaucucuuauugggaaugaggaauacacagauuacaugcccuccaugaagcgcuuccggagagaggaagaggaagcgggaguccugugguga

SEQ ID NO: 19706 - RNA, 9876 nt, Artificial Sequence
  derived and/or modified CDS sequence (opt5) from DENV-2__FJ639708__SS-prME
agcgccggaaugaucauuaugcugauccccacagugauggcuuuccaccugacaacgagaaauggggagccucauaugauugucggaauccaggaaaagggcaaaucccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcaaggaaaucaaagugaccccucaguccagcaucacagaggcggaacugaccggguauggaacgguuaccauggaguguucucccagaacaggccuugauuucaaugaaauggugcugcuccaaauggagaacaaggccuggcugguccaccggcagugguuucuugaccugccgcucccuuggcugcccggggcugauaagcaggaguccaauuggauucagaaagaaacccuggugacauucaagaacccucaugccaaaaagcaagacguugugguccucggaagccaggagggcgcuaugcacaccgcccugacgggggccacagaaauccagauguccucuggcaaucuucuguuuaccggacaucucaaaugccgccugagaauggacaaacuucaacugaagggcaugagcuacuccauguguacagggaaauucaagguggucaaagagauugcugagacccagcacggaaccaucgugauucggguucaguaugaaggcgaugggagccccugcaagauccccuucgagaucauggaccucgagaagcgguacauucugggacgccugaucacagugaacccuauugucacggagaaggauucuccggugaacaucgaagcggagcccccuuuuggcgacuccuacauuaucauugggguugagcccggccagcucaagcugaauugguucaaaaagggaagcucuaucggccaaauguuugaaaccacaaugagaggggccaaaagaauggcuauccuuggagauaccgccugggacuucggcagccucgggggaguguuuacauccauuggcaaggcccuccaucaggucuucggggcuaucuauggcgccgcguuuucuggagugagcuggaccaugaaaauucugaucggcgugauuaucacguggaucgggaugaacucccgcagcacaucucuguccguuagccuuguccucgugggaauugugacccuguaccugggcgucauggugcaggcugauucuggguguguuguguccuggaagaauaaggagcucaaaugcggaagcggcaucuucauuaccgacaacguccacacauggaccgaacaguauaaguuucaaccugagucccccucuaaacuggccagcgccauccagaaggcucaggaagaggggauuuguggcauccgguccgugacaagacuugagaaucugauguggaaacagaucacgccggaacucaaccacauucuggccgagaaugaaguuaagcugaccaucaugacaggagauauuaaaggcaucaugcaagcugggaagcgcucucuucggccucagcccaccgagcucaaguacagcuggaaaacauggggaaaggccaaaaugcuguccaccgaaagcuauaaccagacguuccugauugacggcccugagaccgcggagugccccaauacaaacagagccuggaacucucucgaaguggaggauuacggguuuggagucuucaccacaaacaucuggcugaaacuuaaagaaaagcaggacgcuuuuugugacuccaagcugaugagcgccgcuaucaaagauaaucgcgccgugcaugcggacaugggcuauuggauugagucugcccucaacgauaccuggaagaucgagaaggcuagcuucauugaaguuaagaauugccacuggccuaaaagccauacacuguggucuaacggcgugcuggagagcgaaaugaucauucccaagaaccuugccgggccggucucccaacacaauuaccggccuggauaccacacccagaucgcuggccccuggcaucucgggaagcuggagauggacuucgauuuuugugacggaacgacagugauugugaccgaagauugcggcaacagagggcccagccugcgcaccacaaccgccucuggaaaacucaucacggaguggugcugucgguccugcacacugccuccgcuuagauaucggggcgaggacggcuguugguacgggauggaaauccgcccccugaaggagaaagaagagaaucucgucaacagccugguuaccgccggacacggccagguggauaauuucucccugggggugcuuggaauggcucucuuucuggaagagaugcugagaacacgggucggcaccaagcaugcgauucuccugguggccguuucuuucaugacacuuaucaccgggaacaugagcuuuaaagaccugggaagaguggucgugaugguuggcgcuacgauggccgaugacauuggcaugggggugaccuaucucgcccugcuggcugccuucaagguccgcccuacauuugcggcuggacuucugcuccggaagcugaccuccaaagagcucaugaugacaaccaucggcauugugcugcuuucucaaagcacgauccccgaaacaguucuggagcucaccgaugcccuggcccuggggaugauggugcuuaagaucgucagaaauauggaaaaauaccagcuggcugugacaauuauggccauccucugcgugccuaacgcggucauucugcagaaugcuuggaagguuuccuguaccauccucgccguggugucugucagcccccugcuucugaccuccagccagcagaagacagacuggauuccucucgcccugacgaucaagggacugaaccccaccgcuaucuuccuuacaacccugucucgcacaaauaaaaagagauccuggccgcucaacgaggccauuauggcugugggcaugguuagcauccuggccucuucccuccugaagaaugacauuccuaugaccgggccccuuguggcgggaggccugcugacggucugcuaugugcucacaggccggagcgccgaucuggaacuugagcgcgcuaccgacguuaaaugggaggaucaggccgaaaucucuggguccagcccuauucuguccaucaccauuagcgaggacggaucuaugagcaucaagaacgaagaggaggaacagacacucaccauccugauuagaacaggccuccuggugaucuccgggcuuuuucccauuucuaucccgauuacggcugccgccugguaccugugggaggucaaaaagcagcgggcuggagugcugugggaugucccuucucccccucccaugggcaaagcggaacucgaggacggggccuaucgcaucaagcaaaagggaauccugggcuacucccagauuggcgcugggguguacaaagaaggaaccuuccacacaauguggcauguuaccagaggcgccgugcuuaugcacaaggggaaacggaucgagcccuccugggccgaugucaagaaagaccugauuagcuauggaggcggguggaagcucgagggagaauggaaggagggcgaagaggugcagguucuggcucucgaaccuggcaaaaauccgcgcgccgugcagacaaagcccgggcuguuuaaaaccaacacgggaaccaucggcgcggucucccuugauuucucuccugggacaagcggaucccccauuaucgacaagaaaggcaaggugguggggcuguacggaaacggcguugucaccagaagcggcgcuuaugugucugccaucgcccaaacagagaaguccauugaggauaauccugaaaucgaggacgauauuuuucggaaacgcagacugaccaucauggaccuccaccccggggcuggaaagacaaaacgguaccugccugccauugugagagaagcgaucaagcgcggccuucggacgcugauucucgcuccgaccagagucguggccgccgagauggaagaggcucugcgcgggcuccccauccgguaucagaccccugccaucagagcugagcauaccggacgcgaaauuguugaccugaugugucacgccaccuucacaaugcggcuucugagccccgugagagucccuaacuacaaucugaucauuauggaugaggcgcauuucacggaccccgccucuaucgcugcccgcggcuauauuuccacccggguggaaaugggggaggcugccggcaucuuuaugacagccaccccgccuggaagcagagaucccuucccccaguccaacgcuccuaucauugacgaggaacgggagauccccgaacgcucuuggaauagcggccacgaguggguuacagauuuuaaagggaagaccgugugguucgucccuuccauuaaggcgggaaacgacaucgccgcuugccuccgcaaaaauggcaagaaagugauucaacugagccggaagacguuugauucugaauacguuaaaacacgcaccaacgacugggauuucguggucaccacagacaucuccgagaugggggccaauuuuaaggccgagagagugaucgauccgcggagauguaugaaacccgugauucuuaccgacggagaggaacgcgucauccuggcuggcccuaugcccguuacacauagcucugccgcgcagcggagagggcgcauuggccggaacccuaagaaugaaaacgaccaguacaucuauaugggagagccccucgaaaaugaugaggacugcgcucacuggaaggaggccaaaaugcugcuggauaacauuaauaccccggaaggcaucauuccuagcauguucgagcccgaaagagagaagguggacgccaucgauggggaauaccgccuccggggagaggcuagaaaaacguuuguggaccuuaugcgcagaggcgaucugccugucuggcuggccuauaagguggcggccgaggggaucaacuacgcugaccggcgcugguguuucgauggaauuaaaaacaaucagauccucgaagagaacguugaaguggagauuuggacaaaggagggcgaaagaaagaaacugaagccccgguggcuugacgcccgcaucuauuccgauccucuggcucucaaagaguuuaaggaguucgccgcugggagaaaaucucugacccugaaucucauuacagagaugggccggcuucccaccuucaugacgcaaaagaccagagacgcccuggauaaccuggcgguccuccacacagccgaagcuggaggccgcgccuacaaucaugcucugagcgagcuuccggagacccuggaaacacuccugcugcucacccuucuggccacagugaccgggggaaucuuucuguuccucauguccggccgggggaucggaaagaugacgcugggcaugugcugcauuaucacagccucuauucuucugugguaugcucagauccagccucacuggauugcggccagcaucauccucgaguuuuuccugauuguucugcucauccccgaacccgagaaacagagaaccccucaagacaaccagcuuaccuacguggucauugcuauccugacaguggucgccgccaccauggcuaaugaaaugggcuuucuggagaagaccaagaaggaccucgggcugggauccauugccacgcagcagccggagagcaacauccuugauauugaccugcgccccgcgucugccuggacccucuacgcuguggccacaaccuucguuacaccuaugcugcggcauuccaucgaaaauagcuccgugaacgugucucugaccgcuaucgccaaucaagcgacgguccucaugggccuugggaaaggauggccccugagcaagauggauauuggcguuccucugcucgccaucggguguuauucccaggugaaccccauuacccugacagcugcccuucugcuccugguggcucacuacgccaucauuggaccuggccugcaggcuaaggccaccagagaggcgcagaaacgggccgcugccggcaucaugaagaauccgacagucgacgggaucaccgugauugaucucgaccccaucccuuaugaucccaaauuugaaaagcaacuuggacagguuaugcugcugauucucugcgugacgcagguccugaugaugcgcacaaccugggcucuuugugaggcccugacacucgccaccggcccuaucucuacccugugggaagggaaccccggaagauucuggaauacaacgauugcggugagcauggcuaacaucuuucggggcuccuaccuggccggggcuggacuccuuuucagcaucaugaaaaauaccacaaacacccgcagaggcacaggcaacauuggggagacccugggagagaaguggaaaucucggcugaaugcccucggcaaguccgaauuucaaaucuauaagaaaagcgggauucaggaggucgaccgcacgcuggccaaggaaggaaucaaaagaggcgagacagaucaccaugcugugucucggggguccgccaaacuucgcugguucguugagagaaacauggugaccccggaaggaaaagucguggaccugggcugcggcagagggggauggagcuacuauuguggcgggcucaagaauguucgggaggugaagggacugaccaaaggcgggccuggacacgaagaacccauucccaugucuacauacggcuggaaccugguccgccuccagagcggcguggauguguuuuucaucccucccgaaaagugcgacacccuucugugugauaucggggaguccucuccuaauccgacaguugaggcgggacggacgcugagaguccucaaccugguggaaaauuggcuuaacaauaacacccaguucugcauuaaagugcugaaucccuacaugccuagcgucaucgagaagauggaagcccuccaacgcaaauauggcggggcucugguucggaacccccuguccagaaauagcacacaugagauguacuggguguccaacgccucuggaaauauugugagcuccgucaacaugaucucucgcaugcucauuaaccgguuuaccaugagacacaagaaggcuacauaugaaccugacguggaccuuggcagcgggacccgcaauaucggaauugaguccgagguucccaaccuggauaucaucggcaaacggauugaaaagaucaaacaggagcaugaaacgucuuggcacuacgaccaggaucacccguauaagaccugggccuaccauggcagcuaugagacaaaacagaccggguccgcgagcucuauggugaauggagucgugagacugcucacaaagccuugggacguucugcccaccgugacacaaauggccaugaccgauacgacaccuuucggccagcagcgcgucuuuaaggaaaaaguggacacccggacccaggagcccaaggaggggaccaagaaacuuaugaaaauuacggcugaauggcuguggaaggagcucggcaaaaagaagaccccuagaauguguacacgcgaagaguucaccagaaaagugcgguccaacgccgcucugggcgccaucuuuacagaugagaauaaguggaaaagcgcucgcgaagccgucgaggacucuagauucugggaacugguugauaaggagcggaaccuccaccuggaagggaaaugcgagaccuguguguacaauaugaugggaaagagagagaagaaacuuggcgaauuuggcaaggcgaaagggucccgggccauuugguacauguggcugggagcucgcuuccucgaguuugaagcccugggcuuccuuaacgaggaccauugguuuagcagagaaaauucucuguccgggguggagggagagggccuccacaagcugggguauauccugcgggaugucagcaaaaaggaaggcggagcuauguacgccgacgacacagccggcugggauacccgcaucacgcucgaggaccugaagaacgaagagauggugaccaaucacauggaaggggagcauaagaaacuugcggaggcuauuuucaaacugacauaucaaaacaaaguugugagaguccagcggcccaccccgcgcggaacagugauggauaucauuuccagacgggaccagcgcggcagcgggcaaguuggaaccuacggccucaauacguuuacaaacauggaagcccagcugaucagacagauggagggggaaggcguguucaaaaauauucagcaccuuaccgucacagaggagguggccguucaaaacuggcuggcucgggugggacgcgaaagacucucucggauggccaucagcggcgaugacugcgucgugaagccucuggaugaccgcuucgcuaacgcccugaccgcgcucaaugauauggggaagaucagaaaagacauucagcagugggagcccuccaagggauggaacgauuggacgcagguccccuuuugcucucaucacuuccaugaacugaucaugaaagacggccgggugcuuguugugccuuguagaaaucaagaugagcugauugggcgcgcccggaucagccagggagcuggcuggucccucagagaaaccgccugccuggggaagucuuaugcucagauguggagccuuauguacuuucaccgccgggaccugagacucgccgcgaacgccauuuguuccgcugucccgucucacugggugcccacaagccgcaccacaugguccauccaugccaaacacgaguggaugaccacagaggacaugcugaccguguggaaucggguuuggauuagagaaaacccuuggauggaggauaagacgcccguggaaagcugggaggaaaucccuuaucugggcaagcgcgaggaccaguggugcggaucucucaucggccugacaucccgggcuaccugggccaaaaauauucaagcugccaucaaccaggucagaagccuuauugggaaugaggaauacaccgauuacaugcccucuaugaagcgcuuccggagagaggaagaggaagcgggagugcugugguga

SEQ ID NO: 19707 - RNA, 9876 nt, Artificial Sequence
  derived and/or modified CDS sequence (opt5) from DENV-2__FJ639709__SS-prME
agcgccggaaugaucauuaugcugauccccaccgugauggcuuuccaccucacaacgagaaacggggagccucauaugauugucgggauccaggaaaagggaaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcagggauccaauuggauucagaaagagacccuggucacauucaagaacccucaugcuaaaaagcaagacgugguugugcucggcagccaggaaggggccaugcacaccgcccugacgggcgcuacagagauccagauguccucuggaaaucuucuguuuaccggccaucucaaaugccgccugagaauggacaaacuucaacugaaggggaugagcuacuccauguguacaggaaaauucaaggucgugaaagaaauugcggagacccagcacggcaccaucgucauucgggugcaguaugagggggauggaagccccugcaagauccccuucgaaaucauggaccucgagaaaagauacguucugggccgccugauuacagugaacccuaucgucacggaaaaggauucuccggugaacauugaggccgaacccccuuuuggggacuccuacaucauuaucggcguugagcccggacagcucaagcugaauugguucaaaaagggcagcucuauugggcaaauguuugagaccacaaugcggggagcuaaaagaauggccauccuuggcgauaccgccugggacuucgggagccugggaggcguguuuacauccaucgggaaggcucuccaucaggucuucggcgccauuuauggagcggcuuuuucuggcgugagcuggaccaugaaaauccugauuggggugaucauuacguggaucggaaugaacucccgcagcacaucucuguccguuagccuuguccucgugggcaucgugacccuguaccugggggucauggugcaggccgauucuggauguguuguguccuggaagaauaaggaacucaaaugcggcagcgggauuuucaucaccgacaacguccacacauggaccgagcaguauaaguuucaaccugaaucccccucuaaacuggccagcgcuauucagaaggcccaggaggaaggcaucuguggcauucgguccgugacaagacuugagaaucugauguggaaacagaucacgccggagcucaaccacauccuggcugaaaaugagguuaagcugaccauuaugacaggcgauaucaaagggauuaugcaagccggaaagcgcucucuucggccucagcccaccgaacucaaguacagcuggaaaacauggggcaaggcgaaaaugcuguccaccgagagccauaaccagacguuccugaucgacgggccugaaaccgccgagugccccaauacaaacagagcuuggaacucucucgagguggaagauuauggauuuggcgucuucaccacaaacauuuggcugaaacuuaaagagaagcaggacgccuuuugugacuccaagcugaugagcgcugccaucaaagauaaucgcgcggugcacgccgacaugggcuacuggaucgaaucugcucucaacgauaccuggaagauugagaaagccuccuucaucgagguuaagaauugccauuggccuaaaagccacacacuguggucuaacggggugcuggaaagcgagaugauuauccccaagaaccuugcuggaccggucucccaacacaauuaucggccuggcuaccauacccagauugccgggcccuggcaccucggaaagcuggaaauggacuucgauuuuugugacggcacgacagugaucgugaccgaggauugcgggaacagaggacccagccugcgcaccacaaccgccucuggcaaacucauuacggaauggugcugucgguccugcacacugccuccgcuuagauaccggggcgaggacggguguugguauggaauggagauccgcccccugaaggaaaaagaggaaaaucucgucaacagccugguuaccgcuggccauggacagguggauaauuucucccugggagugcuuggcauggcgcucuuucuggaggaaaugcugagaacacgggucgggaccaagcacgccauccuccugguggcuguuucuuucgugacacuuauuaccggaaacaugagcuuuaaagaccugggcagagucgugguuauggugggcgccacgaugaccgaugacaucgggaugggagucacauaccucgcccugcuggcugccuucaaggugcgcccuaccuuugcggcuggccuucugcuccggaagcugacauccaaagagcucaugaugaccacgauugggaucguucugcuuucucaaacaaccauucccgagacaauccuggaacucaccgaugcccuggcccugggaaugauggugcuuaagaucgucagagacauggagaaauaucagcuggcugugaccauuauggccauccucugcgugccuaaugcggucauucugcagaacgcuuggaagguuagcuguacaauccucgccgugguguccgucucuccccugcuucugacgagcucccagcagaagaccgacuggauuccucucgcccugacaaucaagggccugaaucccaccgcuaucuuccuuacaacccugagccgcacgaacaaaaagagaucuuggccgcucaaugaagccauuauggcuguggggaugguuuccauccuggccagcucucuccugaagaacgauauuccuaugacaggaccccuuguggcgggcggccugcugaccgucugcuacgugcucaccgggcgguccgccgaccuggagcuugaacgcgcuacagauguuaaaugggaggaccaggccgagaucagcggaucuuccccuauucugagcaucaccauuuccgaagauggcagcaugucuaucaagaaugaggaagaggagcagacacucacgauccugauuagaaccgggcuccuggugaucagcggacuuuuucccgucuccauuccgaucacagcugccgccugguaucugugggaagugaaaaagcagcgggcuggcguccugugggacgugccuucucccccucccauggggaaagcggagcucgaagauggagccuaccgcauuaagcaaaagggcauccugggcuauagccagaucggggcuggaguuuacaaagagggcaccuuccauacaauguggcacgugaccagaggggccguccuuaugcacaagggaaaacggauugaacccuccugggccgacgugaagaaagaucugaucucuuacggcgggggauggaagcucgagggcgaguggaaggaaggcgaggaaguucaggugcuggcucucgagccugggaaaaacccgcgcgccguccagacgaagcccggacuguuuaaaaccaauacaggcaccauuggggcggugagccuugacuucuccccuggaacaucuggcagccccaucauugauaagaaagggaaggugguuggacuguauggcaacggcgucgugaccagauccggggcuuacgugagcgccaucgcccaaacagaaaagucuaucgaggacaacccugagauugaagaugacaucuuucggaaacgcagacugacgauuauggaccuccaucccggagcuggcaagaccaaacgguaucugccugccaucgucagagaggcgauuaagcgcgggcuucggacacugauccucgcuccgaccagagugguugccgccgaaauggaggaagcucugcgcggacuccccauucgguaccagaccccugccaucagagcugagcacacaggccgcgagaucguggaucugaugugucaugccacguucaccaugcggcuucugucccccgucagagugccuaauuauaaccugauuaucauggacgaagcgcacuucacagaucccgccagcauugcugcccgcggguacaucucuacccggguugagaugggcgaagcugccggaauuuuuaugacagccaccccgccuggcuccagagaccccuucccccagagcaaugcuccuaucaucgaugaggagcgggaaauucccgagcgcuccuggaacucugggcaugaaugggugacggacuuuaaaggaaagacagucugguucgugccuagcaucaaggcgggcaaugauauugccgcuugccuccgcaagaaugggaagaaaguuauccaacugucccggaagaccuuugacagcgaguaugugaaaacccgcacaaaugauugggacuucgucgugaccacagauauuucugaaaugggagccaacuuuaaggccgagagagugaucgacccgcggagauguaugaaacccgucauccuuaccgacggcgaggaacgcguuauucuggcugggccuaugcccgugacgcacuccagcgccgcgcagcggagaggccgcaucggacggaauccuaagaacgagaaugaucaguacauuuacaugggcgaaccccucgagaacgacgaagauugcgcucacuggaaggaggccaaaaugcugcuggacaauaucaacacaccggaggggauuaucccuucuauguucgaacccgagagagaaaagguggaugccauugacggagaguaucgccuccggggcgaagcuagaaaaaccuuugucgaucuuaugcgcagaggggaccugccuguguggcuggccuacaagguugcggccgagggaaucaauuaugcugaucggcgcugguguuucgacggcaucaaaaacaaccagauucucgaggaaaauguggaggucgaaaucuggacaaaggagggggagagaaagaaacugaagccccgguggcuugaugcccgcauuuacagcgacccucuggcucucaaagaauuuaaggaguucgccgcuggcagaaaaucccugacccugaaccucaucacggaaaugggacggcuucccaccuucaugacacaaaagaccagagaugcccuggacaaucuggcggugcuccauacagccgaggcuggcgggcgcgccuauaaccacgcucugucugaacuuccggagacccuggagacacuccugcugcucacccuucuggccacgguuacaggaggcauuuuucuguuccucaugagcgggcggggaaucggcaagaugacccugggcaugugcugcaucauuaccgccuccauccuucuguggaaugcucagauucagccucauuggaucgcggccucuauuauccucgaauuuuuccugaucgugcugcucauucccgagcccgaaaaacagagaacaccucaagacaaccagcuuaccuacgucgugaucgcuauucugacagucguggccgccacgauggcuaaugagaugggguuucuggaaaagaccaaaaaggaucucggacugggcagcaucgccacacagcagccggaguccaacauucuugacaucgaucugcgccccgcgagcgccuggacccucuaugcuguugccacaaccuucgugacgccuaugcugcggcacucuauugaaaauuccagcgugaacgucucccugaccgcuaucgccaaucaagcgacaguucucauggggcuuggaaaaggcuggccccugucuaagauggacaucggggugccucugcucgccauuggauguuacagccaggugaaccccaucacccugacagcugcccuucugcuccuggucgcucacuacgccauuaucggcccuggccugcaggcuaaggccaccagagaagcgcagaaacgggccgcugccgggauuaugaagaauccgacgguggauggaaucacaguuaucgaccucgaucccauuccuuaugaccccaaauuugagaagcaacuuggccaggugaugcugcugauccucugcgucacccaggugcugaugaugcgcacaaccugggcucuuugugaagcccugacccucgccacagggccuauuuccacgcugugggagggaaaccccggcagauucuggaauaccacaaucgcggucucuauggcuaacauuuuucgggggagcuaccuggccggagcuggccuccuuuucuccaucaugaaaaauaccacaaacacccgcagaggcacggggaacaucggagaaacacugggcgagaaguggaaaagccggcugaaugcccucgggaagucugaguuucaaaccuauaagaaauccggcauucaggaaguggaucgcacccuggccaaggagggcaucaaaagaggggaaacagaccaucacgcuguuagccggggaucugccaaacuucgcugguucguggagagaaacauggucaccccggagggcaaagugguugaucugggcugcgggcggggaggcugguccuacuauugugggggacucaagaaugugagagaagucaagggccugacaaaagggggaccuggccaugaggaacccauucccaugagcacguacggcuggaaccuggugcgccuccagucugggguggacgucuuuuucaucccucccgagaagugcgauacccuucugugugacauuggagaaagcuccccuaauccgacagucgaggcgggccggacccugagagugcucaaccugguggagaauuggcuuaacaauaacacacaguucugcaucaaaguccugaaucccuauaugccuucuguuaucgaaaagauggaggcccuccaacgcaaauacgggggagcucuggugcggaacccccugagcagaaauuccacccacgaaauguacugggugagcaacgccuccggcaauauugucucuagcgugaacaugaucucccgcaugcucauuaaccgguuuacgaugagacauaagaaggcuaccuaugagccugacguugaucuugggucuggaacacgcaauaucggcauugaaagcgagauccccaaccuggacauuaucggcaaacggaucgagaagauuaaacaggaacacgagaccuccuggcacuacgaucaggaccauccguauaagacaugggccuaccacgggucuuaugaaaccaaacagacaggaagcgcguccagcauggugaauggcgucgugagacugcucaccaagccuugggauguucugcccacggugacacaaauggccaugaccgacaccacaccuuucgggcagcagcgcgucuuuaaggagaaaguggauacgcggacccaggaacccaaggagggaaccaagaaacuuaugaaaaucaccgcugaguggcuguggaaggaacucggcaaaaagaagacaccuagaauguguacccgcgaggaguucacaagaaaagugcggucuaacgccgcucugggggccauuuuuaccgacgagaauaaguggaaauccgcucgcgaggccgucgaagauagcagauucugggagcugguugacaaggaacggaaccuccaucuggagggaaaaugcgaaacguguguguacaauaugaugggcaagagagagaagaaacuuggcgaguuugggaaggcgaaaggaucucgggccaucugguauauguggcugggcgcucgcuuccucgaauuugaggcccugggguuccuuaacgaagaucacugguuuuccagagagaauagccugucuggaguggaaggcgaggggcuccacaagcugggcuacauucugcgggacgucuccaaaaaggagggaggcgcuauguacgccgacgauaccgccgggugggacacacgcaucacccucgaagaucugaagaacgaggaaauggugacaaaucauauggagggagaacacaagaaacuugcggaggcuaucuucaaacugaccuaucaaaacaaaguugugagaguccagcggcccacgccgcgcggcacagugauggacauuaucagcagacgggaucagcgcggguccggacaaguuggcaccuacgggcucaauacauuuaccaacauggaggcccagcugauuagacagauggaaggcgagggaguguucaaaaauauccagcaucuuacggccaccgaagaggucgcugugcaaaacuggcuggcccggguuggccgcgagagacucagccggauggcuauuucuggggacgauugcguggucaagccucuggacgaucgcuucgccaacgcgcugacagcccucaaugacaugggaaagaucagaaaagauauccagcagugggaacccagcaagggcuggaacgacuggacccaggugcccuuuugcucccaccauuuccacgagcugauuaugaaagaugggcggguccuugugguuccuuguagaaaucaagacgaacugaucggacgcgcucggauuucucagggcgccggguggagccucagagagacagcuugccugggcaaguccuaugcccagauguggucucuuauguacuuucaccgccgggaccugagacucgcggccaacgcuaucuguagcgccgugccgucccauuggguccccaccucucgcacaaccuggagcauucacgcuaaacaugaauggaugacgacagaggauaugcugaccguguggaaucggguguggaucagagagaacccuuggauggaagacaagacccccguugaguccugggaagagauuccuuaucugggaaagcgcgaagaucaguggugcggcagccucaucgggcugacaucucgggccaccugggcuaaaaauauccaagccgcgauuaaccaggugagaucccuuaucggaaaugaggaguacacagacuauaugcccagcaugaagcgcuuccggagagaagaggaagaggccggcguccugugguga

SEQ ID NO: 19708 - RNA, 9876 nt, Artificial Sequence
  derived and/or modified CDS sequence (opt5) from DENV-2__FJ639710__SS-prME
agcgcuggcaugaucauuaugcugauccccaccgugauggcuuuccaccucacaacgagaaauggggagccucauaugauugucgggauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaaggggccauugugaccugcgcgauguuuacaugcaagaaaaacauggaaggaaagaucguccagccugagaaucucgaauacacgauuguugugacaccccacucuggcgaggagcaugccguggggaacgacacaggaaaacacggcaaggaaaucaaagucaccccucaguccagcaucacagaggcugaacugaccggcuaugggacggugaccauggaguguucucccagaacaggacuugauuucaaugaaaugguucugcuccaaauggagaacaaggccuggcuggugcaccggcagugguuucuugaccugccgcucccuuggcugcccggcgcugauaagcaggaguccaauuggauucagaaagaaacccuggucacauucaagaacccucaugccaaaaagcaagacgugguugugcucgggagccaggagggagccaugcacaccgcucugacgggcgcgacagaaauccagauguccucugggaaucuucuguuuaccggccaucucaaaugccgccugagaauggacaaacuucaacugaagggaaugagcuacuccauguguacaggcaaauucaaggucgugaaagagauugccgagacccagcacgggaccaucgucauucgggugcaguaugaaggagauggcagccccugcaagauccccuucgagaucauggaccucgagaagagauacguucuggggcgccugauuacagugaacccuaucgucacggagaaggauucuccggugaacauugaagcugagcccccuuuuggagacuccuacaucauuaucggcguugagcccgggcagcucaagcugaauugguucaaaaagggcagcucuauuggacaaauguuugaaaccacaaugcggggcgccaaaagaauggccauccuuggggauaccgcuugggacuucggaagccugggcgggguguuuacauccaucggaaaggcccuccaucaggucuucggcgcgauuuauggggcugccuuuucuggcgugagcuggaccaugaaaauccugauuggagugaucauuacguggaucggcaugaacucccgcagcacaucucuguccguuagccuuauccucgucgggauugugacccuguaccugggagugaugguccaggccgauucuggcugugugguuuccuggaagaauaaggagcucaaaugcgggagcggaaucuucauuaccgacaacgugcacacauggaccgaacaguauaaguuucaaccugagucccccucuaaacuggcuagcgccauccagaaggcucaggaagagggcauuugugggauccgguccgucacaagacuugagaaucugauguggaaacagaucacgccggaacucaaccacauucuggccgagaaugaagugaagcugaccaucaugacaggcgauauuaaaggaaucaugcaagcgggccgccggucucuuagaccucagcccaccgagcucaaguacagcuggaagacaugggggaaagccaagaugcuguccaccgaaagcuauaaccagacguuccugauugacggaccugagaccacagagugccccaauaccaaccgcgcuuggaacucucucgaaguugaggauuacggcuuugggguguucacaaccaacaucuggcugaaacuuaaggaaaaacaggacgccuuuugugacuccaagcugaugagcgcugccaucaaggauaaucgggcgguccaugccgacaugggauauuggauugagucugcucucaacgauacauggaaaaucgagaaggccuccuucauugaagugaaaaauugccacuggccuaagagccauacccuguggucuaacggcguucuggagagcgaaaugaucauucccaaaaaccuugcuggcccggugucccaacacaauuacagaccuggguaccacacgcagaucgccggacccuggcaucucggcaagcuggagauggacuucgauuuuugugacgggacaaccgucauugugaccgaagauugcggaaaccgcggccccagccugcggacaaccacggccucugggaagcucaucacagaguggugcuguagauccugcacccugccuccgcuucgguaucgcggagaggacggcuguugguacggcauggaaaucagaccccugaaagagaaggaagagaaucucgugaacagccuggucacagcugggcacggacagguugauaauuucucccugggcgugcuugggauggcgcucuuucuggaagagaugcugcggaccagagugggaacaaaacaugccauucuccuggucgcugugucuuucguuacccuuaucacgggcaacaugagcuuuaaggaccuggggcgcguggucgugaugguuggagccaccauggccgaugacauuggcaugggcgugacauaucucgcucugcuggccgcguucaaaguccggccuaccuuugcugccgggcuucugcucagaaagcugacauccaaggagcucaugaugaccacgaucggaauugugcugcuuucucaaagcacaauccccgaaaccauccuggagcucacagaugcccuggcucugggcaugaugguucuuaaaauugugcgcaauauggaaaaguaccagcuggccgucaccaucauggcgauucucugcgugccuaacgcugugauccugcagaaugccuggaaagucuccuguaccauucucgccguugugucugugagcccccugcuucugacauccagccagcaaaagacggacuggaucccucucgcucugaccaucaaagggcugaaccccacagccauuuuccuuaccacacugucuagaaccaauaagaaacgguccuggccgcucaacgaggcuaucauggccgucggaauggugagcauucuggcgucuucccuccugaagaaugacaucccuaugacgggcccccuuguugccgggggacugcugacagugugcuauguccucaccggccgcagcgcugaucuggaacuugagagagccaccgacgugaagugggaggaacaggcugagauuucuggcuccagcccuauccuguccauuacaaucagcgaagaugggucuaugagcaucaaaaacgaggaggaggaacagacccucacaauucugauccggacgggacuccugguuauuuccggccuuuuucccaucucuauuccgaucaccgccgccgcuugguaccugugggaagugaagaaacagcgcgcggggguccugugggacgugccuucucccccucccaugggaaaggccgagcucgaagauggcgcuuauagaaucaaacaaaaggggauucugggauacucccagaucggcgccggcgucuacaaggaggggacauuccacaccauguggcaugugacacggggagccguucuuaugcacaaaggcaagcgcauugagcccuccugggcugacgugaaaaaggaucugaucagcuaugggggaggcuggaaacucgaaggggaguggaaggaaggagaggaaguccaggugcuggcccucgagccuggcaagaauccgagagcgguucagaccaaacccggccuguuuaagacgaacaccgggacaauuggagcugugucccuugacuucucuccuggcaccagcgggucccccaucaucgauaaaaagggaaaagucgugggccuguacgggaacggagugguuacacggagcggcgccuaugucucugccauugcucaaaccgagaaguccaucgaagacaauccugagauugaagaugacaucuuucgcaagagacggcugacaauuauggaucuccaccccggcgccgggaaaacgaagagauaccugccugcgaucgugcgcgaggcuauuaaacggggacuuagaacccugauccucgccccgacacgcguggucgccgcugaaauggaggaggcccugcggggccuccccaucagauaucagaccccugcuauucgcgccgaacauaccgggcgggagaucguggaccugaugugucacgcgacauucacgaugagacuucugagccccguucgcgugccuaacuacaaucugauuaucauggacgaagcccauuucaccgaucccgcuucuauugccgcucggggauauaucuccacaagagucgagaugggcgaggccgccgggaucuuuaugaccgcuacaccgccuggcagccgggaccccuucccccaguccaacgcgccuauuaucgaugaggaacgcgaaauucccgagagaucuuggaauagcggacacgaauggaucaccgacuuuaagggcaaaacggugugguucguuccuuccauuaaggccgggaacgauaucgcugccugccuccggaagaauggcaagaaggugauccaacugagccgcaaaacauuugacucugaguacgucaagaccagaaccaacgauugggacuucgugguuacaaccgauauuuccgagaugggcgccaauuuuaaagcugaacgggugaucgacccgagacgcuguaugaagcccgucauucuuacagauggggaggaacgggugauccuggccggaccuaugcccgugacccauagcucugcggcucagagacgcggccggauugggagaaacccuaaaaaugagaacgaccaguacaucuauaugggcgaaccccucgagaaugacgaggauugcgcccacuggaaggaagccaagaugcugcuggacaacauuaauacgccggagggaaucaucccuagcauguucgaacccgagcgcgaaaaagucgaugcuauugacggcgaguaccggcucagaggggaggcccgcaagacauuuguugaucuuaugagacggggagaccugccuguguggcuggcguauaaaguggccgcugaaggcaucaacuacgccgaucgcagaugguguuucgacgggauuaagaacaaucagauccucgaggaaaacgucgagguggagauuuggaccaaagaaggagagcggaagaagcugaaaccccgcuggcuugaugcuagaaucuauuccgacccucuggcccucaaggaauuuaaagaguucgcugccggccggaagucucugacacugaaucucaucaccgaaauggggagacuucccacguucaugacccagaagacccgcgaugcgcuggacaaccuggccguucuccacaccgcugaggccggcggacgggcuuacaaucaugcccugagcgagcuuccggaaacacuggagacccuccugcugcucacacuucuggccaccgugacgggcgggauuuuucuguuccucauguccggaagaggcaucgggaagaugacacugggaaugugcugcauuaucaccgcuucuauucuucugugguaugcgcagauccagccucacuggaucgccgcuagcauuauccucgaauuuuuccugauuguccugcucauccccgagcccgaaaagcagcgcaccccucaagauaaccagcuuacauacgugguuauugccauccugaccguggucgccgcuacaauggccaaugagaugggcuuucuggagaaaacgaagaaagaccucggccugggguccauugcgacccagcagccggaaagcaacauccuugacaucgaucugcggcccgccucugcuuggacacucuacgccguggcuaccacauucauuaccccuaugcugagacauuccaucgagaauagcuccgucaacacgucucugaccgccauugcgaaucaagccacagugcucaugggacuuggcaagggguggccccugagcaaaauggacaucggaguuccucugcucgcuauuggcuguuauucccaggugaaccccaucacccugacagccgcccuucugcuccugguggcccacuacgcuaucauugggccuggacugcaggccaaggcgacccgggaagcccagaagcgcgcugccgcuggcaucaugaaaaauccgacggucgauggcauuacaguuaucgaccucgaucccauuccuuaugaccccaaguuugagaaacaacuuggacaggugaugcugcugauccucugcgugacccagguccugaugaugagaacaaccugggcccuuugugaagcccugacccucgcgacaggaccuaucucuacgcugugggagggcaaccccgggcgguucuggaauaccacaauugcugugagcauggccaacaucuuucgcggauccuaccuggcuggcgccgggcuccuuuucagcauuaugaagaauaccacaaacaccagacggggaacgggcaacaucggcgagacacugggggaaaaauggaagucucgccugaaugcccucggaaaauccgaguuucaaauuuauaaaaagagcggcauccaggaaguugauagaacccuggcuaaagaggggaucaagcggggagagaccgaccaccaugccgugucucgcggcuccgcgaaacuuagaugguucgucgaacggaacauggugacaccggaggggaaggucguggaucugggaugcggcagaggcggguggagcuacuauuguggaggccucaaaaauguuaaggaagugaaggggcugaccaaaggaggcccugggcacgaggaacccauucccaugucuacauacggauggaaccugguccgccuccagagcggcguggacgucuuuuucaucccucccgagaagugcgauacgcuucugugugacauuggcgaguccucuccuaauccgaccguggaagccgggcggacacugagaguccucaaccugguggagaauuggcuuaacaauaacacccaguucugcaucaaagugcugaaucccuacaugccuagcguuauugaaaagauggaggcucuccaacgcaaauauggaggcgcccugguccggaacccccuguccagaaauagcacacaugaaauguacuggguguccaacgcuucugggaauaucgugagcuccgucaacaugauuucucgcaugcucaucaaccgguuuaccaugagacacaagaaggccacguaugagccugauguugaccuuggaagcggcacccgcaauaucgggauugaguccgaagugcccaaccuggacaucauuggaaaacggaucgagaagauuaaacaggaacaugagacaucuuggcacuacgaucaggaccacccguauaagaccugggcguaccauggcagcuaugaaacaaaacagaccggcuccgccagcucuauggugaauggggucgugagacugcucacaaagccuugggauguucugcccaccgugacgcaaauggcuaugacagacaccaccccuuucggacagcagcgcgucuuuaaggagaaaguggauacacggacgcaggagcccaaggaaggcaccaagaaacuuaugaaaaucacagccgaguggcuguggaaagaacucgggaaaaagaagaccccuagaauguguacacgcgaggaguucaccagaaaaguucgguccaacgcugcccugggagcuaucuuuacagacgaaaauaaguggaaaagcgcccgcgaggcgguggaagauucuagauucugggagcuggucgacaaggaacggaaccuccaccuggagggcaaaugcgagaccuguguguacaauaugauggggaagagagaaaagaaacuuggagaguuuggcaaggccaaaggcucccgggcuauuugguacauguggcugggggcccgcuuccucgaauuugaggcucugggauuccuuaacgaagaucauugguuuagcagagaaaauucucuguccggcguggagggggaaggacuccacaagcugggcuauauccugcgggacgucagcaaaaaggaagggggagccauguacgccgaugacacggcgggaugggacacccgcauuacacucgaggaucugaagaacgaggaaaugguuaccaaucacauggagggcgagcauaagaaacuugcugaagccaucuucaaacugacauaucaaaacaaaguggugagaguccagcggcccaccccgcgcgggacggugauggacauuaucuccagacgggaucagcgcggaagcggccaaguugggacauacggacucaauaccuuuacaaacauggaggcccagcugaucagacagauggaaggcgaggggguguucaaaaauauucagcaccuuaccgucacggaggaaguggcuguucaaaacuggcuggcccgggugggccgcgagagacucucucggauggcuaucagcggagacgauugcgucgugaagccucuggacgaucgcuucgccaacgcgcugaccgcccucaaugacaugggcaagauuagaaaagauauccagcagugggaacccuccaagggguggaacgacuggacacagguucccuuuugcucucaucacuuccaugagcugauuaugaaagauggacgggugcuugucgugccuuguagaaaucaagacgaacugaucggccgcgcucggauuagccagggggccggauggucccucagagagaccgcuugccugggcaagucuuaugcccagauguggagccuuaucuacuuucaccgccgggaucugagacucgcggccaacgcuaucuguuccgccgucccgucucacugggugcccacaagccgcaccacaugguccauucaugcuaaacacgaguggaugaccacggaagacaugcugacaguuuggaaucggguguggaucagagagaacccuuggauggaagacaagacccccgucgagagcugggaagagauuccuuaucuggggaagcgcgaggaucaguggugcggcucucucaucggacugaccucccgggccacaugggcuaaaaauauucaagccgcgaucaaccaggugagaagccuuaucggcaaugaagaguacaccgacuacaugcccucuaugaagcgcuuccggagagaagaggaagaggccggggugcugugguga

SEQ ID NO: 19709 - RNA, 9876 nt, Artificial Sequence
  derived and/or modified CDS sequence (opt5) from DENV-2__GQ868623__SS-prME
agcgccggaaugaucauuaugcugauccccaccgugauggcuuuccaccucacaacgagaaacggggaaccucauaugauugucgggauccaggaaaagggcaaaagccugcuuuuuaagaccgaagacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaagaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggagaacaaggcuuggcuggugcaccggcagugguuucuugaccugccgcucccuuggcugcccggggccgauaagcagggauccaauuggauucagaaagagacccuggucacauucaagaacccucaugcuaaaaagcaagacgugguugugcucggcagccaggaaggggccaugcacaccgcccugacgggcgcuacagagauccagauguccucuggaaaucuucuguuuaccggccaucucaaaugccgccugagaauggacaaacuucaacugaaggggaugagcuacuccauguguacaggaaaauucaaggucgugaaagaaauugcggagacccagcacggcaccaucgucauucgggugcaguaugagggggauggaagccccugcaagauccccuucgaaaucauggaccucgagaaaagauacguucugggccgccugauuacagugaacccuaucgucacggaaaaggauucuccggugaacauugaggccgaacccccuuuuggggacuccuacaucauuaucggcguugagcccggacagcucaagcugaauugguucaaaaagggcagcucuauugggcaaauguuugagaccacaaugcggggagcuaaaagaauggccauccuuggcgauaccgccugggacuucgggagccugggaggcguguuuacauccaucgggaaggcucuccaucaggucuucggcgccauuuauggagcggcuuuuucuggcgugagcuggaccaugaaaauccugauuggggugaucauuacguggaucggaaugaacucccgcagcacaucucuguccguuagccuuguccucgugggcaucgugacccuguaccugggggucauggugcaggccgauucuggauguguuguguccuggaagaauaaggaacucaaaugcggcagcgggauuuucaucaccgacaacguccacacauggaccgagcaguauaaguuucaaccugaaucccccucuaaacuggccagcgcuauucagaaggcccaggaggaaggcaucuguggcauucgguccgugacaagacuugagaaucugauguggaaacagaucacgccggagcucaaccacauccuggcugaaaaugagguuaagcugaccauuaugacaggcgauaucaaagggauuaugcaagccggaaagcgcucucuucggccucagcccaccgaacucaaguacagcuggaaaacauggggcaaggcgaaaaugcuguccaccgagagccauaaccagacguuccugaucgacgggccugaaaccgccgagugccccaauacaaacagagcuuggaacucucucgagguggaagauuauggauuuggcgucuucaccacaaacauuuggcugaaacuuaaagagaagcaggacgccuuuugugacuccaagcugaugagcgcugccaucaaagauaaucgcgcggugcacgccgacaugggcuacuggaucgaaucugcucucaacgauaccuggaagauugagaaagccuccuucaucgagguuaagaauugccauuggccuaaaagccacacacuguggucuaacggggugcuggaaagcgagaugauuauccccaagaaccuugcuggaccggucucccaacacaauuaucggccuggcuaccauacccagauugccgggcccuggcaccucggaaagcuggaaauggacuucgauuuuugugacggcacgacagugaucgugaccgaggauugcgggaacagaggacccagccugcgcaccacaaccgccucuggcaaacucauuacggaauggugcugucgguccugcacacugccuccgcuuagauaccggggcgaggacggguguugguauggaauggagauccgcccccugaaggaaaaagaggaaaaucucgucaacagccugguuaccgcuggccauggacagguggauaauuucucccugggagugcuuggccucgcgcuguuucuggaggaaaugcucagaacacgggucgggaccaagcacgccauccugcuuguggcuguuucuuucgugacacugauuaccggaaacaugagcgucaaagaccucggcagagugguugugauggucggcgccacgaugaccgaugacaucgggaugggagugacauaccuggcccugcuugcugccuuuaagguucgcccuaccuucgcggcuggccugcuccugcggaagcucacauccaaagagcugaugaugaccacgauugggaucgugcuucugucucaaagcacaauucccgagaccauccucgaacugacagaugcccuggcccuuggaaugaugguccugaagaucgugagagacauggagaaauaucagcucgcugugaccauuauggccauccugugcgucccuaaugcgguuauucuccagaacgcuuggaagguguccuguaccauccuggccguggucucugugagcccccuucugcucacauccagccagcagaagacggacuggauuccucuggcccugaccaucaagggccuuaaucccacagcuaucuuucugaccacacucucucgcaccaacaaaaagagauccuggccgcugaaugaagccauuauggcuguugggauggugagcauccucgccucuucccugcuuaagaacgauauuccuaugacgggaccccuggucgcgggcggccugcucacagugugcuacguucugaccgggcggagcgccgaccuugagcuggaacgcgcuaccgaugugaaaugggaggaccaggccgagaucucuggauccagcccuauucucuccaucacaauuagcgaagauggcucuaugagcaucaagaaugaggaagaggagcagacccugacaauccucauuagaacggggcugcuugucaucuccggacuguuccccgugucuauuccgaucaccgcugccgccugguaucugugggaagucaaaaagcagcgggcuggcgugcucugggacguuccuucucccccucccauggggaaagcggagcuggaagauggagccuaccgcauuaagcaaaagggcauccuuggcuauucccagaucggggcuggaguguacaaagagggcacauuucauaccauguggcacgucacaagaggggccgugcugaugcacaagggaaaacggauugaacccuccugggccgacguuaagaaagaucucaucagcuacggcgggggauggaagcuggagggcgaguggaaggaaggcgaggaagugcagguccucgcucuggagccugggaaaaacccgcgcgccgugcagaccaagcccggacuuuucaaaacgaauaccggcacaauuggggcggugucccuggacuuuucuccuggaaccagcggcucccccaucauugauaagaaagggaagguugucggacuguauggcaacggcguggugacaagaagcggggcuuacgucucugccaucgcccaaaccgaaaaguccaucgaggacaacccugagauugaagaugacaucuuccggaaacgcagacucacaauuauggaccugcaucccggagcuggcaagacgaaacgguaucuuccugccaucgugagagaggcgauuaagcgcgggcugcggacccucauccuggcuccgacaagaguuguggccgccgaaauggaggaagcucuccgcggacugcccauucgguaccagaccccugccaucagagcugagcacaccggccgcgagaucgucgaucuuaugugucaugccacauuuacgaugcggcugcugagccccgugagaguuccuaauuauaaccucauuaucauggacgaagcgcacuucaccgaucccgccucuauugcugcccgcggguacaucuccacacggguggagaugggcgaagcugccggaauuuucaugaccgccacaccgccuggcagcagagaccccuuuccccaguccaaugcuccuaucaucgaugaggagcgggaaauucccgagcgcucuuggaacagcgggcaugaaugggucaccgacuucaaaggaaagacggugugguuuguuccuuccaucaaggcgggcaaugauauugccgcuugccugcgcaagaaugggaagaaagugauccaacuuagccggaagacauucgacucugaguaugucaaaacccgcaccaaugauugggacuuuguggugacaaccgauauuuccgaaaugggagccaacuucaaggccgagagagucaucgacccgcggagauguaugaaacccguuauccugacagacggcgaggaacgcgugauucucgcugggccuaugcccgugacccacagcucugccgcgcagcggagaggccgcaucggacggaauccuaagaacgagaaugaucaguacauuuacaugggcgaaccccuggagaacgacgaagauugcgcucacuggaaggaggccaaaaugcugcucgacaauaucaacacgccggaggggauuaucccuagcauguuugaacccgagagagaaaaggucgaugccauugacggagaguaucgccuucggggcgaagcuagaaaaacauucguggaucugaugcgcagaggggaccugccuguuuggcucgccuacaagguggcggccgagggaaccaauuaugcugaucggcgcugguguuuugacggcaucaaaaacaaccagauccuggaggaaaaugucgagguggaaauuuggacaaaggagggggagagaaagaaacuuaagccccgguggcuggaugcccgcaucuacuccgacccucucgcucugaaagaguucaaggaguuugccgcuggcagaaaaucucugacccucaaccuuauuacggaaaugggacggcugcccaccuucaugacacaaaagaccagagaugcccuggacaaucucgcgguucugcauacagccgaggcuggcgggcgcgccuauaaccacgcucuuagcgaacugccggagacccucgagacacugcugcuccuuacccugcuggccacggugacaggaggcaucuuccucuuucugauguccgggcggggaauuggcaagaugacccuuggcaugugcugcaucaucaccgccucuauucugcucugguacgcucagauccagccucauuggauugcggccagcaucauucuggaguucuuucugaucguccuccuuauccccgagcccgaaaaacagagaacaccucaagacaaucagcugaccuauguggucauugcuauccugacagugguugccgccacgauggcuaacgagaugggguuccucgaaaagaccaaaaaggaucugggacuuggcuccauugccacacagcagccggagagcaauauccuggacauugaucuccgccccgcgucugccuggacccuguacgcuguggccacaaccuuugugacgccuaugcugcggcacuccaucgagaacagcuccgucaauguuucucucaccgcuauugccaaccaagcgacagugcuuauggggcugggaaaaggcuggccccugagcaagauggacaucggggugccucuccuggccaucggauguuacucccaggucaaucccauuacccuuacagcugcccugcuccugcugguggcucacuaugccaucauuggcccuggccuccaggcuaaggccaccagagaagcgcagaaacgggccgcugccgggaucaugaagaacccgacgguugauggaauuacagugaucgaccuugaucccaucccuuacgaccccaaauucgagaagcaacugggccaggucaugcugcucauucugugcgugacccagguccuuaugaugcgcacaaccugggcucugugugaagcccucacccuggccacagggccuaucucuacgcugugggagggaaaucccggcagauuuuggaacaccacaauugcggugagcauggcuaauaucuuccggggguccuaucucgccggagcuggccuucuguuuagcauuaugaaaaacaccacaaauacccgcagaggcacggggaacaucggagaaacacugggcgagaaguggaaaucucggcucaacgcccuggggaaguccgaguuccaaaccuacaagaaaagcggaauccaggaaguugaucgcacccuugccaaggagggcauuaaaagaggggaaacagaccaucacgcugugucucggggauccgccaagcugcgcugguuugucgagagaaauauggugaccccggagggcaaaguuguggaucucggcugcgggcggggaggcuggagcuauuacugugggggacugaagaacgucagagaagugaagggccugacaaaagggggaccuggccaugaggaacccauccccaugucuacguauggcuggaaucucgugcgccuucagagcgggguugacgucuucuuuauuccucccgagaagugcgauacccugcugugugacaucggagaauccucuccuaacccgacaguggaggcgggccggacccucagagugcugaaucuugucgagaacuggcugaauaacaauacacaguucugcauuaaaguucucaaccccuacaugccuagcgugaucgaaaagauggaggcccugcaacgcaaacacgggggagcucuggugcggaauccccucuccagaaacagcacccaugaaauguacugggucuccaaugccucuggcaacaucgugagcuccguuaauaugauuucucgcaugcuuaucaaccgguucacgaugagacacaagaaggcuaccuaugagccugacguggaucuggggagcggaacacgcaacauuggcaucgaauccgagauucccaaucuggacaucauuggcaaacggaucgagaagaucaaacaggaacacgagaccucuuggcauuacgaucaggaccacccguauaagacaugggccuaccaugggagcuaugaaaccaaacagacaggauccgcgagcucuauggucaacggcgugguuagacuccugaccaagccuugggaugugcuucccacggucacacaaauggccaugaccgacaccacaccuuuugggcagcagcgcguguucaaggagaaaguggauacgcggacccaggaacccaaggagggaaccaaaaagcugaugaaaauuaccgcugaguggcucuggaaggaacugggcaaaaagaagacaccuagaauguguacccgcgaggaauuuacaagaaaaguccgguccaaugccgcucugggggccaucuucaccgacgagaacaaguggaaaagcgcucgcgaggccguugaagauucuagauuuugggagcucguggaccgggaaagaaaucugcaccuugagggaaagugcgaaacguguguguacaacaugaugggcaaacgggagaagaagcugggcgaguucgggaaagcgaagggaucccgcgccauuugguauauguggcucggcgcuagauuucuggaguucgaggcccuuggguuucugaaugaagaucacugguucagccgggagaacucucucuccggagucgaaggcgaggggcugcauaaacugggcuacauccuccgcgacgugagcaagaaagagggaggcgcuauguacgccgacgauaccgccgggugggacacaagaauuacccuggaagaucuuaagaaugaggaaaugguuacaaaccacauggagggagaacauaagaaacuggcggaggcuaucuuuaagcucaccuaucaaaauaaagugguccgggugcagcgccccacgccgagaggcacaguuauggacaucauuucccggcgcgaucagagagggagcggacaagugggcaccuacgggcugaacacauucaccaauauggaggcccagcuuauccggcagauggaaggcgagggagucuuuaagaacauucagcaccugacggccaccgaagagguggcuguucaaaauuggcucgcccgcgugggcagagagcggcugucucgcauggcuaucagcggggacgauugcgucgugaaaccucuggacgauagauucgccaacgcgcucacagcccugaacgacaugggaaagauucggaaggauauccagcagugggaacccuccaaaggcuggaaugacuggacccagguccccuucugcucucaucacuuucacgagcuuaucaugaaggaugggagagugcugguugugccuugucgcaaccaagacgaacucauuggacgggcuagaaucagccagggcgccggguggucccugcgcgagacagcuugccuuggcaaaucuuaugcccagauguggagccugauguacuuccaucggagagaccuccgccuggcggccaaugcuauuuguuccgccgucccgucucacugggugcccaccagccggacaaccugguccauccaugcuaagcacgaauggaugacgacagaggauaugcugaccguguggaacagaguuuggauucgcgagaauccuuggauggaagacaaaacccccguggagagcugggaagagaucccuuaucucggaaagcgggaagaucaguggugcggcucucugauugggcuuacauccagagccaccugggcuaagaacauccaagccgcgaucaaucagguccgcagccugauuggaaacgaggaguacacagacuauaugcccucuaugaaacgguuuagacgggaagaggaagaggccggcgugcucugguga

SEQ ID NO: 19710 - RNA, 9876 nt, Artificial Sequence
  derived and/or modified CDS sequence (opt5) from DENV-2__GQ868624__SS-prME
agcgccggcaugaucauuaugcugauccccaccgugauggcuuuccaccugacaacgcggaauggggagccucauaugauugucggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucgggggagucuuuacauccaucggcaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccagguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucaaagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagcgcgcuaccgacgucaagugggaggaucaggccgaaauuucuggguccagcccuauccuguccauuaccaucagcgaggacggaucuaugagcauuaaaaacgaagaggaggaacagacacucaccauccugaucagaacaggccuccuggugauuuccgggcuuuuucccaucucuauuccgaucacggcugccgccugguaccugugggaggucaagaaacagcgggcuggagugcugugggauguuccuucucccccucccaugggcaaggcggaacucgaggacggggccuaucgcauuaaacaaaagggaauccugggcuacucccagaucggcgcugggguguacaaggaaggaaccuuccacacaauguggcaugucaccagaggcgccgugcuuaugcacaaagggaagcggauugagcccuccugggccgauguuaaaaaggaccugaucagcuauggaggcggguggaaacucgagggagaauggaaggagggcgaagaggugcagguccuggcucucgaaccuggcaagaauccgcgcgccgugcagacaaaacccgggcuguuuaagaccaacacgggaaccauuggcgcggugucccuugauuucucuccugggacaagcggaucccccaucauugacaaaaagggcaaaguugucgggcuguacggaaacggcguggugaccagaagcggcgcuuaugucucugccaucgcccaaacagagaaguccaucgaggauaauccugaaauugaggacgauaucuuucggaagcgcagacugaccauuauggaccuccaccccggggcuggaaaaacaaagcgguaccugccugccaucgugagagaagcgauuaaacgcggccuucggacgcugauccucgcuccgaccagaguuguggccgccgagauggaagaggcucugcgcgggcuccccauucgguaucagaccccugccaucagagcugagcauaccggacgcgaaaucgucgaccugaugugucacgccaccuucacaaugcggcuucugagccccgugagaguuccuaacuacaaucugauuaucauggaugaggcgcauuucacggaccccgccucuauugcugcccgcggcuauaucuccacccggguggaaaugggggaggcugccggcauuuuuaugacagccaccccgccuggaagcagagaucccuucccccaguccaacgcuccuaucaucgacgaggaacgggagauucccgaacgcucuuggaauagcggccacgagugggucacagauuuuaaggggaaaaccgugugguucguuccuuccaucaaggcgggaaacgacauugccgcuugccucagaaagaauggcaaaaaggugauccaacugagccggaaaacguuugauucugaauacgucaagacacgcaccaacgacugggauuucguggugaccacagacauuuccgagaugggggccaauuuuaaagccgagagagucaucgauccgcggagauguaugaagcccguuauccuuaccgacggagaggaacgcgugauucuggcuggcccuaugcccgugacacauagcucugccgcgcagcggagagggcgcaucggccggaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaaagagagaaagucgacgccauugauggggaauaccgccuccggggagaggcuagaaagacguuuguggaccuuaugcgcagaggcgaucugccuguuuggcuggccuauaaaguggcggccgaggggaucaacuacgcugaccggcgcugguguuucgauggaaucaagaacaaucagauucucgaagagaacgucgaaguggagaucuggacaaaagagggcgaaagaaagaagcugaaaccccgguggcuugacgcccgcauuuauuccgauccucuggcucucaaggaguuuaaagaguucgccgcugggagaaagucucugacccugaaucucaucacagagaugggccggcuucccaccuucaugacgcagaagaccagagacgcccuggauaaccuggcgguucuccacacagccgaagcuggaggccgcgccuacaaucaugcucugagcgagcuuccggagacccuggaaacacuccugcugcucacccuucuggccacagugaccgggggaauuuuucuguuccucauguccggccgggggaucggaaagaugacgcugggcaugugcugcaucauuacagccucuauccuucugugguaugcucagauucagccucacuggaucgcggccagcauuauccucgaguuuuuccugaucguccugcucauucccgaacccgagaagcagagaaccccucaagacaaccagcuuaccuacguggucaucgcuauucugacagugguugccgccaccauggcuaaugaaaugggcuuucuggagaaaacaaagaaagaccucgggcugggauccaucgccacgcagcagccggagagcaacauucuugauaucgaccugcgccccgcgucugccuggacccucuacgcuguggccacaaccuucgugacaccuaugcugcggcauuccauugaaaauagcuccgucaacguuucucugaccgcuaucgccaaucaagcgacggugcucaugggccuugggaagggauggccccugagcaaaauggauaucggcgugccucugcucgccauuggguguuauucccaggucaaccccaucacccugacagcugcccuucugcuccugguggcucacuacgccauuaucggaccuggccugcaggcuaaggccaccagagaggcgcagaagcgggccgcugccggcauuaugaaaaauccgacaguugacgggaucaccgugaucgaucucgaccccauuccuuaugaucccaaguuugaaaaacaacuuggacaggucaugcugcugauccucugcgugacgcagguccugaugaugcgcacaaccugggcucuuugugaggcccugacacucgccaccggcccuauuucuacccugugggaagggaaccccggaagauucuggaauacaacgaucgcggugagcauggcuaacauuuuucggggcuccuaccuggccggggcuggacuccuuuucagcaucaugaagaauaccacaaacacccgcagaggcacaggcaacaucggggagacccugggagagaaauggaagucucggcugaaugcccucggcaaauccgaauuucaaauuuauaaaaagagcgggauccaggagguugaccgcacgcuggccaaagaaggaauuaagagaggcgagacagaucaccaugcugugucucggggguccgccaaacuucgcugguucgucgagagaaacauggugaccccggaaggaaagguuguggaccugggcugcggcagagggggauggagcuacuauuguggcgggcucaaaaauguccgggaggugaagggacugaccaagggcgggccuggacacgaagaacccauccccaugucuacauacggcuggaaccuggugcgccuccagagcggcguugaugucuuuuucauuccucccgaaaaaugcgacacccuucugugugauaucggggaguccucuccuaauccgacaguggaggcgggacggacgcugagagugcucaaccuggucgaaaauuggcuuaacaauaacacccaguucugcaucaagguucugaaucccuacaugccuagcgugauugagaaaauggaagcccuccaacgcaaguauggcggggcucuggugcggaacccccuguccagaaauagcacacaugagauguacugggucuccaacgccucuggaaauaucgugagcuccguuaacaugauuucucgcaugcucaucaaccgguuuaccaugagacacaaaaaggcuacauaugaaccugacguggaccuuggcagcgggacccgcaauauuggaaucgaguccgagauucccaaccuggauaucaucggcaagcggauugagaagaucaaggaggaacaugagacgucuuggcacuacgaccaggaucacccguauaaaaccugggccuaccauggcagcuaugaaacaaagcagaccggguccgcgagcucuauggucaauggagugguuagacugcucacaaaaccuugggacgugcugcccaccgucacacagauggccaugaccgauacgacaccuuucggccaacagcgcguguuuaaggagaagguggacacccggacccaggagcccaaagaagggacaaagaaacuuaugaagauuacggcugaguggcuguggaaagaacucggaaagaaaaagaccccuagaauguguacacgcgaggaguucaccagaaagguccgguccaacgccgcucugggcgccaucuuuacagaugaaaauaaauggaaaagcgcucgcgaggccguugaagacucuagauucugggagcugguggauaaagaacggaaccuccaccuggaggggaagugcgagaccuguguguacaauaugaugggaaaaagagaaaagaaacuuggcgaguuuggcaaagcgaaggggucccgggccauuugguacauguggcugggagcucgcuuccucgaauuugaggcccugggcuuccuuaacgaagaccauugguuuagcagagaaaauucucuguccggggucgagggagaaggccuccacaaacugggguauauccugcgggaugugagcaagaaagagggcggagcuauguacgccgacgacacagccggcugggauacccgcaucacgcucgaagaccugaagaacgaggaaaugguuaccaaucacauggagggggagcauaagaaacuugcggaagcuauuuucaagcugacauaucagaacaaaguggucagagugcaacggcccaccccgcgcggaacaguuauggauaucauuuccagacgggaccagcgcggcagcgggcaggucggaaccuacggccucaauacguuuacaaacauggaggcccaacugaucagacagauggaaggggagggcgucuucaagaauauucagcaccuuaccgugacagaggaagccgcuguucagaacuggcuggcccgggugggacgcgagagacucucucggauggcuaucagcggcgaugacugcgucgugaaaccucuggaugaccgcuucgccaacgcgcugaccgcccucaaugauauggggaagaucagaaaggacauucaacagugggaacccuccaaaggauggaacgauuggacgcagguccccuuuugcucucaucacuuccaugagcugaucaugaaggacggccgggugcuuguugugccuuguagaaaucaggaugaacugauugggcgcgcucggaucagccaaggagccggcuggucccucagagagaccgcuugccuggggaaaucuuaugcccagauguggagccuuauguacuuucaccgccgggaccugagacucgcggccaacgcuauuuguuccgccgucccgucucacugggugcccacaagccgcaccacaugguccauccaugcuaagcacgaguggaugaccacagaagacaugcugaccguguggaaucggguuuggauuagagagaacccuuggauggaagauaaaacgcccguggagagcugggaagagaucccuuaucugggcaagcgcgaggaccaguggugcggaucucucaucggccugacaucccgggccaccugggcuaagaauauucaggccgcgaucaaccaagucagaagccuuauugggaaugaagaguacaccgauuacaugcccucuaugaaacgcuuccggagagaagaggaagaggccggagugcugugguga

SEQ ID NO: 19711 - RNA, 9876 nt, Artificial Sequence
  derived and/or modified CDS sequence (opt5) from DENV-2__FJ639717__SS-prME
uccgcuggaaugaucauuaugcugauccccacagugauggcuuuccaccucacaacgagaaacggggagccucauaugauugucgggauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucgucccucaugugggaaugggccuggagacacgcaccgaaacguggaugucuuccgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggaguccaaggcuuggcuggugcaccggcagugguuucuugaccugccgcucccuuggcugcccggggccgauaagcagggaagcaacuggauucagaaagagacccuggucacauucaagaauccucaugcuaaaaagcaagacgugguugugcucggcucccaggaaggggccaugcacaccgcccugacgggcgcuacagagauccagaugucuagcggaaaccuucuguuuaccggccaucucaaaugccgccugagaauggacaaacuucaacugaaggggauguccuacagcauguguacaggaaaauucaaggucgugaaagaaauugcggagacccagcacggcaccaucgucauucgggugcaguaugagggggauggaucucccugcaagauccccuucgaaaucauggaccucgagaaaagauacguucugggccgccugauuacagugaauccuaucgucacggaaaaggauuccccggugaacauugaggccgaacccccuuuuggggacagcuacaucauuaucggcguugagcccggacagcucaagcugaacugguucaaaaagggcucuagcauugggcaaauguuugagaccacaaugcggggagcuaaaagaauggccauccuuggcgauaccgccugggacuucgggucccugggaggcguguuuacaucuaucgggaaggcucuccaucaggucuucggcgccauuuauggagcggcuuuuagcggcguguccuggaccaugaaaauccugauuggggugaucauuacguggaucggaaugaauagccgcucuacaucccugagcguuucucuuguccucgugggcaucgugacccuguaccugggggucauggugcaggccgauuccggauguguugugagcuggaagaacaaggaacucaaaugcggcuccgggauuuucaucaccgacaauguccacacauggaccgagcaguauaaguuucaaccugaaucucccagcaaacuggccuccgcuauucagaaggcccaggaggaaggcaucuguggcauucggucugugacaagacuugagaaccugauguggaaacagaucacgccggagcucaaucacauccuggcugaaaacgagguuaagcugaccauuaugacaggcgauaucaaagggauuaugcaagccggaaagcgcagccuucggccucagcccaccgaacucaaguacuccuggaaaacauggggcaaggcgaaaaugcugagcaccgagucucauaaucagacguuccugaucgacgggccugaaaccgccgagugccccaacacaaauagagcuuggaacucccucgagguggaagauuauggauuuggcgucuucaccacaaauauuuggcugaaacuuaaagagaagcaggacgccuuuugugacagcaagcugaugucugcugccaucaaagauaaccgcgcggugcacgccgacaugggcuacuggaucgaauccgcucucaaugauaccuggaagauugagaaagccagcuucaucgagguuaagaacugccauuggccuaaaucucacacacuguggagcaauggggugcuggaauccgagaugauuauccccaagaaccuugcuggaccggucagccaacacaacuaucggccuggcuaccauacccagacggccgggcccuggcaccucggaaagcuggaaauggacuucgauuuuugugacggcacaaccgugauugugaccgaggauugcgggaauagaggacccucucugcgcacaaccacggccuccggcaaacucaucacagaauggugcugucggagcugcacccugccuccgcuuagauaccggggcgaggacggguguugguauggaauggagauucgcccccugaaggaaaaagaggaaaaccucgucaauucccugguuacagcuggccauggacagguggauaacuucucucugggagugcuuggcauggcgcucuuucuggaggaaaugcugagaacccgggucgggacaaagcacgccauccuccugguggcuguuagcuucgugacccuuaucacgggaaauauguccuuuaaagaccugggcagagucgugguuauggugggcaccacaaugaccgaugacauugggaugggagucacauaccucgcccugcuggccgcuuucaaggugcgcccuaccuuugccgcgggccuucugcuccggaagcugacgucuaaagagcucaugaugacaaccaucgggauuguucugcuuagccaauccacaauccccgagaccauucuggaacucaccgaugcucuggcccugggaaugauggugcuuaagaucgucagagacauggagaaauaucagcuggccgugacaaucauggcuauucucugcgugccuaacgccgucauccugcagaaugcguggaagguuucuuguacgauucucgcuguggugagcgucagcccccugcuucugaccagcucucagcagaagacagacuggaucccucucgcccugaccauuaagggccugaaccccacagccaucuuccuuaccacgcugucccgcacaaauaaaaagagaagcuggccgcucaacgaagcuaucauggccguggggaugguuucuauucuggcuuccagccuccugaagaaugauaucccuaugaccggaccccuuguggccggcggccugcugaccgucugcuacgugcucacagggcggucugcggaccuggagcuugaacgcgccaccgauguuaaaugggaggaccaggcugagauuuccggaagcuccccuauccugagcauuacaaucucugaagauggcagcauguccauuaagaacgaggaagaggagcagacgcucaccauccugaucagaacagggcuccuggugauuucuggacuuuuucccgucagcaucccgauuaccgccgcugccugguaucugugggaagugaaaaagcagcgggccggcguccugugggacgugccuucucccccucccauggggaaagcugagcucgaagauggagcguaccgcaucaagcaaaagggcauucugggcuauagccagaucggggccggaguuuacaaagagggcacauuccauaccauguggcacgugacgagaggggcuguccuuaugcacaagggaaaacggaucgaacccagcugggccgacgugaagaaagaucugauuuccuacggcgggggauggaagcucgagggcgaguggaaggaaggcgaggaaguucaggugcuggcccucgagccugggaaaaauccgcgcgcuguccagaccaagcccggacuguuuaaaacaaacaccggcacaaucggggccgugucucuugacuucagcccuggaaccuccggcagccccauuaucgauaagaaagggaaggugguuggacuguauggcaauggcgucgugacaagaucuggggcguacguguccgcuauugcccaaacggaaaagagcaucgaggacaacccugagaucgaagaugacauuuuucggaaacgcagacugaccaucauggaccuccaucccggagccggcaagacaaaacgguaucugccugcuauugucagagaggccaucaagcgcgggcuucggacccugauucucgcgccgaccagagugguugcugccgaaauggaggaagcccugcgcggacuccccauccgguaccagaccccugcuauuagagccgagcacacgggccgcgagaucguggaucugaugugucaugcuaccuucacaaugcggcuucugucucccgucagagugccuaacuauaaucugaucauuauggacgaagcccacuucaccgaucccgcguccaucgccgcucgcggguacauuagcacacggguugagaugggcgaagccgcuggaaucuuuaugaccgccacgccgccuggcuccagagaccccuucccccagucuaacgccccuauuaucgaugaggagcgggaaauccccgagcgcagcuggaauacagggcaugaaugggugaccgacuuuaaaggaaagaccgucugguucgugccuuccauuaaggcuggcaacgauaucgcggccugccuccgcaagaaugggaagaaaguuauucaacugagccggaagacauuugacucugaguaugugaaaacccgcacaaacgauugggacuucgucgugaccacggauaucuccgaaaugggagcuaauuuuaaggccgagagagugauugacccgcggagauguaugaaacccgucauccuuacagacggcgaggaacgcguuauccuggccgggccuaugcccgugacccacagcucugcugcccagcggagaggccgcauuggacggaacccuaagaaugagaacgaucaguacaucuacaugggcgaaccccucgagaaugacgaagauugcgcgcacuggaaggaggcuaaaaugcugcuggacaacauuaauacaccggaggggaucauuccuagcauguucgaacccgagagagaaaagguggaugccaucgacggagaguaucgccuccggggcgaagccagaaaaaccuuugucgaucuuaugcgcagaggggaccugccuguguggcuggcuuacaagguugccgcggagggaauuaacuaugccgaucggcgcugguguuucgacggcaucaaaaauaaccagauccucgaggaaaacguggaggucgaaauuuggacgaaggagggggagagaaagaaacugaagccccgguggcuugaugcucgcaucuacuccgacccucuggcccucaaagaauuuaaggaguucgcugccggcagaaaaucucugacccugaaucucauuacagaaaugggacggcuucccaccuucaugacacaaaagaccagagaugcucuggacaaccuggccgugcuccauacagcggaggccggcgggcgcgcuuauaaucacgcccugagcgaacuuccggagacccuggagacgcuccugcugcucacacuucuggcuaccguuaccggaggcaucuuucuguuccucauguccgggcggggaauuggcaagaugacacugggcaugugcugcaucaucaccgccucugugcuucugugguacgcccagauucagccucauuggaucgcugcgagcauuauccucgaauuuuuccugauuguccugcucauccccgagcccgaaaaacagagaacaccucaagacaaccagcuuacguauguggucaucgccauucugaccgugguugcugccacaauggccaaugagaugggguuucuggaaaagaccaaaaaggaucucggacugggcuccaucgcuacacagcagccggagagcaacauucuugacaucgaucugcgccccgccucugcguggacccucuacgccguggcuacgaccuucgugacaccuaugcugcggcacuccauugagaauagcuccgucaacguuucucugaccgccaucgcuaaucaagccacagugcucauggggcuuggaaaaggcuggccccugagcaagauggacauuggggugccucugcucgcgaucggauguuacucccaggucaaccccaucacccugacggccgcccuucugcuccugguggcccacuaugcuauuaucggcccuggccugcaggccaaggcuacaagagaagcccagaaacgggcggccgcugggauuaugaagaauccgaccguugauggaaucacagugauugaccucgaucccaucccuuacgaccccaaauuugagaagcaacuuggccaggucaugcugcugauccucugcgugacccagguccugaugaugcgcaccacaugggcccuuugugaagcucugacgcucgccaccgggccuauuucuacacugugggagggaaaccccggcagauucuggaauaccacaaucgccgugagcauggcgaacauuuuucggggguccuaucuggcuggagccggccuccuuuucagcaucaugaaaaauaccacgaacacacgcagaggcaccgggaauauuggagaaacccugggcgagaaguggaaaucucggcugaacgcucucgggaaguccgaguuucaaacauacaagaaaagcggaauccaggaaguugaucgcacccuggccaaggagggcaucaaaagaggggaaacagaccaucacgccgugucucggggauccgcuaaacuucgcugguucgucgagagaaacauggugacgccggagggcaaaguuguggaucugggcugcgggcggggaggcuggagcuauuacugugggggacucaagaaugucagagaagugaagggccugaccaaagggggaccuggccaugaggaacccauucccaugucuacauauggcuggaaccuggugcgccuccagagcgggguugacgucuuuuucaucccucccgagaagugcgauacccuucugugugacauuggagaauccucuccuaauccgacaguggaggccggccggacccugagagugcucaaccuggucgagaauuggcuuaacaauaacacgcaguucugcaucaaaguucugaaucccuacaugccuagcgugauugaaaagauggaggcgcuccaacgcaaauacgggggagcccuggugcggaacccccuguccagaaauagcacccacgaaauguauugggucuccaacgcuucuggcaauaucgugagcuccguuaacaugaucucucgcaugcucauuaaucgguuuacaaugagacauaagaaggccaccuacgagccugacguggaucuugggagcggaacacgcaacaucggcauugaauccgagauccccaaccuggacauuaucggcaaacggauugagaagaucaaacaggaacacgagaccucuuggcacuaugaucaggaccauccguacaagacaugggcuuaucacgggagcuacgaaaccaaacagacgggauccgccagcucuauggucaauggcgugguuagacugcucacaaagccuugggaugugcugcccaccgucacccaaauggcgaugacagacacgaccccuuucgggcagcagcgcguguuuaaggagaaaguggauacacggacccaggaacccaaggagggaaccaagaaacuuaugaaaaucaccgccgaguggcuguggaaggaacucggcaaaaagaagacaccuagaauguguacccgcgaggaguucacgagaaaaguccgguccaacgcugcccugggggcuauuuuuaccgacgagaauaaguggaaaagcgcccgcgaggcuguugaagauucuagauucugggagcugguggacaaggaacggaaccuccaucuggagggaaaaugcgaaacauguguguauaauaugaugggcaagagagagaagaaacuuggcgaguuugggaaggccaaaggaucccgggcgaucugguacauguggcugggcgcccgcuuccucgaauuugaggcucugggguuccuuaacgaagaucacugguuuagcagagaaaauucucuguccggagucgaaggcgaggggcuccacaagcugggcuacauucugcgggacgugagcaaaaaggagggaggcgccauguaugcugacgauaccgccgggugggacacacgcaucacccucgaagaucugaagaacgaggaaaugguuacgaaucauauggagggagaacacaagaaacuugccgaggcgauuuucaaacugacauaccaaaacaaaguggucagagugcagcggcccaccccgcgcggcacaguuauggacaucaucuccagacgggaucagcgcgggagcggacaagugggcaccuaugggcucaauacguuuaccaacauggaggcucagcugauuagacagauggaaggcgagggagucuucaaaaauauccagcaucuuacagccaccgaagagguggccguucaaaacuggcuggcucgggugggccgcgagagacucucucggauggccauuagcggggacgauugcgucgugaagccucuggacgaucgcuucgcuaaugcccugacagcgcucaacgacaugggaaagaucagaaaagauauucagcagugggaacccuccaagggcuggaacgacuggacccagguccccuuuugcucucaccauuuccacgagcugaucaugaaagaugggcgggugcuuguugugccuuguagaaaucaagacgaacugaucggacgcgcccggauuagccagggcgcuggguggucccucagagagacagccugccugggcaagucuuacgcucagauguggagccuuauguauuuucaccgccgggaccugagacucgccgcgaacgccaucuguuccgcugucccgucucauugggugcccaccagccgcacgacaugguccauucacgccaaacaugaauggaugaccaccgaggauaugcugacaguguggaaucggguuuggaucagagagaacccuuggauggaagacaagacccccguggagagcugggaagagauuccuuaccugggaaagcgcgaagaucaguggugcggcucucucaucgggcugacaucccgggcuacgugggccaaaaauauucaagcugccaucaaccaggucagaagccuuaucggaaaugaggaguauaccgacuacaugcccucuaugaagcgcuuccggagagaagaggaagaggcgggcgugcugugguga

SEQ ID NO: 19712 - RNA, 9876 nt, Artificial Sequence
  derived and/or modified CDS sequence (opt5) from DENV-2__FJ639718__SS-prME
agcgccggaaugaucauuaugcugauccccacagugauggcuuuccaccugacaacgcggaauggggagccucauaugauugucggaauccaggaaaagggcaaaagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaggacaagcgguuugugugcaagcauagcaugguggaucgcggcuggggcaauggguguggacuguucggcaaagggggaauugucacaugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggccaagagaauggcuauccuuggagauaccgccugggacuucggcagccucggcggggucuuuacauccaucgggaaagcccuccaucagguguucggggcuauuuauggcgccgcguuuucuggagugagcuggaccaugaagauccugauuggcguuaucauuacguggaucgggaugaacucccgcagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucaaccugagucccccucuaagcuggccagcgccauucagaaagcucaggaagaggggaucuguggcauucgguccguuacaagacuugagaaucugauguggaagcagaucacgccggaacucaaccacauccuggccgagaaugaagugaaacugaccauuaugacaggagauaucaagggcauuaugcaagcugggaaacgcucucuucggccucagcccaccgagcucaaguacagcuggaagacauggggaaaagccaagaugcuguccaccgaaagcuauaaccagacguuccugaucgacggcccugagaccgcggagugccccaauacaaacagagccuggaacucucucgaagucgaggauuacggguuuggaguguucaccacaaacauuuggcugaaacuuaaggaaaaacaggacgcuuuuugugacuccaagcugaugagcgccgcuaucaaggauaaucgcgccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccaacacaauuaccggccuggauaccacacccagauugcuggccccuggcaucucgggaagcuggagauggacuucgauuuuugugacggaacgacagugaucgucaccgaagauugcggcaacagagggcccagccugcgcaccacaaccgccucuggaaagcucauuacggaguggugcugucgguccugcacacugccuccgcuuagauaucggggcgaggacggcuguugguacgggauggaaauccgcccccugaaagagaaggaagagaaucucguuaacagccuggugaccgccggacacggccagguggauaauuucucccuggggguccuuggaauggcucucuuucuggaagagaugcugagaacacgggugggcaccaaacaugcgauccuccugguugccgugucuuucgucacacuuauuaccgggaacaugagcuuuaaggaccugggaagagugguugugauggucggcgcuacgauggccgaugacaucggcaugggggugaccuaucucgcccugcuggcugccuucaaaguucgcccuacauuugcggcuggacuucugcuccggaagcugaccuccaaggagcucaugaugacaaccauuggcaucgugcugcuuucucaaagcacgauucccgaaacaguccuggagcucaccgaugcccuggcccuggggaugauggugcuuaaaaucgugagaaauauggaaaaguaccagcuggcugucacaaucauggccauucucugcguuccuaacgcggugauccugcagaaugcuuggaaaguguccuguaccauucucgccgucgugucuguuagcccccugcuucugaccuccagccagcaaaagacagacuggaucccucucgcccugacgauuaaaggacugaaccccaccgcuaucuuccuuacaacccugucucgcacaaauaagaaaagauccuggccgcucaacgaggccaucauggcugugggcauggucagcauucuggccucuucccuccugaagaaugacaucccuaugaccgggccccuuguggcgggaggccugcugacgguuugcuaugugcucacaggccggagcgccgaucuggaacuugagaaggcuaccgacgucaaaugggaggaucaggccgaaauuucuggguccagcccuauccuguccauuaccaucagcgaggacggaucuaugagcauuaagaacgaagaggaggaacagacacucaccauccugauccgcacaggccuccuggugauuuccgggcuuuuucccaucucuauuccgaucacggcugccgccugguaccugugggaggucaaaaagcagagagcuggagugcugugggauguuccuucucccccucccaugggcaaagcggaacucgaggacggggccuaucggauuaagcaaaagggaauccugggcuacucccagaucggcgcugggguguacaaagaaggaaccuuccacacaauguggcaugucacccgcggcgccgugcuuaugcacaaggggaaaagaauugagcccuccugggccgauguuaagaaagaccugaucagcuauggaggcggguggaagcucgagggagaauggaaggagggcgaagaggugcagguccuggcucucgaaccuggcaaaaauccgcgggccgugcagacaaagcccgggcuguuuaaaaccaacacgggaaccauuggcgcggugucccuugauuucucuccugggacaagcggaucccccaucauugacaagaaaggcaagguugucgggcuguacggaaacggcguggugacccgcagcggcgcuuaugucucugccaucgcccaaacagagaaguccaucgaggauaauccugaaauugaggacgauaucuuuagaaaacggcgccugaccauuauggaccuccaccccggggcuggaaagacaaaaagauaccugccugccaucgugcgggaagcgauuaagagaggccuucgcacgcugauccucgcuccgacccggguuguggccgccgagauggaagaggcucugagagggcuccccauucgcuaucagaccccugccauccgggcugagcauaccggaagagaaaucgucgaccugaugugucacgccaccuucacaaugcgccuucugagccccgugcggguuccuaacuacaaucugauuaucauggaugaggcgcauuucacggaccccgccucuauugcugccagaggcuauaucuccacccgcguggaaaugggggaggcugccggcauuuuuaugacagccaccccgccuggaagccgggaucccuucccccaguccaacgcuccuaucaucgacgaggaaagagagauucccgaacggucuuggaauagcggccacgagugggucacagauuuuaaagggaagaccgugugguucguuccuuccaucaaggcgggaaacgacauugccgcuugccuccgcaaaaauggcaagaaagugauccaacugagcagaaagacguuugauucugaauacgucaaaacacggaccaacgacugggauuucguggugaccacagacauuuccgagaugggggccaauuuuaaggccgagcgcgucaucgauccgagacgguguaugaaacccguuauccuuaccgacggagaagagagagugauucuggcuggcccuaugcccgugacacauagcucugccgcgcagcgccgggggagaaucggccgcaacccuaagaaugaaaacgaccaguacauuuauaugggagagccccucgaaaaugaugaggacugcgcucacuggaaggaggccaaaaugcugcuggauaacaucaauaccccggaaggcauuaucccuagcauguucgagcccgaacgggagaaggucgacgccauugauggggaauacagacuccgcggagaggcucggaaaacguuuguggaccuuaugagacgcggcgaucugccuguuuggcuggccuauaagguggcggccgaggggaucaacuacgcugacagacggugguguuucgauggaaucaaaaacaaucagauucucgaagagaacgucgaaguggagaucuggacaaaggagggcgaacgcaagaaacugaagcccagauggcuugacgcccggauuuauuccgauccucuggcucucaaagaguuuaaggaguucgccgcugggcgcaaaucucugacccugaaucucaucacagagaugggcagacuucccaccuucaugacgcaaaagacccgggacgcccuggauaaccuggcgguucuccacacagccgaagcuggaggcagagccuacaaucaugcucugagcgagcuuccggagacccuggaaacacuccugcugcucacccuucuggccacagugaccgggggaauuuuucuguuccucauguccggccgcgggaucggaaagaugacgcugggcaugugcugcaucauuacagccucuauccuucugugguaugcucagauucagccucacuggaucgcggccagcauuauccucgaguuuuuccugaucguccugcucauucccgaacccgagaaacagcggaccccucaagacaaccagcuuaccuacguggucaucgcuauucugacagugguugccgccaccauggcuaaugaaaugggcuuucuggagaagaccaagaaggaccucgggcugggauccaucgccacgcagcagccggagagcaacauucuugauaucgaccugagacccgcgucugccuggacccucuacgcuguggccacaaccuucgugacaccuaugcugcgccauuccauugaaaauagcuccgucaacguuucucugaccgcuaucgccaaucaagcgacggugcucaugggccuugggaaaggauggccccugagcaagauggauaucggcgugccucugcucgccauuggguguuauucccaggucaaccccaucacccugacagcugcccuucugcuccugguggcucacuacgccauuaucggaccuggccugcaggcuaaggccacccgggaggcgcagaaaagagccgcugccggcauuaugaagaauccgacaguugacgggaucaccgugaucgaucucgaccccauuccuuaugaucccaaauuugaaaagcaacuuggacaggucaugcugcugauccucugcgugacgcagguccugaugaugcggacaaccugggcucuuugugaggcccugacacucgccaccggcccuauuucuacccugugggaagggaaccccggacgcuucuggaauacaacgaucgcggugagcauggcuaacauuuuuagaggcuccuaccuggccggggcuggacuccuuuucagcaucaugaaaaauaccacaaacacccggcgcggcacaggcaacaucggggagacccugggagagaaguggaaaucuagacugaaugcccucggcaaguccgaauuucaaauuuauaagaaaagcgggauccaggagguugaccggacgcuggccaaggaaggaauuaaacgcggcgagacagaucaccaugcugugucuagaggguccgccaaacuucggugguucgucgagcgcaacauggugaccccggaaggaaaaguuguggaccugggcugcggcagagggggauggagcuacuauuguggcgggcucaagaauguccgggaggugaagggacugaccaaaggcgggccuggacacgaggaacccauccccaugucuacauacggcuggaaccuggugagacuccagagcggcguugaugucuuuuucauuccucccgaaaagugcgacacccuucugugugauaucggggaguccucuccuaauccgacaguggaggcgggacgcacgcugcgggugcucaaccuggucgaaaauuggcuuaacaauaacacccaguucugcaucaaaguucugaaucccuacaugccuagcgugauugagaagauggaagcccuccaaagaaaauauggcggggcucuggugcgcaacccccugucccggaauagcacacaugagauguacugggucuccaacgccucuggaaauaucgugagcuccguuaacaugauuucuagaaugcucaucaaccgcuuuaccaugcggcacaagaaggcuacauaugaaccugacguggaccuuggcagcgggaccagaaauauuggaaucgaguccgagauucccaaccuggauaucaucggcaaacgcauugaaaagaucaaagaggaacaugagacgucuuggcacuacgaccaggaucacccguauaagaccugggccuaccauggcagcuaugaaacaaaacagaccggguccgcgagcucuauggucaauggagugguucggcugcucacaaagccuugggacgugcugcccaccgucacacagauggccaugaccgauacgacaccuuucggccaacagagaguguuuaaggagaaaguggacacccgcacccaggagcccaaggaagggaccaagaaacuuaugaaaauuacggcugaguggcuguggaaggaacucggcaagaagaagaccccucggauguguacaagagaggaguucacccgcaaagucagauccaacgccgcucugggcgccaucuuuacagaugaaaauaaguggaaaagcgcucgggaggccguugaagacaaccgcuucugggagcugguggauaaggaaagaaaucuccaccuggaggggaaaugcgagaccuguguguacaacaugaugggaaagcgggaaaagaaacuuggcgaguuuggcaaggcgaaagggucuagagccauuugguacauguggcugggagcucgguuccucgaauuugaggcccugggcuuccuuaaugaagaccauugguuuucccgcgagaacagccugucuggggucgagggagaaggccuccacaagcugggguauauccugagagauguguccaaaaaggagggcggagcuauguacgccgacgacacagccggcugggauacccggaucacgcucgaagaccugaagaaugaggaaaugguuaccaaccacauggagggggagcauaagaaacuugcggaagcuauuuucaaacugacauaucagaauaaagugguccgcgugcaaagacccaccccgcggggaacaguuauggauaucauuagccgcagagaccagcggggcuccggacaggugggaaccuacggccucaacacguuuacaaauauggaggcccaacugauccgccagauggaaggggagggcgucuucaaaaacauucagcaccuuaccgugacagaggaagccgcuguucagaacuggcuggccagagugggacgggagcgccucagcagaauggcuaucucuggcgaugacugcgucgugaagccucuggaugaccgguucgccaaugcgcugaccgcccucaacgauauggggaagauccgcaaagacauucaacagugggaacccagcaagggauggaaugauuggacgcagguccccuuuugcucccaucacuuccaugagcuggugaugaaagacggcagaguucuuguggucccuugucggaaccaggaugaacugaucgggagagcucgcauuucucaaggagccggcuggagccuccgggagaccgcuugccuggggaaguccuaugcccagauguggucucuuauguacuuucacagacgcgaccugcggcucgcggccaaugcuaucuguagcgccgugccgucccacugggugcccacaucuagaaccacauggagcauucaugcuaaacacgaguggaugaccacagaagacaugcugaccguuuggaaccgcguguggauccgggagaauccuuggauggaagauaagacgcccgucgaguccugggaagagauuccuuaucugggcaagagagaggaccaguggugcggaagccucaucggccugacaucucgcgccaccugggcuaaaaacauccaggccgcgauuaaucaagugcggucccuuaucgggaacgaagaguacaccgauuacaugcccagcaugaagagauuccgccgggaagaggaagaggccggaguucugugguga

SEQ ID NO: 19713 - RNA, 9876 nt, Artificial Sequence
  derived and/or modified CDS sequence (opt5) from DENV-2__GQ868625__SS-prME
agcgccggcaugaucauuaugcugauccccaccgugauggcuuuccaccugacaacgagaaauggggagccucauaugauugucggaauccaggaaaagggcaagagccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaggaacaggacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccggauguuugaaaccacaaugagaggggccaagcgcauggcuauccuuggagauaccgccugggacuucggcagccucgggggagucuuuacauccaucggcaaagcccuccaucaaguguucggggcuauuuauggcgccgcguuuucuggagugagcuggaccaugaagauccugauuggcguuaucauuacguggaucgggaugaacucccggagcacaucucuguccgucagccuugugcucgugggaaucgucacccuguaccugggcgugaugguucaggcugauucuggguguguggucuccuggaaaaauaaggagcucaagugcggaagcggcauuuucaucaccgacaacgugcacacauggaccgaacaguauaaauuucagccugagucccccucuaagcuggccagcgccauucaaaaagcucaggaagaggggaucuguggcauuagauccguuacacgccuugagaaucugauguggaagcagaucacgccggaacucaaccacauccuggccgagaaugaagugaaacugaccauuaugacaggagauaucaagggcauuaugcaggcugggaaacggucucuuagaccucaacccaccgagcucaaguacagcuggaagacauggggaaaagccaagaugcuguccaccgaaagcuauaaccagacguuccugaucgacggcccugagaccgcggagugccccaauacaaaccgcgccuggaacucucucgaagucgaggauuacggguuuggaguguucaccacaaacauuuggcugaaacuuaaggaaaaacaggacgcuuuuugugacuccaagcugaugagcgccgcuaucaaggauaaucgggccguucaugcggacaugggcuauuggaucgagucugcccucaacgauaccuggaaaauugagaaggcuuccuucaucgaagugaaaaauugccacuggccuaagagccauacacuguggucuaacggcguccuggagagcgaaaugauuauccccaaaaaccuugccgggccggugucccagcacaauuacagaccuggauaccacacccaaauugcuggccccuggcaucucgggaagcuggagauggacuucgauuuuugugacggaacgacagugaucgucaccgaagauugcggcaaccgcgggcccagccugcggaccacaaccgccucuggaaagcucauuacggaguggugcuguagauccugcacacugccuccgcuucgguaucgcggcgaggacggcuguugguacgggauggaaaucagaccccugaaagagaaggaagagaaucucguuaacagccuggugaccgccggacacggccagguggauaauuucucccuggggguccuuggaauggcucucuuucuggaagagaugcugcggacaagagugggcaccaaacaugcgauccuccugguugccgugucuuucgucacacuuauuaccgggaacaugagcuuuaaggaccugggacgcgugguugugauggucggcgcuacgauggccgaugacaucggcaugggggugaccuaucucgcccugcuggcugccuucaaaguucggccuacauuugcggcuggacuucugcucagaaagcugaccuccaaggagcucaugaugacaaccauuggcaucgugcugcuuucucagagcacgauucccgaaacaguccuggagcucaccgaugcccuggcccuggggaugauggugcuuaaaaucgugcgcaauauggaaaaguaccaacuggcugucacaaucauggccauucucugcguuccuaacgcggugauccugcagaaugcuuggaaaguguccuguaccauucucgccgucgugucuguuagcccccugcuucugaccuccagccagcagaagacagacuggaucccucucgcccugacgauuaaaggacugaaccccaccgcuaucuuccuuacaacccugucuagaacaaauaagaaacgguccuggccgcucaacgaggccaucauggcugugggcauggucagcauucuggccucuucccuccugaagaaugacaucccuaugaccgggccccuuguggcgggaggccugcugacgguuugcuaugugcucacaggccgcagcgccgaucuggaacuugagagagcuaccgacgucaagugggaggaucaagccgaaauuucuggguccagcccuauccuguccauuaccaucagcgaggacggaucuaugagcauuaaaaacgaagaggaggaacagacacucaccauccugauccggacaggccuccuggugauuuccgggcuuuuucccaucucuauuccgaucacggcugccgccugguaccugugggaggucaagaaacagcgcgcuggagugcugugggauguuccuucucccccucccaugggcaaggcggaacucgaggacggggccuauagaauuaaacagaagggaauccugggcuacucccaaaucggcgcugggguguacaaggaaggaaccuuccacacaauguggcaugucacccggggcgccgugcuuaugcacaaagggaagcgcauugagcccuccugggccgauguuaaaaaggaccugaucagcuauggaggcggguggaaacucgagggagaauggaaggagggcgaagaggugcagguccuggcucucgaaccuggcaagaauccgagagccgugcagacaaaacccgggcuguuuaagaccaacacgggaaccauuggcgcggugucccuugauuucucuccugggacaagcggaucccccaucauugacaaaaagggcaaaguugucgggcuguacggaaacggcguggugacccggagcggcgcuuaugucucugccaucgcccagacagagaaguccaucgaggauaauccugaaauugaggacgauaucuuucgcaagagacggcugaccauuauggaccuccaccccggggcuggaaaaacaaagagauaccugccugccaucgugcgcgaagcgauuaaacggggccuuagaacgcugauccucgcuccgacccgcguuguggccgccgagauggaagaggcucugcgggggcuccccauuagauaucaaaccccugccauccgcgcugagcauaccggacgggaaaucgucgaccugaugugucacgccaccuucacaaugagacuucugagccccgugcgcguuccuaacuacaaucugauuaucauggaugaggcgcauuucacggaccccgccucuauugcugcccggggcuauaucuccaccagaguggaaaugggggaggcugccggcauuuuuaugacagccaccccgccuggaagccgggaucccuucccccaguccaacgcuccuaucaucgacgaggaacgcgagauucccgaaagaucuuggaauagcggccacgagugggucacagauuuuaaggggaaaaccgugugguucguuccuuccaucaaggcgggaaacgacauugccgcuugccuccggaagaauggcaaaaaggugauccagcugagccgcaaaacguuugauucugaauacgucaagacaagaaccaacgacugggauuucguggugaccacagacauuuccgagaugggggccaauuuuaaagccgagcgggucaucgauccgagacgcuguaugaagcccguuauccuuaccgacggagaggaacgggugauucuggcuggcccuaugcccgugacacauagcucugccgcgcaaagacgcgggcggaucggcagaaacccuaaaaaugaaaacgaccaguacauuuauaugggagagccccucgaaaaugaugaggacugcgcucacuggaaggaggccaagaugcugcuggauaacaucaauaccccggaaggcauuaucccuagcauguucgagcccgaacgcgagaaagucgacgccauugauggggaauaccggcucagaggagaggcucgcaagacguuuguggaccuuaugagacggggcgaucugccuguuuggcuggccuauaaaguggcggccgaggggaucaacuacgcugaccgcagaugguguuucgauggaaucaagaacaaucagauucucgaagagaacgucgaaguggagaucuggacaaaagagggcgaacggaagaagcugaaaccccgcuggcuugacgccagaauuuauuccgauccucuggcucucaaggaguuuaaagaguucgccgcugggcggaagucucugacccugaaucucaucacagagaugggcagacuucccaccuucaugacgcagaaaacccgcgacgcccuggauaaccuggcgguucuccacacagccgaagcuggaggccgggccuacaaucaugcucugagcgagcuuccggagacccuggaaacacuccugcugcucacccuucuggccacagugaccgggggaauuuuucuguuccucauguccggcagagggaucggaaagaugacgcugggcaugugcugcaucauuacagccucuauccuucugugguaugcucaaauucagccucacuggaucgcggccagcauuauccucgaguuuuuccugaucguccugcucauucccgaacccgagaagcagcgcaccccucaggacaaccaacuuaccuacguggucaucgcuauucugacagugguugccgccaccauggcuaaugaaaugggcuuucuggagaaaacaaagaaagaccucgggcugggauccaucgccacgcagcagccggagagcaacauucuugauaucgaccugcggcccgcgucugccuggacccucuacgcuguggccacaaccuucgugacaccuaugcugagacauuccauugaaaauagcuccgucaacguuucucugaccgcuaucgccaaucaggcgacggugcucaugggccuugggaagggauggccccugagcaaaauggauaucggcgugccucugcucgccauuggguguuauucccaagucaaccccaucacccugacagcugcccuucugcuccugguggcucacuacgccauuaucggaccuggccugcaggcuaaggccacccgggaggcgcagaagcgcgccgcugccggcauuaugaaaaauccgacaguugacgggaucaccgugaucgaucucgaccccauuccuuaugaucccaaguuugaaaaacagcuuggacaagucaugcugcugauccucugcgugacgcagguccugaugaugagaacaaccugggcucuuugugaggcccugacacucgccaccggcccuauuucuacccugugggaagggaaccccggacgguucuggaauacaacgaucgcggugagcauggcuaacauuuuucgcggcuccuaccuggccggggcuggacuccuuuucagcaucaugaagaauaccacaaacaccagacggggcacaggcaacaucggggagacccugggagagaaauggaagucucgccugaaugcccucggcaaauccgaauuucagauuuauaaaaagagcgggauccaagagguugacagaacgcuggccaaagaaggaauuaagcggggcgagacagaucaccaugcugugucucgcggguccgccaaacuuagaugguucgucgagcggaacauggugaccccggaaggaaagguuguggaccugggcugcggcagagggggauggagcuacuauuguggcgggcucaaaaauguccgcgaggugaagggacugaccaagggcgggccuggacacgaagaacccauccccaugucuacauacggcuggaaccuggugcggcuccagagcggcguugaugucuuuuucauuccucccgaaaaaugcgacacccuucugugugauaucggggaguccucuccuaauccgacaguggaggcgggaagaacgcugcgcgugcucaaccuggucgaaaauuggcuuaacaauaacacccaguucugcaucaagguucugaaucccuacaugccuagcgugauugagaaaauggaagcccuccagcggaaguauggcggggcucuggugagaaacccccugucccgcaauagcacacaugagauguacugggucuccaacgccucuggaaauaucgugagcuccguuaacaugauuucucggaugcucaucaacagauuuaccaugcgccacaaaaaggcuacauaugaaccugacguggaccuuggcagcgggacccggaauauuggaaucgaguccgagauucccaaccuggauaucaucggcaagagaauugagaagaucaaggaggaacaugagacgucuuggcacuacgaccaagaucacccguauaaaaccugggccuaccauggcagcuaugaaacaaagcagaccggguccgcgagcucuauggucaauggagugguucgccugcucacaaaaccuugggacgugcugcccaccgucacacagauggccaugaccgauacgacaccuuucggccagcaacggguguuuaaggagaagguggacaccagaacccaggagcccaaagaagggacaaagaaacuuaugaagauuacggcugaguggcuguggaaagaacucggaaagaaaaagaccccucgcauguguacaagagaggaguucacccggaagguccgcuccaacgccgcucugggcgccaucuuuacagaugaaaauaaauggaaaagcgcuagagaggccguugaagacucucgguucugggagcugguggauaaagaaagaaaccuccaccuggaggggaagugcgagaccuguguguacaauaugaugggaaaacgggaaaagaaacuuggcgaguuuggcaaagcgaaggggucccgcgccauuugguacauguggcugggagcuagauuccucgaauuugaggcccugggcuuccuuaacgaagaccauugguuuagccgggaaaauucucuguccggggucgagggagaaggccuccacaaacugggguauauccugcgcgaugugagcaagaaagagggcggagcuauguacgccgacgacacagccggcugggauaccagaaucacgcucgaagaccugaagaacgaggaaaugguuaccaaucacauggagggggagcauaagaaacuugcggaagcuauuuucaagcugacauaucagaacaaagugguccgggugcagcgccccaccccgagaggaacaguuauggauaucauuucccggcgcgaccaaagaggcagcgggcaggucggaaccuacggccucaauacguuuacaaacauggaggcccagcugauccggcaaauggaaggggagggcgucuucaagaauauucagcaccuuaccgugacagaggaagccgcuguucagaacuggcuggcccgcgugggaagagagcggcucucucgcauggcuaucagcggcgaugacugcgucgugaaaccucuggaugacagauucgccaacgcgcugaccgcccucaaugauauggggaagauccggaaggacauucagcaaugggaacccuccaaaggauggaacgauuggacgcagguccccuuuugcucucaucacuuccaugagcuggugaugaaggacggcagaguucuuguggucccuugucgcaaucaggaugaacugaucgggcgggcuagaauuagccagggagccggcuggucccuccgcgagaccgcuugccuggggaaaucuuaugcccaaauguggagccuuauguacuuucaccggagagaccugcgccucgcggccaacgcuaucuguuccgccgugccgucucacugggugcccacaagccggaccacaugguccauucaugcuaagcacgaguggaugaccacagaagacaugcugaccguuuggaauagaguguggauccgcgagaacccuuggauggaagauaaaacgcccgucgagagcugggaagagauuccuuaucugggcaagcgggaggaccaguggugcggaucucucaucggccugacauccagagccaccugggcuaagaauauccaggccgcgauuaaccaggugcgcagccuuaucgggaaugaagaguacaccgauuacaugcccucuaugaaacgguucagacgggaagaggaagaggccggaguucugugguga

SEQ ID NO: 19714 - RNA, 9876 nt, Artificial Sequence
  derived and/or modified CDS sequence (opt5) from DENV-2__KF955401__SS-prME
agcgccggcaugaucauuaugcugauccccaccgugauggcuuuccaccugacaacgcggaauggggaaccucauaugauugucggaauccaggaaaagggcaaaucccugcuuuuuaagaccgaagacgggguuaauaugugcacacugauggccauggaucuuggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagcggaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggauuuugucgaaggggugagcggaggcuccuggguugacaucgugcucgagcacgggagcugugucaccacaauggcgaagaauaagcccacccuggauuucgaacuuauuaaaacagaggccaagcagccugcuacccugcgcaaauauugcaucgaagccaagcucacgaacacaaccaccgagucuagauguccgacacaaggagagcccucccugaaagaagaacaagacaagcgguuugugugcaagcauagcaugguggaucgcggcuggggcaauggguguggacuguucggcaaagggggaauugugaccugcgcuauguuuacaugcaagaaaaacauggaaggcaagaucguucagccugagaaucucgaauacacgauuguggugacaccccacucuggggaggagcaugccgucggaaacgacacaggcaaacacggcauggaaaucaaggugaccccucaguccagcaucacagaggcggaacugaccggguauggaacgguuaccauggaguguucucccagaacaggccuugauuucaaugaaauggugcugcuccaaauggagaacaaagccuggcugguccaccggcagugguuucuugaccugccgcucccuuggcugcccggggcugauaagcaggaguccaauuggauucagaaggaaacccuggugacauucaaaaacccucaugccaagaaacaagacguugugguccucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaaguggucaaggagauugcugagacccagcacggaaccaucgugauucggguucaguaugaaggcgaugggagccccugcaaaauccccuucgagaucauggaccucgaaaagagauacgugcugggacgccugauuacagucaacccuaucgugacggagaaagauucuccgguuaacauugaagcggagcccccuuuuggcgacuccuacaucauuaucgggguggagcccggccagcucaagcugaauugguucaagaaaggaagcucuauuggccaaauguuugaaaccacaaugagaggggcuaagagaauggcuauccuuggagauaccgccugggacuucggcagccucgggggagucuuuacauccaucggcaaagcccuccaucagguguucggggcuauuuauggcguggccuuuucuggaguuagcuggaccaugaagauccugauuggcgucaucauuacguggaucgggaugaacucccgcagcacaucucuguccgugagccuugugcucgucggaaucgugacccuguaccugggcguuauggugcaggcggauucugggugugucguguccuggaaaaauaaggagcucaagugcggaagcggcauuuucaucaccgacaacguucacacauggaccgaacaguauaaauuucaaccugagucccccucuaagcuggcuagcgccauucagaaagcccaggaagaggggaucuguggcauucgguccgugacaagacuugagaaucugauguggaagcagaucacgccggaacucaaccacauccuggcugagaaugaagucaaacugaccauuaugacaggagauaucaagggcauuaugcaagccgggaaacgcucucuucggccucagcccaccgagcucaaguacagcuggaagacauggggaaaagcuaagaugcuguucaccgaauccuauaaccagacguuucugaucgacggcccugagaccgccgagugccccaauacaaacagagcguggaauagccucgaaguggaggauuacggguucggaguuuuuaccacaaacauuuggcugaaacuuaaggaaaaacaggacgccuucugugacucuaagcugauguccgcugccaucaaggauaaucgcgcugugcaugccgacaugggcuauuggaucgagagcgcgcucaacgauaccuggaaaauugagaaggccucuuucaucgaagucaaaaauugccacuggccuaagucccauacacuguggagcaacggcgugcuggagucugaaaugauuauccccaaaaaccuugcugggccggugagccaacacaauuaccggccuggauaccacacccagauugccggccccuggcaucucgggaagcuggagauggacuuugauuucugugacggaacgacagucaucguuaccgaagauugcggcaacagagggcccucccugcgcaccacaaccgcuagcggaaagcucauuacggaguggugcugucggucuugcacacugccuccgcuuagauaucggggcgaggacggcuguugguacgggauggaaauccgcccccugaaagagaaggaagagaaucucgugaacucccuggugaccgccggacacggccaggucgauaauuuuagccugggggugcuuggaauggcccucuuccuggaagagaugcugagaacacggguuggcaccaaacaugcuauccuccugguggcggucuccuuugugacacuuauuaccgggaacaugucuuucaaggaccugggaagaguuguggucauggugggcgccacgauggcugaugacaucggcauggggguuaccuaucucgcccugcuggccgcuuuuaaagugcgcccuacauucgccgcgggacuucugcuccggaagcugaccagcaaggagcucaugaugacaaccauuggcaucguccugcuuucccaaucuacgauucccgaaacagugcuggagcucaccgaugcucuggcccuggggaugauggugcuuaaaaucgucagaaauauggaaaaguaccagcuggccguuacaaucauggcuauucucugcgugccuaacgccgugauccugcagaaugcguggaaagucagcuguaccauucucgcugugguuuccgugucuccccugcuucugaccagcucccagcaaaagacagacuggaucccucucgcccugacgauuaaaggacugaaccccaccgccaucuuucuuacaacccugagccgcacaaauaagaaaagaucuuggccgcucaacgaggcuaucauggccgucggcaugguguccauucuggcuagcucucuccugaagaaugacaucccuaugaccgggccccuuguugccggaggccugcugacggugugcuauguccucacaggccgguccgcggaucuggaacuugagcgcgccaccgacgugaagugggaggaucaggcugaaauuagcgggucuuccccuauccugagcauuaccaucuccgaggacggaagcaugucuauuaaaaacgaagaggaggaacagacacucaccauccugaucagaacaggccuccuggucauuagcgggcuuuuccccaucuccauuccgaucacggccgcugccugguaccugugggaggugaagaaacagcgggccggaguucugugggaugugccuucucccccucccaugggcaaggcugaacucgaggacggggcguaucgcauuaaacaaaagggaauccugggcuacagccagaucggcgccggggucuacaaggaaggaaccuuucacacaauguggcaugugaccagaggcgcuguucuuaugcacaaagggaagcggauugagcccuccugggccgaugugaaaaaggaccugaucucuuauggaggcggguggaaacucgagggagaauggaaggagggcgaagagguccaggugcuggcccucgaaccuggcaagaauccgcgcgcugugcagacaaaacccgggcuguucaagaccaacacgggaaccauuggcgccguuagccuugauuuuuccccugggacaucuggaagccccaucauugacaaaaagggcaaagucguggggcuguacggaaacggcguggucaccagauccggcgcguaugugagcgcuaucgcccaaacagagaagucuaucgaggauaauccugaaauugaggacgauaucuuccggaagcgcagacugaccauuauggaccuccaccccggggccggaaaaacaaagcgguaccugccugcuaucguuagagaagccauuaaacgcggccuucggacgcugauccucgcgccgaccagaguggucgcugccgagauggaagaggcccugcgcgggcuccccauucgguaucagaccccugcuaucagagccgagcauaccggacgcgaaaucguggaccugaugugucacgcuaccuucacaaugcggcuucugucccccguuagagugccuaacuacaaucugauuaucauggaugaggcccauuuuacggaccccgcgagcauugccgcucgcggcuauaucucuacccgggucgaaaugggggaggccgcuggcauuuucaugacagccaccccgccuggauccagagaucccuuuccccagagcaacgccccuaucaucgacgaggaacgggagauucccgaacgcuccuggaacucuggccacgagugggugacagauuucaaggggaaaaccguuugguuugugccuagcaucaaggcuggaaacgacauugcggccugccucagaaagaauggcaaaaaggucauccaacugucccggaaaacguucgauagcgaauacgugaagacacgcaccaacgacugggauuuuguggucaccacagacauuucugagaugggggcuaauuucaaagccgagagaguuaucgauccgcggagauguaugaagcccgugauccuuaccgacggagaggaacgcgugauucuggccggcccuaugcccgucacacauuccagcgcugcccagcggagagggcgcaucggccggaacccuaaaaaugaaaacgaccaguacauuuauaugggagagccccucgaaaaugaugaggacugcgcgcacuggaaggaggcuaagaugcugcuggauaacaucaauaccccggaaggcauuaucccuucuauguuugagcccgaaagagagaaaguggacgccauugauggggaauaccgccuccggggagaggccagaaagacguucguugaccuuaugcgcagaggcgaucugccuguguggcuggcuuauaaagucgccgcggaggggaucaacuacgccgaccggcgcugguguuuugauggaaucaagaacaaucagauucucgaagagaacguggaaguugagaucuggacaaaagagggcgaaagaaagaagcugaaaccccgguggcuugacgcucgcauuuauagcgauccucuggcccucaaggaguucaaagaguucgcugccgggagaaagucccugacccugaaucucaucacagagaugggccggcuucccaccuuuaugacgcagaagaccagagacgcucuggauaaccuggccgugcuccacacagcggaagccggaggccgcgcuuacaaucaugcccugucugagcuuccggagacccuggaaacacuccugcugcucacccuucuggcuacagucaccgggggaauuuuccuguuucucaugagcggccgggggaucggaaagaugacgcugggcaugugcugcaucauuacagccuccauccuucugugguaugcccagauucagccucacuggaucgcugcgucuauuauccucgaguucuuucugaucgugcugcucauucccgaacccgagaagcagagaaccccucaagacaaccagcuuaccuacgucgugaucgccauucugacaguuguggcugccaccauggccaaugaaaugggcuuccuggagaaaacaaagaaagaccucgggcugggaagcaucgcuacgcagcagccggaguccaacauucuugauaucgaccugcgccccgccagcgcguggacccucuacgccguggcuacaaccuuugucacaccuaugcugcggcauucuauugaaaauuccagcguuaacgugucccugaccgccaucgcuaaucaagccacggugcucaugggccuugggaagggauggccccugucuaaaauggauaucggcgucccucugcucgcgauuggguguuauagccaggugaaccccaucacccugacagccgcccuucugcuccugguugcccacuacgcuauuaucggaccuggccugcaggccaaggcuaccagagaggcccagaagcgggcggccgcuggcauuaugaaaaauccgacaguggacgggaucaccgucaucgaucucgaccccauuccuuaugaucccaaguucgaaaaacaacuuggacaggugaugcugcugauccucugcgucacgcagguccugaugaugcgcacaaccugggcccuuugugaggcucugacacucgccaccggcccuauuuccacccugugggaagggaaccccggaagauuuuggaauacaacgaucgccguuucuauggcgaacauuuuccggggcagcuaccuggcuggggccggacuccucuuuuccaucaugaagaauaccacaaacacccgcagaggcacaggcaacaucggggagacccugggagagaaauggaaaagccggcugaaugcucucggcaaaucugaguuccaaauuuauaagaaguccgggauccaggagguggaccgcacgcuggccaaagaaggaauuaagagaggcgagacagaucaccaugccgucagccgggggucugcuaaacuucgcugguuuguggagagaaacaugguuaccccggaaggaaagguggucgaccugggcugcggcagagggggaugguccuacuauuguggcgggcucaaaaaugugagagaggugaagggacugaccaagggcgggccuggacacgaagaacccauccccaugagcacauacggcuggaaccugguucgccuccagucuggcgucgauguguucuucauuccucccgaaaaaugcgacacccuucugugugauaucggggagagcuccccuaauccgacaguggaggccggacggacgcugagaguccucaaccugguugaaaauuggcuuaacaauaacacccaguuuugcaucaaggugcugaaucccuacaugccuucugugauugagaaaauggaagcgcuccaacgcaaguauggcggggcccugguccggaacccccugagcagaaauuccacacaugagauguacugggugagcaacgcuuccggaaauaucguuucuagcgugaacaugauuucccgcaugcucaucaaccgguucaccaugagacacaaaaaggccacauaugaaccugacgucgaccuuggcucugggacccgcaauauuggaaucgagagcgagacgcccaaccuggauauuaucggcaagcggaucgagaagauuaaggaggaacaugagaccuccuggcacuacgaccaggaucacccguauaaaacaugggcuuaccauggcucuuaugaaaccaagcagacagggagcgccuccagcauggugaauggaguugugagacugcucaccaaaccuugggacguccugcccacagugacccagauggcgaugacggauacaaccccuuuuggccaacagcgcguguucaaggagaaggucgacacccggacacaggagcccaaagaagggacgaagaaacuuaugaagaucaccgccgaguggcuguggaaagaacucggaaagaaaaagacaccuagaauguguacccgcgaggaguuuacaagaaagguucggucuaacgcugcccugggcgcuauuuucaccgaugaaaauaaauggaaguccgcccgcgaggcuguggaagacagcagauuuugggagcugguggauaaagaacggaaccuccaccuggaggggaagugcgagacaugugucuacaauaugaugggaaaaagagaaaagaaacuuggcgaguucggcaaagccaaggggucucgggcgaucugguacauguggcugggagcccgcuuucucgaguucgaggcucugggcuuucuuaacgaagaccauugguucuccagagagaauagccugucugggguggagggagaaggccuccacaaacugggguauauucugcgggauguuuccaagaaagagggcggagccauguacgcugacgacaccgccggcugggauacgcgcaucacccucgaagaccugaagaacgaggaaauggugacaaaucacauggagggggagcauaagaaacuugccgaagcgaucuuuaagcugaccuaucagaacaaagucgugagaguucaacggcccacaccgcgcggaaccgugauggauauuaucagcagacgggaccagcgcggcuccgggcaggucggaacguacggccucaauacauucaccaacauggaggcucaacugauuagacagauggaaggggagggcguguucaagaauauccagcaccuuacaguuaccgaggaagccgccgugcagaacuggcuggcucgggucggacgcgagagacucagccggauggccauuucuggcgaugacugcguggucaaaccucuggaugaccgcuuugcuaacgcccugacggcgcucaaugauauggggaagaucagaaaggacauccaacagugggaacccagcaaaggauggaacgauuggacccaggugcccuucugcucccaucacuuucaugagcugauuaugaaggacggccggguucuuguggucccuuguagaaaucaggaugaacugaucgggcgcgcccggauuucucaaggagcuggcuggagccucagagagacagccugccuggggaaauccuaugcucagauguggucucuuauguacuuccaccgccgggaccugagacucgccgcgaacgccaucuguagcgcugugccgucccacugggugcccaccucucgcacaaccuggagcauucaugccaagcacgaguggaugacaaccgaagacaugcugacgguuuggaaucggguguggaucagagagaacccuuggauggaagauaaaacacccgucgaguccugggaagagauuccuuaucugggcaagcgcgaggaccaguggugcggaagccucaucggccugaccucucgggcuaccugggccaagaauauccaggcugccauuaaccaagugagaucccuuaucgggaaugaagaguacacagauuacaugcccagcaugaaacgcuuucggagagaagaggaagaggcgggaguucugugguga

SEQ ID NO: 19715 - RNA, 9876 nt, Artificial Sequence
  derived and/or modified CDS sequence (opt5) from DENV-2__JF730047__SS-prME
uccgcuggaaugaucauuaugcugauccccacagugauggcuuuccaccucacaacgagaaacggggagccucauaugauugucgggauccaggaaaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccagcacaugggugaccuauggcacguguaccacaaccggggagcacagaagagaaaagcgguccguggcgcucguuccucaugugggaaugggccuggagacacgcaccgaaacguggaugucuuccgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggaguccaaggcuuggcuggugcaccggcagugguuucuugaccugccgcucccuuggcugcccggggccgauaagcagggaagcaacuggauucagaaagagacccuggucacauucaagaauccucaugcuaaaaagcaagacgugguugugcucggcucccaggaaggggccaugcacaccgcccugacgggcgcuacagagauccagaugucuagcggaaaccuucuguuuaccggccaucucaaaugccgccugagaauggacaaacuucaacugaaggggauguccuacagcauguguacaggaaaauucaaggucgugaaagaaauugcggagacccagcacggcaccaucgucauucgggugcaguaugagggggauggaucucccugcaagauccccuucgaaaucauggaccucgagaaaagauacguucugggccgccugauuacagugaauccuaucgucacggaaaaggauuccccggugaacauugaggccgaacccccuuuuggggacagcuacaucauuaucggcguugagcccggacagcucaagcugaacugguucaaaaagggcucuagcauugggcaaauguuugagaccacaaugcggggagcuaaaagaauggccauccuuggcgauaccgccugggacuucgggucccugggaggcguguuuacaucuaucgggaaggcucuccaucaggucuucggcgccauuuauggagcggcuuuuagcggcguguccuggaccaugaaaauccugauuggggugaucauuacguggaucggaaugaauagccgcucuacaucccugagcguuucucuuguccucgugggcaucgugacccuguaccugggggucauggugcaggccgauuccggauguguugugagcuggaagaacaaggaacucaaaugcggcuccgggauuuucaucaccgacaauguccacacauggaccgagcaguauaaguuucaaccugaaucucccagcaaacuggccuccgcuauucagaaggcccaggaggaaggcaucuguggcauucggucugugacaagacuugagaaccugauguggaaacagaucacgccggagcucaaucacauccuggcugaaaacgagguuaagcugaccauuaugacaggcgauaucaaagggauuaugcaagccggaaagcgcagccuucggccucagcccaccgaacucaaguacuccuggaaaacauggggcaaggcgaaaaugcugagcaccgagucucauaaucagacguuccugaucgacgggccugaaaccgccgagugccccaacacaaauagagcuuggaacucccucgagguggaagauuauggauuuggcgucuucaccacaaauauuuggcugaaacuuaaagagaagcaggacgccuuuugugacagcaagcugaugucugcugccaucaaagauaaccgcgcggugcacgccgacaugggcuacuggaucgaauccgcucucaaugauaccuggaagauugagaaagccagcuucaucgagguuaagaacugccauuggccuaaaucucacacacuguggagcaauggggugcuggaauccgagaugauuauccccaagaaccuugcuggaccggucagccaacacaacuaucggccuggcuaccauacccagacggccgggcccuggcaccucggaaagcuggaaauggacuucgauuuuugugacggcacaaccgugauugugaccgaggauugcgggaauagaggacccucucugcgcacaaccacggccuccggcaaacucaucacagaauggugcugucggagcugcacccugccuccgcuuagauaccggggcgaggacggguguugguauggaauggagauucgcccccugaaggaaaaagaggaaaaccucgucaauucccugguuacagcuggccauggacagguggauaacuucucucugggagugcuuggcauggcgcucuuucuggaggaaaugcugagaacccgggucgggacaaagcacgccauccuccugguggcuguuagcuucgugacccuuaucacgggaaauauguccuuuaaagaccugggcagagucgugguuauggugggcaccacaaugaccgaugacauugggaugggagucacauaccucgcccugcuggccgcuuucaaggugcgcccuaccuuugccgcgggccuucugcuccggaagcugacgucuaaagagcucaugaugacaaccaucgggauuguucugcuuagccaauccacaauccccgagaccauucuggaacucaccgaugcucuggcccugggaaugauggugcuuaagaucgucagagacauggagaaauaucagcuggccgugacaaucauggcuauucucugcgugccuaacgccgucauccugcagaaugcguggaagguuucuuguacgauucucgcuguggugagcgucagcccccugcuucugaccagcucucagcagaagacagacuggaucccucucgcccugaccauuaagggccugaaccccacagccaucuuccuuaccacgcugucccgcacaaauaaaaagagaagcuggccgcucaacgaagcuaucauggccguggggaugguuucuauucuggcuuccagccuccugaagaaugauaucccuaugaccggaccccuuguggccggcggccugcugaccgucugcuacgugcucacagggcggucugcggaccuggagcuugaacgcgccaccgauguuaaaugggaggaccaggcugagauuuccggaagcuccccuauccugagcauuacaaucucugaagauggcagcauguccauuaagaacgaggaagaggagcagacgcucaccauccugaucagaacagggcuccuggugauuucuggacuuuuucccgucagcaucccgauuaccgccgcugccugguaucugugggaagugaaaaagcagcgggccggcguccugugggacgugccuucucccccucccauggggaaagcugagcucgaagauggagcguaccgcaucaagcaaaagggcauucugggcuauagccagaucggggccggaguuuacaaagagggcacauuccauaccauguggcacgugacgagaggggcuguccuuaugcacaagggaaaacggaucgaacccagcugggccgacgugaagaaagaucugauuuccuacggcgggggauggaagcucgagggcgaguggaaggaaggcgaggaaguucaggugcuggcccucgagccugggaaaaauccgcgcgcuguccagaccaagcccggacuguuuaaaacaaacaccggcacaaucggggccgugucucuugacuucagcccuggaaccuccggcagccccauuaucgauaagaaagggaaggugguuggacuguauggcaauggcgucgugacaagaucuggggcguacguguccgcuauugcccaaacggaaaagagcaucgaggacaacccugagaucgaagaugacauuuuucggaaacgcagacugaccaucauggaccuccaucccggagccggcaagacaaaacgguaucugccugcuauugucagagaggccaucaagcgcgggcuucggacccugauucucgcgccgaccagagugguugcugccgaaauggaggaagcccugcgcggacuccccauccgguaccagaccccugcuauuagagccgagcacacgggccgcgagaucguggaucugaugugucaugcuaccuucacaaugcggcuucugucucccgucagagugccuaacuauaaucugaucauuauggacgaagcccacuucaccgaucccgcguccaucgccgcucgcggguacauuagcacacggguugagaugggcgaagccgcuggaaucuuuaugaccgccacgccgccuggcuccagagaccccuucccccagucuaacgccccuauuaucgaugaggagcgggaaauccccgagcgcagcuggaauacagggcaugaaugggugaccgacuuuaaaggaaagaccgucugguucgugccuuccauuaaggcuggcaacgauaucgcggccugccuccgcaagaaugggaagaaaguuauucaacugagccggaagacauuugacucugaguaugugaaaacccgcacaaacgauugggacuucgucgugaccacggauaucuccgaaaugggagcuaauuuuaaggccgagagagugauugacccgcggagauguaugaaacccgucauccuuacagacggcgaggaacgcguuauccuggccgggccuaugcccgugacccacagcucugcugcccagcggagaggccgcauuggacggaacccuaagaaugagaacgaucaguacaucuacaugggcgaaccccucgagaaugacgaagauugcgcgcacuggaaggaggcuaaaaugcugcuggacaacauuaauacaccggaggggaucauuccuagcauguucgaacccgagagagaaaagguggaugccaucgacggagaguaucgccuccggggcgaagccagaaaaaccuuugucgaucuuaugcgcagaggggaccugccuguguggcuggcuuacaagguugccgcggagggaauuaacuaugccgaucggcgcugguguuucgacggcaucaaaaauaaccagauccucgaggaaaacguggaggucgaaauuuggacgaaggagggggagagaaagaaacugaagccccgguggcuugaugcucgcaucuacuccgacccucuggcccucaaagaauuuaaggaguucgcugccggcagaaaaucucugacccugaaucucauuacagaaaugggacggcuucccaccuucaugacacaaaagaccagagaugcucuggacaaccuggccgugcuccauacagcggaggccggcgggcgcgcuuauaaucacgcccugagcgaacuuccggagacccuggagacgcuccugcugcucacacuucuggcuaccguuaccggaggcaucuuucuguuccucauguccgggcggggaauuggcaagaugacacugggcaugugcugcaucaucaccgccucuauucuucugugguacgcccagauccagccucauuggauugcugcgagcaucauucucgaauuuuuccugaucgugcugcucauccccgagcccgaaaaacagagaacaccucaagacaaccagcuuacguaugucgugauugccauccugaccgucguggcugccacaauggccaaugagaugggguuucuggaaaagaccaaaaaggaucucggacugggcuccauugcuacacagcagccggagagcaacauccuugacauugaucugcgccccgccucugcguggacccucuacgccguugcuacgaccuucgugacaccuaugcugcggcacuccaucgagaauagcuccgugaacgucucucugaccgccauugcuaaucaagccacaguucucauggggcuuggaaaaggcuggccccugagcaagauggacaucggggugccucugcucgcgaucggauguuacucccaggugaaccccauuacccugacggccgcccuucugcuccuggucgcccacuaugcuaucauuggcccuggccugcaggccaaggcuacaagagaagcccagaaacgggcggccgcugggaucaugaagaauccgaccguggauggaauuacaguuaucgaccucgaucccaucccuuacgaccccaaauuugagaagcaacuuggccaggugaugcugcugauucucugcgucacccaggugcugaugaugcgcaccacaugggcccuuugugaagcucugacgcucgccaccgggccuaucucuacacugugggagggaaaccccggcagauucuggaauaccacaauugccgucagcauggcgaacaucuuucggggguccuaucuggcuggagccggccuccuuuucagcauuaugaaaaauaccacgaacacacgcagaggcaccgggaauaucggagaaacccugggcgagaaguggaaaucucggcugaacgcucucgggaaguccgaguuucaaacauacaagaaaagcggaauccaggaaguggaucgcacccuggccaaggagggcauuaaaagaggggaaacagaccaucacgccguuucucggggauccgcuaaacuucgcugguucguggagagaaacauggucacgccggagggcaaagugguugaucugggcugcgggcggggaggcuggagcuauuacugugggggacucaagaaugugagagaagucaagggccugaccaaagggggaccuggccaugaggaacccauccccaugucuacauauggcuggaaccuggugcgccuccagagcgggguggacgucuuuuucauuccucccgagaagugcgauacccuucugugugacaucggagaauccucuccuaauccgacagucgaggccggccggacccugagagugcucaaccugguggagaauuggcuuaacaauaacacgcaguucugcauuaaaguccugaaucccuacaugccuagcguuaucgaaaagauggaggcgcuccaacgcaaauacgggggagcccuggugcggaacccccuguccagaaauagcacccacgaaauguauuggguguccaacgcuucuggcaauaucgucagcuccgugaacaugauuucucgcaugcucaucaaucgguuuacaaugagacauaagaaggccaccuacgagccugacguugaucuugggagcggaacacgcaacauuggcaucgaauccgagauucccaaccuggacaucauuggcaaacggaucgagaagaucaaacaggaacacgagaccucuuggcacuaugaucaggaccauccguacaagacaugggcuuaucacgggagcuacgaaaccaaacagacgggauccgccagcucuauggugaauggcgucgugagacugcucacaaagccuugggauguucugcccaccgugacccaaauggcgaugacagacacgaccccuuucgggcagcagcgcgucuuuaaggagaaaguggauacacggacccaggaacccaaggagggaaccaagaaacuuaugaaaauuaccgccgaguggcuguggaaggaacucggcaaaaagaagacaccuagaauguguacccgcgaggaguucaucagaaaagugcgguccaacgcugcccugggggcuauuuuuacggacgagaauaaguggaaaagcgcccgcgaggcugucgaagauucuagauucugggagcugguugacaaggaacggaaccuccaucuggagggaaaaugcgaaaccuguguguauaauaugaugggcaagagagagaagaaacuuggcgaguuugggaaggccaaaggaucccgggcgaucugguacauguggcugggcgcccgcuuccucgaauuugaggcucugggguuccuuaacgaagaucacugguuuagcagagaaaauucucuguccggaguggaaggcgaggggcuccacaagcugggcuacauucugcgggacgucagcaaaaaggagggaggcgccauguaugcugacgauacagccgggugggacacccgcaucacacucgaagaucugaagaacgaggaaauggugaccaaucauauggagggagaacacaagaaacuugccgaggcgaucuucaaacugacguaccaaaacaaaguugugagaguccagcggcccacaccgcgcggcaccgugauggacauuaucuccagacgggaucagcgcgggagcggacaaguuggcacauaugggcucaauaccuuuacgaacauggaggcucagcugauuagacagauggaaggcgagggaguguucaaaaauauccagcaucuuaccgccacagaagaggucgccgugaagaacuggcuggcucggguuggccgcgagagacucucucggauggccauuagcggggacgauugcguggucaagccucuggacgaucgcuucgcuaaugcccugaccgcgcucaacgacaugggaaaaaucagaaaggauauccaacagugggaacccuccaaaggcuggaacgacuggacacaggugcccuuuugcucucaccauuuccacgagcugauuaugaaggaugggcggguccuugugguuccuuguagaaaucaggacgaacugaucggacgcgcccggauuagccaaggcgcuggguggucccucagagagaccgccugccugggcaaaucuuacgcucagauguggagccuuauguauuuucaccgccgggaccugagacucgccgcgaacgccaucuguuccgcugugccgucucauuggguccccacaagccgcaccacgugguccauucacgccaagcaugaauggaugacaaccgaggauaugcugaccguguggaaucggguguggaucagagagaacccuuggauggaagacaagacacccguugagagcugggaagagauuccuuaccugggaaaacgcgaagaucaguggugcggcucucucaucgggcugaccucccgggcuacaugggccaagaauauccaggcugccauuaaccaagugagaagccuuaucggaaaugaggaguauacggacuacaugcccucuaugaaacgcuuccggagagaagaggaagaggcgggcguccugugguga

SEQ ID NO: 19716 - RNA, 9876 nt, Artificial Sequence
  derived and/or modified CDS sequence (opt5) from DENV-2__JF730048__SS-prME
agcgcuggaaugaucauuaugcugauccccaccgugauggcuuuccaccucacaacgagaaacggggagccucauaugauugucgggauccaggagaagggcaagucccugcuuuuuaagaccgaggacgggguuaauaugugcacacugauggccauggaucucggagaacugugugaggacaccauuacauacaagugcccgcuucugcggcaaaacgaacccgaggauaucgacuguuggugcaauucuaccuccacaugggugaccuauggcacguguaccacaaccggggagcaccgcagagaaaagcgguccguggcgcucguuccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcgcucugauuuucauccuucugacagccguugcgccuuccaugacgaugagaugcauuggcaucucuaaccgggauuuuguggaaggggucagcggaggcuccuggguggacaucguucucgagcacgggagcugugugaccacaauggccaagaauaagcccacccuggauuucgaacuuauuaaaacagaggcuaagcagccugccacccugcgcaaauauugcaucgaagcuaagcucacgaacacaaccaccgagucuagauguccgacacaaggagagcccucccugaaagaggaacaagacaagcgguuugucugcaagcauagcaugguggaucgcggcuggggcaauggguguggacuguucggcaaagggggaauugugaccugcgccauguuuacaugcaagaaaaacauggaaggcaagaucguccagccugagaaucucgaauacacgauuguugugacaccccacucuggggaggagcaugcggugggaaacgacacaggcaaacacggcaaggaaaucaaagucaccccucaguccagcaucacagaggccgaacugaccggguauggaacggugaccauggaguguucucccagaacaggccuugauuucaaugaaaugguucugcuccaaauggaguccaaggcuuggcuggugcaccggcagugguuucuugaccugccgcucccuuggcugcccggggccgauaagcagggaagcaacuggauucagaaagagacccuggucacauucaagaauccucaugcuaaaaagcaagacgugguugugcucggcucccaggaaggggccaugcacaccgcccugacgggcgcuacagagauccagaugucuagcggaaaccuucuguuuaccggccaucucaaaugccgccugagaauggacaaacuucaacugaaggggauguccuacagcauguguacaggaaaauucaaggucgugaaagaaauugcggagacccagcacggcaccaucgucauucgggugcaguaugagggggauggaucucccugcaagauccccuucgaaaucauggaccucgagaaaagauacguucugggccgccugauuacagugaauccuaucgucacggaaaaggauuccccggugaacauugaggccgaacccccuuuuggggacagcuacaucauuaucggcguugagcccggacagcucaagcugaacugguucaaaaagggcucuagcauugggcaaauguuugagaccacaaugcggggagcuaaaagaauggccauccuuggcgauaccgccugggacuucgggucccugggaggcguguuuacaucuaucgggaaggcucuccaucaggucuucggcgccauuuauggagcggcuuuuagcggcguguccuggaccaugaaaauccugauuggggugaucauuacguggaucggaaugaauagccgcucuacaucccugagcguuucucuuguccucgugggcaucgugacccuguaccugggggucauggugcaggccgauuccggauguguugugagcuggaagaacaaggaacucaaaugcggcuccgggauuuucaucaccgacaauguccacacauggaccgagcaguauaaguuucaaccugaaucucccagcaaacuggccuccgcuauucagaaggcccaggaggaaggcaucuguggcauucggucugugacaagacuugagaaccugauguggaaacagaucacgccggagcucaaucacauccuggcugaaaacgagguuaagcugaccauuaugacaggcgauaucaaagggauuaugcaagccggaaagcgcagccuucggccucagcccaccgaacucaaguacuccuggaaaacauggggcaaggcgaaaaugcugagcaccgagucucauaaucagacguuccugaucgacgggccugaaaccgccgagugccccaacacaaauagagcuuggaacucccucgagguggaagauuauggauuuggcgucuucaccacaaauauuuggcugaaacuuaaagagaagcaggacgccuuuugugacagcaagcugaugucugcugccaucaaagauaaccgcgcggugcacgccgacaugggcuacuggaucgaauccgcucucaaugauaccuggaagauugagaaagccagcuucaucgagguuaagaacugccauuggccuaaaucucacacacuguggagcaauggggugcuggaauccgagaugauuauccccaagaaccuugcuggaccggucagccaacacaacuaucggccuggcuaccauacccagacggccgggcccuggcaccucggaaagcuggaaauggacuucgauuuuugugacggcacaaccgugauugugaccgaggauugcgggaauagaggacccucucugcgcacaaccacggccuccggcaaacucaucacagaauggugcugucggagcugcacccugccuccgcuuagauaccggggcgaggacggguguugguauggaauggagauucgcccccugaaggaaaaagaggaaaaccucgucaauucccugguuacagcuggccauggacagguggauaacuucucucugggagugcuuggcauggcgcucuuucuggaggaaaugcugagaacccgggucgggacaaagcacgccauccuccugguggcuguuagcuucgugacccuuaucacgggaaauauguccuuuaaagaccugggcagagucgugguuauggugggcaccacaaugaccgaugacauugggaugggagucacauaccucgcccugcuggccgcuuucaaggugcgcccuaccuuugccgcgggccuucugcuccggaagcugacgucuaaagagcucaugaugacaaccaucgggauuguucugcuuagccaauccacaauccccgagaccauucuggaacucaccgaugcucuggcccugggaaugauggugcuuaagaucgucagagacauggagaaauaucagcuggccgugacaaucauggcuauucucugcgugccuaacgccgucauccugcagaaugcguggaagguuucuuguacgauucucgcuguggugagcgucagcccccugcuucugaccagcucucagcagaagacagacuggaucccucucgcccugaccauuaagggccugaaccccacagccaucuuccuuaccacgcugucccgcacaaauaaaaagagaagcuggccgcucaacgaagcuaucauggccguggggaugguuucuauucuggcuuccagccuccugaagaaugauaucccuaugaccggaccccuuguggccggcggccugcugaccgucugcuacgugcucacagggcggucugcggaccuggagcuugaacgcgccaccgauguuaaaugggaggaccaggcugagauuuccggaagcuccccuauccugagcauuacaaucucugaagauggcagcauguccauuaagaacgaggaagaggagcagacgcucaccauccugaucagaacagggcuccuggugauuucuggacuuuuucccgucagcaucccgauuaccgccgcugccugguaucugugggaagugaaaaagcagcgggccggcguccugugggacgugccuucucccccucccauggggaaagcugagcucgaagauggagcguaccgcaucaagcaaaagggcauucugggcuauagccagaucggggccggaguuuacaaagagggcacauuccauaccauguggcacgugacgagaggggcuguccuuaugcacaagggaaaacggaucgaacccagcugggccgacgugaagaaagaucugauuuccuacggcgggggauggaagcucgagggcgaguggaaggaaggcgaggaaguucaggugcuggcccucgagccugggaaaaauccgcgcgcuguccagaccaagcccggacuguuuaaaacaaacaccggcacaaucggggccgugucucuugacuucagcccuggaaccuccggcagccccauuaucgauaagaaagggaaggugguuggacuguauggcaauggcgucgugacaagaucuggggcguacguguccgcuauugcccaaacggaaaagagcaucgaggacaacccugagaucgaagaugacauuuuucggaaacgcagacugaccaucauggaccuccaucccggagccggcaagacaaaacgguaucugccugcuauugucagagaggccaucaagcgcgggcuucggacccugauucucgcgccgaccagagugguugcugccgaaauggaggaagcccugcgcggacuccccauccgguaccagaccccugcuauuagagccgagcacacgggccgcgagaucguggaucugaugugucaugcuaccuucacaaugcggcuucugucucccgucagagugccuaacuauaaucugaucauuauggacgaagcccacuucaccgaucccgcguccaucgccgcucgcggguacauuagcacacggguugagaugggcgaagccgcuggaaucuuuaugaccgccacgccgccuggcuccagagacucuuucccccagagcaacgcccccauuaucgaugaggagcgggaaaucccugagcgcuccuggaauacagggcaugaaugggugaccgacuuuaaaggaaagaccgucugguucgugcccagcauuaaggcuggcaacgauaucgcggccugccuccgcaagaaugggaagaaaguuauucaacugucucggaagacauuugacuccgaguaugugaaaacccgcacaaacgauugggacuucgucgugaccacggauaucagcgaaaugggagcuaauuuuaaggccgagagagugauugacccucggagauguaugaaaccggucauccuuacagacggcgaggaacgcguuauccuggccgggcccaugccugugacccacucuagcgcugcccagcggagaggccgcauuggacggaaccccaagaaugagaacgaucaguacaucuacaugggcgaaccucucgagaaugacgaagauugcgcgcacuggaaggaggcuaaaaugcugcuggacaacauuaauacacccgaggggaucauuccguccauguucgaaccugagagagaaaagguggaugccaucgacggagaguaucgccuccggggcgaagccagaaaaaccuuugucgaucuuaugcgcagaggggaccugcccguguggcuggcuuacaagguugccgcggagggaauuaacuaugccgaucggcgcugguguuucgacggcaucaaaaauaaccagauccucgaggaaaacguggaggucgaaauuuggacgaaggagggggagagaaagaaacugaagccucgguggcuugaugcucgcaucuacucugacccccuggcccucaaagaauuuaaggaguucgcugccggcagaaaaagccugacccugaaucucauuacagaaaugggacggcuuccuaccuucaugacacaaaagaccagagaugcucuggacaaccuggccgugcuccauacagcggaggccggcgggcgcgcuuauaaucacgcccuguccgaacuucccgagacccuggagacgcuccugcugcucacacuucuggcuaccguuaccggaggcaucuuucuguuccucaugucugggcggggaauuggcaagaugacacugggcaugugcugcaucaucaccgccagcauucuucugugguacgcccagauccagccgcauuggauugcugcguccaucauucucgaauuuuuccugaucgugcugcucaucccugagcccgaaaaacagagaacaccccaagacaaccagcuuacguaugucgugauugccauccugaccgucguggcugccacaauggccaaugagaugggguuucuggaaaagaccaaaaaggaucucggacugggcagcauugcuacacagcagccugagucuaacauccuugacauugaucugcgcccggccuccgcguggacccucuacgccguugcuacgaccuucgugacacccaugcugcggcacagcaucgaaaauuccucugugaacgucagccugaccgccauugcuaaucaagccacaguucucauggggcuuggaaaaggcuggccucuguccaagauggacaucggggugccccugcucgcgaucggauguuacucucaggugaacccuauuacccugacggccgcccuucugcuccuggucgcccacuaugcuaucauuggccccggccugcaggccaaggcuacaagagaagcccagaaacgggcggccgcugggaucaugaagaauccuaccguggauggaauuacaguuaucgaccucgauccgauccccuacgacccuaaauuugagaagcaacuuggccaggugaugcugcugauucucugcgucacccaggugcugaugaugcgcaccacaugggcccuuugugaagcucugacgcucgccaccgggcccaucagcacacugugggagggaaacccuggcagauucuggaauaccacaauugccgucuccauggcgaacaucuuucgggggagcuaucuggcuggagccggccuccuuuucucuauuaugaaaaauaccacgaacacacgcagaggcaccgggaauaucggagaaacccugggcgagaaguggaaaucccggcugaacgcucucgggaaguccgaguuucaaacauacaagaaaucuggaauccaggaaguggaucgcacccuggccaaggagggcauuaaaagaggggaaacagaccaucacgccguuucccggggaagcgcuaaacuucgcugguucguggagagaaacauggucacgcccgagggcaaagugguugaucugggcugcgggcggggaggcuggucuuauuacugugggggacucaagaaugugagagaagucaagggccugaccaaagggggaccgggccaugaggaaccuauccccaugagcacauauggcuggaaccuggugcgccuccaguccgggguggacgucuuuuucauucccccugagaagugcgauacccuucugugugacaucggagaaucuagccccaauccuacagucgaggccggccggacccugagagugcucaaccugguggagaauuggcuuaacaauaacacgcaguucugcauuaaaguccugaauccguacaugcccuccguuaucgaaaagauggaggcgcuccaacgcaaauacgggggagcccuggugcggaacccucugagcagaaauuccacccacgaaauguauugggugucuaacgcuagcggcaauaucgucuccucugugaacaugauuagccgcaugcucaucaaucgguuuacaaugagacauaagaaggccaccuacgagcccgacguugaucuuggguccggaacacgcaacauuggcaucgaaucugagauuccuaaccuggacaucauuggcaaacggaucgagaagaucaaacaggaacacgagaccagcuggcacuaugaucaggaccaucccuacaagacaugggcuuaucacggguccuacgaaaccaaacagacgggaagcgccucuuccauggugaauggcgucgugagacugcucacaaagccgugggauguucugccuaccgugacccaaauggcgaugacagacacgacccccuucgggcagcagcgcgucuuuaaggagaaaguggauacacggacccaggaaccuaaggagggaaccaagaaacuuaugaaaauuaccgccgaguggcuguggaaggaacucggcaaaaagaagacacccagaauguguacccgcgaggaguucacgagaaaagugcggagcaacgcugcccugggggcuaucuuuaccgacgagaauaaguggaaaucugcccgcgaggcugucgaagauuccagauucugggagcugguugacaaggaacggaaccuccaucuggagggaaaaugcgaaacauguguguauaauaugaugggcaagagagagaagaaacuuggcgaguuugggaaggccaaaggaagccgggcgauuugguacauguggcugggcgcccgcuuccucgaauuugaggcucugggguuccuuaacgaagaucacugguuuucuagagaaaauucccugagcggaguggaaggcgaggggcuccacaagcugggcuacauccugcgggacgucuccaaaaaggagggaggcgccauguaugcugacgauaccgccgggugggacacacgcauuacccucgaagaucugaagaacgaggaaauggugacgaaucauauggagggagaacacaagaaacuugccgaggcgaucuucaaacugacauaccaaaacaaaguugugagaguccagcggccuacacccagaggcacagugauggacaucauuagcagacgggaucagcgcgggucuggacaaguuggcaccuaugggcucaauacguuuaccaacauggaggcucagcugaucagacagauggaaggcgagggaguguucaaaaauauucagcaucuuacagccaccgaagaggucgccgugaagaacuggcuggcucggguuggccgcgagagacucagccggauggccaucuccggggacgauugcguggucaagccgcuggacgaucgcuucgcuaaugcccugacagcgcucaacgacaugggaaaaauuagaaaggauauccaacagugggaaccuucuaaaggcuggaacgacuggacccaggugcccuuuugcagccaccauuuccacgagcugaucaugaaggaugggcggguccuugugguucccuguagaaaucaggacgaacugauuggacgcgcccggaucucccaaggcgcuggguggucucucagagagacagccugccugggcaaaagcuacgcucagauguggucccuuauguauuuucaccgccgggaccugagacucgccgcgaacgccauuuguucugcugugccuagccauugggucccgaccucccgcacgacauggagcauccacgccaagcaugaauggaugaccaccgaggauaugcugacaguguggaaucggguguggauuagagagaaccccuggauggaagacaagaccccuguugagucuugggaagagauccccuaccugggaaaacgcgaagaucaguggugcggcucccucauugggcugacaagccgggcuacgugggccaagaauauccaggcugccaucaaccaagugagaucucuuauuggaaaugaggaguauaccgacuacaugccuuccaugaaacgcuuccggagagaagaggaagaggcgggcguccugugguga

SEQ ID NO: 19717 - RNA, 9876 nt, Artificial Sequence
  derived and/or modified CDS sequence (opt5) from DENV-2__KF955402__SS-prME
agcgccggcaugaucauuaugcugauccccaccgugauggcuuuccaccugacaacgcggaauggggagccucauaugauugugggaauccaggaaaagggcaagagccugcuuuuuaagaccgaggacgggguuaauaugugcacacugauggccauggaucucggagaacugugugaggacaccauuacauacaaaugcccgcuucugcggcaaaacgaacccgaggauaucgacuguuggugcaauucuaccagcacaugggugaccuauggcacguguaccacaaccggggagcaccgcagagaaaagcgguccguggcgcucgucccucaugugggaaugggccuggagacacgcaccgaaacguggaugucuagcgagggcgcuuggaaacacgcccagagaaucgagacauggauucugcggcaucccggguucaccaucauggccgcuauucucgccuacacaaucggaaccacccacuuucagcgcguucugauuuucauccuucugacagcuguggccccuuccaugacgaugagaugcauuggcaucucuaaccgggucuuuguggaagggguuagcggaggcuccuggguggauaucguccucgagcacgggagcugugugaccacaauggcgaagaauaagcccacccuggacuucgaacuuauuaaaacagaggccaagcagccugcuacccugcgcaaauauugcaucgaagccaagcucacgaacacaaccaccgagucuagauguccgacacaaggagagcccucccugaaagaggaacaagauaagcgguuugugugcaagcauagcauggucgaccgcggcuggggcaauggguguggacuguucggcaaagggggaauuguuaccugcgcuauguuuacaugcaagaaaaacauggaaggcaagaucgugcagccugagaaucucgaauacacgauuguggucacaccccacucuggggaggagcaugccgugggaaacgauacaggcaaacacggcauggaaaucaagguuaccccucaguccagcaucacagaggcggaacugaccggguauggaacggugaccauggaguguucucccagaacaggccuugacuucaaugaaaugguccugcuccaaauggagaacaaagccuggcuggugcaccggcagugguuucuugaucugccgcucccuuggcugcccggggcugacaagcaggaguccaauuggauucagaaggaaacccugguuacauucaaaaacccucaugccaagaaacaagauguggucgugcucggaagccaggagggcgcuaugcacaccgcccugacgggggccacagaaauccagauguccucuggcaaucuucuguuuaccggacaucucaagugccgccugagaauggacaaacuucaacugaagggcaugagcuacuccauguguacagggaaguucaaagucgugaaggagauugcugagacccagcacggaaccaucguuauucgggugcaguaugaaggcgacgggagccccugcaaaauccccuucgagaucauggaucucgaaaagagauacguccugggacgccugauuacagugaacccuaucguuacggagaaagacucuccggugaacauugaagcggagcccccuuuuggcgauuccuacaucauuaucggggucgagcccggccagcucaagcugaauugguucaagaaaggaagcucuauuggccaaauguuugaaaccacaaugagaggggcuaagagaauggcuauccuuggagacaccgccugggauuucggcagccucggcgggguguuuacauccaucgggaaagcccuccaucagguguucggggcuauuuauggcguugccuuuucuggagucagcuggaccaugaagauccugauuggcgugaucauuacguggaucgggaugaacucccgcagcacaucucuguccgugagccuuguccucgugggaaucguuacccuguaccugggcgugaugguccaggcggacucugggugugugguuuccuggaaaaauaaggagcucaagugcggaagcggcauuuucaucaccgauaacgugcacacauggaccgaacaguauaaauuucaaccugagucccccucuaagcuggcuagcgccauucagaaagcccaggaagaggggaucuguggcauucgguccgucacaagacuugagaaucugauguggaagcagaucacgccggaacucaaccacauccuggcugagaaugaagugaaacugaccauuaugacaggagacaucaagggcauuaugcaagccgggaaacgcucucuucggccucagcccaccgagcucaaguacagcuggaagacauggggaaaagcuaagaugcuguccaccgaaagcuauaaccagacguuccugaucgauggcccugagaccgccgagugccccaauacaaacagagcguggaacucucucgaaguugaggacuacggguuuggaguguucaccacaaacauuuggcugaaacuuaaggaaaaacaggaugccuuuugugacuccaagcugaugagcgcugccaucaaggacaaucgcgcuguccaugccgauaugggcuauuggaucgagucugcgcucaacgacaccuggaaaauugagaaggccuccuucaucgaagugaaaaauugccacuggccuaagagccauacacuguggucuaacggcgugcuggagagcgaaaugauuauccccaaaaaccuugcugggccggucucccaacacaauuaccggccuggauaccacacccagauugccggccccuggcaucucgggaagcuggagauggauuucgacuuuugugauggaacgacaguuaucgugaccgaagacugcggcaacagagggcccagccugcgcaccacaaccgcuucuggaaagcucauuacggaguggugcugucgguccugcacacugccuccgcuuagauaucggggcgaggauggcuguugguacgggauggaaauccgcccccugaaagagaaggaagagaaucucgugaacagccuggucaccgccggacacggccagguggacaauuucucccuggggguucuuggaauggcccucuuucuggaagagaugcugagaacacgggugggcaccaaacaugcuauccuccuggucgcggugucuuucguuacacuuauuaccgggaacaugagcuuuaaggaucugggaagaguggucgugaugguuggcgccacgauggcugacgauaucggcaugggggugaccuaucucgcccugcuggccgcuuucaaaguccgcccuacauuugccgcgggacuucugcuccggaagcugaccuccaaggagcucaugaugacaaccauuggcaucgugcugcuuucucaaagcacgauucccgaaacagugcuggagcucaccgacgcucuggcccuggggaugaugguccuuaaaaucguuagaaauauggaaaaguaccagcuggccgugacaaucauggcuauucucugcgugccuaacgccgucauccugcagaaugcguggaaaguguccuguaccauucucgcuguugugucugucagcccccugcuucugaccuccagccagcaaaagacagauuggaucccucucgcccugacgauuaaaggacugaaccccaccgccaucuuccuuacaacccugucucgcacaaauaagaaaagauccuggccgcucaacgaggcuaucauggccgugggcaugguuagcauucuggcuucuucccuccugaagaaugacaucccuaugaccgggccccuuguggccggaggccugcugacggucugcuaugugcucacaggccggagcgcggaccuggaacuugagcgcgccaccgaugucaagugggaggaccaggcugaaauuucuggguccagcccuauccuguccauuaccaucagcgaggauggaucuaugagcauuaaaaacgaagaggaggaacagacacucaccauccugaucagaacaggccuccuggugauuuccgggcuuuuucccaucucuauuccgaucacggccgcugccugguaccugugggagguuaagaaacagcgggccggagugcugugggacgucccuucucccccucccaugggcaaggcugaacucgaggauggggcguaucgcauuaaacaaaagggaauccugggcuacucccagaucggcgccgggguguacaaggaaggaaccuuccacacaauguggcauguuaccagaggcgcugugcuuaugcacaaagggaagcggauugagcccuccugggccgacgucaaaaaggaucugaucagcuauggaggcggguggaaacucgagggagaauggaaggagggcgaagagguccaggugcuggcccucgaaccuggcaagaauccgcgcgcuguucagacaaaacccgggcuguuuaagaccaacacgggaaccauuggcgccgucucccuugacuucucuccugggacaagcggaucccccaucauugauaaaaagggcaaagugguggggcuguacggaaacggcgucgugaccagaagcggcgcguauguuucugcuaucgcccaaacagagaaguccaucgaggacaauccugaaauugaggaugacaucuuucggaagcgcagacugaccauuauggaucuccaccccggggccggaaaaacaaagcgguaccugccugcuaucgugagagaagccauuaaacgcggccuucggacgcugauccucgcgccgaccagagucguggcugccgagauggaagaggcccugcgcgggcuccccauucgguaucagaccccugcuaucagagccgagcauaccggacgcgaaaucguugaccugaugugucacgcuaccuucacaaugcggcuucugagccccgugagagucccuaacuacaaucugauuaucauggacgaggcccauuucacggaucccgcgucuauugccgcucgcggcuauaucuccacccggguggaaaugggggaggccgcuggcauuuuuaugacagccaccccgccuggaagcagagaccccuucccccaguccaacgccccuaucaucgaugaggaacgggagauucccgaacgcucuuggaauagcggccacgaguggguuacagacuuuaaggggaaaaccgugugguucgucccuuccaucaaggcuggaaacgauauugcggccugccucagaaagaauggcaaaaaggugauccaacugagccggaaaacguuugacucugaauacgugaagacacgcaccaacgauugggacuucgucguuaccacagauauuuccgagaugggggcuaauuuuaaagccgagagagugaucgacccgcggagauguaugaagcccgugauccuuaccgauggagaggaacgcgucauucuggccggcccuaugcccgugacacauagcucugcugcccagcggagagggcgcaucggccggaacccuaaaaaugaaaacgaccaguacauuuauaugggagagccccucgaaaaugacgaggauugcgcgcacuggaaggaggcuaagaugcugcuggacaacaucaauaccccggaaggcauuaucccuagcauguucgagcccgaaagagagaaaguugaugccauugacggggaauaccgccuccggggagaggccagaaagacguuuguggaucuuaugcgcagaggcgaccugccugucuggcuggcuuauaaaguggccgcggaggggaucaacuacgccgaucggcgcugguguuucgacggaaucaagaacaaucagauucucgaagagaacguugaaguggagaucuggacaaaagagggcgaaagaaagaagcugaaaccccgguggcuugaugcucgcauuuauuccgacccucuggcccucaaggaguuuaaagaguucgcugccgggagaaagucucugacccugaaucucaucacagagaugggccggcuucccaccuucaugacgcagaagaccagagaugcucuggacaaccuggccguccuccacacagcggaagccggaggccgcgcuuacaaucaugcccugagcgagcuuccggagacccuggaaacacuccugcugcucacccuucuggcuacagugaccgggggaauuuuucuguuccucauguccggccgggggaucggaaagaugacgcugggcaugugcugcaucauuacagccucuauccuucugugguaugcccagauucagccucacuggaucgcugcgagcauuauccucgaguuuuuccugaucguccugcucauucccgaacccgagaagcagagaaccccucaagauaaccagcuuaccuacgugguuaucgccauucugacagugguggcugccaccauggccaaugaaaugggcuuucuggagaaaacaaagaaagaccucgggcugggauccaucgcuacgcagcagccggagagcaacauucuugacaucgaucugcgccccgccucugcguggacccucuacgccgucgcuacaaccuucguuacaccuaugcugcggcauuccauugaaaauagcuccgugaacgugucucugaccgccaucgcuaaucaagccacgguccucaugggccuugggaagggauggccccugagcaaaauggacaucggcgugccucugcucgcgauuggguguuauucccagguuaaccccaucacccugacagccgcccuucugcuccugguggcccacuacgcuauuaucggaccuggccugcaggccaaggcuaccagagaggcccagaagcgggcggccgcuggcauuaugaaaaauccgacagucgaugggaucaccgugaucgaccucgaucccauuccuuaugaccccaaguuugaaaaacaacuuggacaggucaugcugcugauccucugcgugacgcagguucugaugaugcgcacaaccugggcccuuugugaggcucugacacucgccaccggcccuauuucuacccugugggaagggaaccccggaagauucuggaauacaacgaucgccgugagcauggcgaacauuuuucggggcuccuaccuggcuggggccggacuccuuuucagcaucaugaagaauaccacaaacacccgcagaggcacaggcaacaucggggagacccugggagagaaauggaagucucggcugaaugcucucggcaaauccgaauuucaaauuuauaaaaagagcgggauccaggaggucgaucgcacgcuggccaaagaaggaauuaagagaggcgagacagaccaccaugccgugucucggggguccgcuaaacuucgcugguucguugagagaaacauggugaccccggaaggaaaggucguggaucugggcugcggcagagggggauggagcuacuauuguggcgggcucaaaaaugugcgggagguuaagggacugaccaagggcgggccuggacacgaagaacccauccccaugucuacauacggcuggaaccugguccgccuccagagcggcguggacguguuuuucauuccucccgaaaaaugcgauacccuucugugugacaucggggaguccucuccuaauccgacagucgaggccggacggacgcugagaguucucaaccugguggaaaauuggcuuaacaauaacacccaguucugcaucaaggugcugaaucccuacaugccuagcgucauugagaaaauggaagcgcuccaacgcaaguauggcggggcccuggugcggaacccccuguccagaaauagcacacaugagauguacuggguuuccaacgcuucuggaaauaucgugagcuccgucaacaugauuucucgcaugcucaucaaccgguuuaccaugagacacaaaaaggccacauaugaaccugauguggaccuuggcagcgggacccgcaauauuggaaucgaguccgagacgcccaaccuggacauuaucggcaagcggaucgagaagauuaaggaggaacaugagaccucuuggcacuacgaucaggaccacccguauaaaacaugggcuuaccauggcagcuaugaaaccaagcagacaggguccgccagcucuaugguuaauggaguggucagacugcucaccaaaccuugggaugugcugcccacagugacccagauggcgaugacggacacaaccccuuucggccaacagcgcgucuuuaaggagaagguugauacccggacacaggagcccaaagaagggacgaagaaacuuaugaagaucaccgccgaguggcuguggaaagaacucggaaagaaaaagacaccuagaauguguacccgcgaggaguucacaagaaaggugcgguccaacgcugcccugggcgcuauuuuuaccgacgaaaauaaauggaaaagcgcccgcgaggcuguggaagauucuagauucugggagcuggucgacaaagaacggaaccuccaccuggaggggaagugcgagacauguguguacaauaugaugggaaaaagagaaaagaaacuuggcgaguuuggcaaagccaaggggucccgggcgaucugguacauguggcugggagcccgcuuccucgaauuugaggcucugggcuuccuuaacgaagaucauugguuuagcagagaaaauucucuguccgggguugagggagaaggccuccacaaacugggguauauucugcgggacgugagcaagaaagagggcggagccauguacgcugaugacaccgccggcugggacacgcgcaucacccucgaagaucugaagaacgaggaaauggucacaaaucacauggagggggagcauaagaaacuugccgaagcgaucuucaagcugaccuaucagaacaaagugguuagagugcaacggcccacaccgcgcggaaccgucauggacauuaucuccagacgggaucagcgcggcagcggacaggugggaacguacggccucaauacauuuaccaacauggaggcucaacugauuagacagauggaaggggagggcguuuucaagaauauccagcaccuuacagugaccgaggaagccgccguccagaacuggcuggcucgggugggacgcgagagacucucucggauggccauuagcggcgacgauugcgucgugaaaccucuggacgaucgcuucgcuaacgcccugacggcgcucaaugacauggggaagaucagaaaggauauccaacagugggaacccuccaaaggauggaacgacuggacccagguucccuuuugcucucaucacuuccaugagcugauuaugaaggauggccgggugcuugucgugccuuguagaaaucaggacgaacugaucgggcgcgcccggauuagccaaggagcuggcuggucccucagagagacagccugccuggggaaaucuuaugcucagauguggagccuuauguacuuucaccgccgggaucugagacucgccgcgaacgccaucuguuccgcugugccgucucacuggguucccaccagccgcacaaccugguccauucaugccaagcacgaguggaugacaaccgaagacaugcugacgguguggaaucgggucuggaucagagagaacccuuggauggaagacaaaacacccguggagagcugggaagagauuccuuaucugggcaagcgcgaggaucaguggugcggaucucucaucggccugaccucccgggcuaccugggccaagaauauccaggcugccauuaaccaaguuagaagccuuaucgggaaugaagaguacacagacuacaugcccucuaugaaacgcuuccggagagaagaggaagaggcgggagugcugugguga

SEQ ID NO: 19718 - RNA, 9876 nt, Artificial Sequence
  derived and/or modified CDS sequence (opt5) from DENV-2__FJ898460__SS-prME
acagccggcgugaucgucaugcugauucccacagcuaucgccuuccaccucacgacccggaauggggagccucauaugauuguuggacggcaggaaaagggcaagagccugcuuuuuaagacagaggacggggugaauaugugcacccugauggcgaucgaucucggagaacugugugaggacacaauuaccuacaaaugcccgcuucugcgccaaaaugaacccgaggauaucgacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauucugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacaucguccucgagcacggguccugugugacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaagggggaaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaaucaagauuacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgaucgugauuagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucaucggcguggagcccggacagcucaaacugaauugguucaagaagggcuccagcauugggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuaacggcgucuccuggaccaugaaaauucugaucggggugaucauuaccuggaucggaaugaacucucggagcacaucccugagcgugucucuuguucucgucggcguggugacccuguaucugggggccaugguccaggccgacuccggaugugugguuagcuggaagaacaaagaacucaagugcggcucugggauuuucaucacagauaaugugcacacguggaccgagcaguacaaguuucaaccugaaucccccagcaaacuggcuuccgccauucagaaggcucaugaggaaggcaucuguggaaucagaucugucacacgccuugagaaccugauguggaaacagauuaccccggagcucaaucacauccugagcgaaaacgaggugaagcugacaauuaugaccggcgacaucaaagggauuaugcaggccggaaagcggucccuuagaccucaacccacggaacucaaauauucuuggaagaccuggggcaaggcgaaaaugcugagcacagagucccauaaucagaccuuccugaucgaugggccugaaacagccgagugccccaacaccaaucgcgcuuggaacagccucgagguugaagacuacggauuuggcguguucucuacaaauaucuggcugaaacuucgggagaaacaggacgucuuuugugauuccaagcugaugagcgccgcuauuaaagacaacagagccgugcacgcggauaugggcuauuggaucgaaucugcccucaaugacaccuggaagauggagaaggcuuccuucauugagguuaaaagcugccacuggccuaagucucauacgcuguggagcaacggggugcuggaauccgagaugaucauucccaagagcuucgccggaccggucucucagcacaacuaccgcccuggcuaucauacacaaaccgcugggcccuggcaccuuggaaagcucgaaauggauuuugacuucugugagggcaccacagugguggucaccgaagauugcgggaaucggggacccucccugagaacgacaaccgccagcggcaaacugaucacagaguggugcugucgguccugcacccucccuccgcugcgcuacagaggcgaggacggguguugguacggaauggaaauucggccccuuaaggagaaggaagagaaccugguuaauucucucgugacagccggccaugggcagaucgauaacuuuagccugggagugcugggcauggcucuuuuccucgaagagaugcugagaacccgcgucgggacgaaacacgcgauccugcucguggccguuuccuuugugacccugauuacaggaaauaugucuuuccgggaccuuggcagagucauggugaugguuggcgcuaccaugacagaugacaucgggaugggagugaccuaucuggcccuccuggccgcuuuuaagguccgcccuacguucgccgcgggccugcuucugagaaaacucacaagcaaggagcugaugauggcuaccauugggaucgcccuccugucccagucuacaaugcccgaaaccauucuugagcugaccgaugcccucgcucugggaaugauggugcugaaaaucguucggaacauggaaaaguaccaacuugccgugacaaucauggcgauuagcugcgucccuaaugcugugauccugcagaacgccuggaagguguccuguacgauucucgccgcugucagcguuucuccccugcuccugaccuccagccagcagaaagccgacuggaucccucuugcucugacaauuaagggccucaaucccaccgccaucuuucugacaacccugucucgcacguccaaaaagagaagcuggccgcuuaacgaggcgaucauggccguggggauggugucuauucuggcuuccagccuccugaaaaaugacaucccuaugacaggaccccucgucgccggcggccugcuuaccgugugcuauguucugaccgggcgguccgcugaucuggaacucgagcgcgccgccgacgugaagugggaggaucaagcugaaauuagcggaucuagcccuauccuguccauuacaaucucugaggacggcagcauguccauuaaaaacgaagaggaggaacagacccuuacaauccugaucagaacggggcuccuggucauuucuggaguguuccccguuagcaucccgauuaccgcggccgcuugguaccucugggaggugaagaagcagcgggccggcguccugugggaugugccuucucccccucccgucgggaaagccgaacuugaggacggagcuuaucgcaucaagcagagaggcauucugggcuacagccaaaucggggccggaguguauaaagaaggcacauuucacaccauguggcauguuacaagaggggcggugcugaugcaccgcggaaagagaaucgagcccagcugggcugaugucaaaaaggaccucauuuccuacggcgggggauggaagcuggagggcgaauggaaagagggcgaagaggugcagguucuugcccuggaaccugggaagaauccgcgggccgugcagaccaaacccggaaucuucaagacgaacaccggcacaauuggggcugucagccucgauuuuucuccuggaaccuccggcagccccaucguggacagaaaagggaaggugguuggacuguacggcaauggcgucgugacacgcucuggggccuauguguccgcgauugcucagaccgaaaaguccaucgaggauaacccugaaaucgaggacgauauuuuccggaaaaagagacucacaaucauggaccugcaucccggagccggcaaaacgaagcgcuaccuuccugccauuguccgggaagcuaucaaaagagggcugcgcacccugauucucgccccgacacgggugguugcugccgagauggaagaggcgcugagaggacuucccauccgcuaucaaaccccugccauucgggcugagcacaccggcagagaaaucguggaccugaugugucaugccacauucacgaugcggcuccugucccccguccgcgugccuaacuacaaucucaucauuauggaugaggcucacuuuaccgaccccgccucuaucgccgcuagaggguauauuagcacacggguugaaaugggcgaggcggccggaaucuucaugaccgcuacaccgccuggcucccgcgaucccuuuccccagagcaacgccccuauuauggacgaggaaagagagauccccgaacggucuuggaacuccgggcacgagugggugaccgauuucaagggaaagacggucugguuugugccuagcaucaaagccggcaacgacauugcugccugccugagaaagaaugggaaaaagguuauccagcuuucucgcaaaacauucgauagcgaauacgugaagacccgggcgaacgacugggauuuugucgugaccacagacauuuccgagaugggagcuaauuucaaggccgagagagugaucgauccgcgccgguguaugaaacccgucauucugaccgacggcgaagagagaguuauccuggccgggccuaugcccgugacacauucuagcgcugcccaacgccggggcagaaucggacgcaacccuaagaaugaaaacgaccaguauauuuacaugggcgagccccucgaaaaugaugaggacugcgcgcacuggaaagaggccaagaugcugcuugauaacaucaauaccccggaagggauuaucccuuccauguuugagcccgaaagagagaaaguggacgcuauugauggagaauaccggcugcgcggcgaggccagaaagacguucgucgaccucaugcggcgcggggaucugccuguguggcuggcuuauaaaguugccgcugagggaaucaacuacgccgacagaaagugguguuuugauggcauuaagaauaaccagauccucgaagagaacguggaagucgagaucuggacaaaagagggggaacggaagaaacuuaagcccagauggcuggacgcgcgcauuuauucugauccucuggcccucaaagaguucaaggaguucgcugccggcagaaagagccugacccuuaaucugaucacagagaugggaagacuccccaccuuuaugacgcagaaagcucgcaacgcccuggacaaucuggccgugcuccauaccgcugaagcgggcgggcgggccuacaaccacgcucuuuccgagcugccggagacacuggaaacccuccugcuucugacacuccuggccaccguuacaggaggcauuuuccuguuucucaugagcgggaagggaaucggcaaaaugacccuuggcaugugcugcauuaucacggccucuauccugcugugguaugcucaaauucagccucacuggaucgccgcguccauuauccucgaguucuuucugauugugcuucugauccccgaacccgagaagcagagaacaccucaggauaaucaacucaccuacgucgugaucgccauucugaccgucguggcugccacaauggcuaacgaaaugggguuccuggagaaaaccaagaaggaccucggacuuggcagcaucacaacgcaggaguccgaaucuaauauucuggacaucgaucugcggccggccagcgcguggacccucuaugccguugcuacaaccuuugugacacccaugcugcgccauuccauugagaacucuagcgugaaugucucccuuaccgccaucgcuaaccaggccacgguucugauggggcucggaaaaggcuggccucugagcaagauggacauuggggugccccugcucgcuaucggauguuacucucaggugaauccuaucacccuuacagccgcgcugcugcuccuggucgcccacuacgcuauuaucggccccggccuucaagccaaagcuaccagagaagcccagaagcgggccgcggcugggauuaugaaaaacccuacaguggauggaaucaccguuauugaccuggagccgauccccuaugauccuaaguucgaaaagcagcucggccaggugaugcugcugauccucugcgucacgcaagugcuuaugaugcgcacaaccugggcccugugugaggcucugacacucgccaccgggcccauuuccacccugugggagggaaauccuggcagauuuuggaacacaacgaucgccgucagcauggcuaauauuuuccgggggucuuaccuugccggagcgggccugcucuuuuccaucaugaaaaacaccacaaauacccgcagaggcacagggaacauuggagaaacccugggcgagaaguggaaaagccggcugaacgcccucgggaagucugaguuccagaucuauaaaaagagcggaauccaggagguggaccgcacgcuugcuaaagagggcauuaagagaggggaaacagaucaucacgccguuucccggggaucugcuaagcugagaugguuuguggagcgcaauauggucacccccgaaggcaaagugguugaccugggcugcgggcggggaggcuggagcuacuauugugggggacucaagaacgugagagaggucaaaggccugaccaaagggggaccgggccaugaagaaccugugcccauguccacauacggcuggaaucuugugcgccugcaaagcgggguugaugucuucuucacacccccugagaaaugcgacacccuccugugugauaucggagaauccucucccaacccuacgauugaggccggccggacccugagagugcucaaucuuguggaaaacuggcugaauaacaauacacaguuuugcaucaagguccugaacccguauaugcccagcguuauugagaagauggaaacccuccagcgcaaauacgggggagcgcuggugcggaauccucuuuccagaaacucuacacacgagauguacugggugagcaaugccaccggcaacaucgucuccucugugaauaugaucagccgcaugcugauuaaccgguucacgaugaagcacaaaaaggcuaccuaugagcccgacguugaucucggguccggaacaagaaacaucggcauugaaagcgagaccccuaaucuggacaucauuggcaaacgcaucgaaaagauuaagcaggagcaugaaacaucuuggcacuacgaccaagaucaucccuauaaaaccugggccuaccacggguccuaugagacaaagcagaccggaagcgcuucuuccauggugaacggcgucgugcggcugcucacgaaaccgugggacguugugccuauggucacacagauggccaugaccgauaccacacccuuugggcagcaaagaguguucaaggagaaaguggacacgcgcacccaggaaccuaaggagggaacaaagaaacuuaugaagaucaccgcugaauggcuguggaaagagcugggcaagaaaaagacacccagaauguguacccgggaggaauuuaccaagaagguccgcagcaaugccgcgcucggggccaucuucaccgaugagaacaaguggaaaucugcuagagaagccguugaggacggacgguuuugggaacugguggauagagagcggaaucuucaccuggagggcaagugcgaaacguguguguacaacaugaugggcaaacgcgagaagaaacucggggaguucggaaaggcuaagggcuccagagccauuugguauauguggcugggggcccgguuucuggaguucgaagcgcucggauuucugaaugaggaccauugguucagccgcggcaacucccuuagcggggucgagggcgaaggacugcacagacucggcuacauccugcgggagguggggaaaaaggaaggaggcgcuauguacgccgaugacaccgccgggugggauacacgcauuacccuugaggaccugaaaaaugaagagaugguuacaaaccauaugaagggagagcacaaaaagcucgcugaagccaucuuuaagcugaccuaucagaauaaaguggucagagugcagcggccuacgccccgcggcacaguuauggacauuaucucuagacgggaucaacgcgggagcggccaggugggaaccuacggccugaacacauucaccaauauggaggcucagcucaucagacaaauggaaggggagggaauuuucaaguccauccagcaucugacggccaccgaggaaauugcgguccagaacuggcuugcccgggugggccgcgagagacugucucggauggcuaucagcggggacgauugcguugugaaaccgauugacgauagauuugccuccgcucucacagcccugaaugacaugggaaagguccgcaaagauauccagcaaugggaaccuucucggggcuggaacgacuggacccaggugcccuucugcagccaccacuuucaugagcuugucaugaaggaugggagagugcugguugugcccugucgcaaccaggacgaacucaucggccgggcgagaauuucccagggagccggcuggucucugaaggagacagcuugccuggggaaaagcuaugcccaaauguggacccucauguacuuccaccgccgggaucugagacuugcugccaaugcuaucuguuccgccgucccuagccauugggugccgacaucucgcaccacgugguccauucacgcgaagcacgaguggaugacaaccgaagacaugcuggccguguggaaccggguuuggauccaggagaaucccuggauggaagauaaaaccccuguggagagcugggaagagguccccuaucucggaaagagagaggaccaguggugcggcucucugauugggcuuacaucccgcgcuaccugggccaaaaacauccagacagccauuaaucaagugcggagccugaucggaaacgaagaguacacggacuauaugccuuccaugaagagauuucggagagaagaggaagaggcuggcguucucugguga

SEQ ID NO: 19719 - RNA, 9876 nt, Artificial Sequence
  derived and/or modified CDS sequence (opt5) from DENV-2__FJ882602__SS-prME
accgccggcaugaucauuaugcugauccccacggcuauggccuuccaccucacgaccagaaacggggagccucauaugauugugagccggcaggaaaagggaaaaucccugcuuuuuaagacagaggacggcguuaauaugugcacccugauggcgauggaucucggggaacugugugaggacacaaucaccuacaacugcccccuucugagacaaaaugaacccgaggauauugacuguuggugcaacucuacaagcaccuggguuacguauggaaccuguacagcuaccggcgagcacagacgggaaaaacgcuccguggcccucgugccucauguggggaugggacuggagacaagaaccgaaacguggaugucuagcgagggcgccuggaagcacgcucagcggaucgagacauggauccugcgccaucccggcuucaccauuauggccgcuauccucgccuacacaauugggaccaccuauuuucagagagugcugaucuucauucuucugacagcgguugccccuuccaugacgaugcggugcaucggaauuucuaaucgcgauuuuguggaaggcgucagcgggggauccuggguggacaucguucucgagcacggcagcugugugaccacaauggcuaaaaacaagcccacccuggauuucgaacuuaucaagacagaggccaaacagccugcuacccugagaaaguacugcauugaagccaaacucacgaauacaaccaccgcgucucgguguccgacacaaggggagcccucccugaacgaggaacaggacaagcgcuuugucugcaaacacagcaugguggauagaggauggggcaauggcugugggcuguucggaaagggcgggaucgugaccugcgccauguuuacaugcaagaaaaacauggagggaaagauuguccagccugaaaaucucgaguauacgaucguuauuacaccccauucuggcgaagagaacgcuguggggaaugacacaggaaaacacggcaaggagaucaaagugaccccucaguccagcaucacagaagccgagcugaccggcuacgggacggucaccauggaauguucuccccggacaggacuugauuucaacgagauggugcugcuccaaauggaaaauaaggcuuggcugguucaucgccagugguuucuugaccugccgcucccuuggcugcccggcgccgauacccagggguccaacuggauucagaaagagacacuggugaccuucaagaacccucacgccaagaaacaagacgucgugguucucggaagccaggagggcgcuaugcacacggcgcugacaggggccaccgaaauccagauguccucuggcaaucuucuguuuacaggacaucucaagugcagacugcggauggacaaacuucaacugaagggcaugagcuauuccauguguaccgggaaauucaagguggucaaggagauugcugaaacccagcacggaacaaucgugauuagaguccaguacgagggcgaugggagccccugcaaaauccccuucgagaucauggaccucgaaaagcgccaugugcugggacggcugauuacgguuaacccuaucgugaccgagaaagauucuccggucaauauugaagccgagcccccuuuuggcgacuccuacaucauuaucgggguggaacccggccagcucaagcugagcugguucaaaaagggaucuagcauuggccaaauguuugagacaaccaugagaggggccaagcgcauggcuauccuuggagauacagccugggacuucggcucccucggagggguuuuuaccucuaucggcaaagcgcuccaccagguguucggggcuauuuauggcgccgccuuuagcggagucuccuggacgaugaagauccugauuggcguggugaucacauggauugggaugaacagccggucuaccucccugagcguugcucuuguccucgugggaguggucacccuguaccugggcgugaugguucaggccgauucuggguguguggucuccuggaaaaauaaggagcucaaaugcggaagcggcaucuucaucacagacaacgugcauaccuggacagaacaguauaaguuucaaccugagucccccucuaagcuggcuagcgccauucagaaagcgcacgaagaggggaucuguggcauuagauccguuacgcgccuugaaaaucugauguggaagcagaucaccccggagcucaaccacauucugucugagaaugaagugaaacugacaaucaugaccggagauaucaagggcauuaugcaggccgggaaacggagccuuagaccucaacccacagagcucaaguacuccuggaaaaccuggggaaaggcuaagaugcugagcacggaaccucauaaccagaccuuccugaucgacggccccgagacagccgaaugcccuaauaccaaccgcgcuuggaacucucucgaggucgaggauuauggguuuggaguguucacaaccaacauuuggcugaaacuuaaggaacggcaggacgucuuuugugacuccaaacugaugagcgccgcgaucaaggauaauagagccgugcacgcugacaugggcuacuggauugagucugcccucaacgauacauggaaaaucgaaaaggcuuccuucaucgaggucaagagcugccauuggcccaaaucucacacccuguggagcaacggcgugcuggaguccgaaaugauuaucccgaagaauuucgccgggccugugagccagcacaacuaucgccccggauaccauacgcaaacagccggccccuggcaccuugggaaacucgagauggacuuugauuucugugaaggaaccaccgucguugugacagaggacugcggcaaucgggggccuucucugagaaccacgacagcuuccggaaagcugauuaccgaauggugcugucggagcugcacacucccgccccugcgcuacagaggcgaugacggcuguugguaugggauggagauccggccucuuaaagagaaggaagagaaccuggucaauucccucgucaccgcgggauacggccagauugauaacuuuucucugggggugcugggaauggcccuuuuccucgaagagaugcugagaacacgcguuggcaccaagcaugcugugcugcucgucgccgugagcuuuaugacgcugaucaccgggaauauguccuuccgggaccuuggaagaguuguggucauggugggcgccgcuaugacagaugacauuggcauggggguuaccuaucuggcccuccuggcggcuuuuaaagugcgccccacauucgccgccggacugcuucugagaaagcucaccucuaaagaacugaugaugacgacaaucggcaucguccuccugagccaguccaccauuccugagacaauccuugagcugaccgaugcucucgcccuggggaugaugauucugaagaucgugcggaacauggaaaaauaccaacuugcggugaccauuauggcuauccugugcguccccaaugccguuauccuccagaacgccuggaaggugucuuguacaauucuggcuguggucagcguguccccucuccugcuuacgagcucucagcagaaggccgacuggaucccccuggcucucaccauuaaaggacugaauccgacagccaucuuucugaccacacuuucccgcaccaacaagaaaagaagcuggccucugaaugaggcgauuauggccguuggcauggugucuauccucgcuuccagccugcucaagaacgacauccccaugacggggccucuggucgccggaggccuucugacagugugcuauguucugaccggccggucugcugaucucgaacuggagcgcgccgccgacgugagaugggaagaucaagcugagauuuccgggagcucccccauccuuagcauuaccaucucugaggacggaagcauguccauuaaaaaugaagaggaggaacagacacugaccauccucauucggacaggccugcucgucaucucugggcuguucccggugagcaucccuauuacggcggccgcuugguaccuuugggaggucaagaaacagcgcgccggagugcugugggauguucccuccccuccgcccgugggcaaggccgaacuggaggacggggcuuauagaaucaagcagaaagggauucugggcuacucucaaaucggcgccggggucuacaaggaaggaaccuuucacacaauguggcaugugacccggggcgcgguucugaugcacaaagggaagcgcauugagccuagcugggcugaugugagaaaagaccuuaucuccuauggaggcggguggaagcuggaaggagaguggaaggagggcgaagagguccaggugcucgcccuggaaccgggcaaaaacccccgggccgugcagacaaagccuggacucuucaaaaccaacacgggaaccaucggcgcuguuucucuggauuuuagccccgggacauccggaagcccuauugucgacaagaaaggcaaggugguggggcuuuacggaaauggcgucgugaccagaucuggcacauauguuuccgccaucgcgcagaccgaaaagagcauugaagauaaccccgagaucgaggacgauauuuuccgcaaacggagacugacaaucauggaccugcacccuggggcuggaaagacgaaacgcuaccucccggccaucgugcgggaagccauuaagagaggccugcgcacccuuauccuggcucccacacgggucguggccgcugagauggaagaggcccucagagggcugccuauucgcuaucaaacccccgcgauccgggccgaacauaccggaagagagauuguugaccucaugugucacgcuacauucacgaugcggcugcuuucuccugugcgcguccccaauuacaaccugaucauuauggaugaggcccauuuuaccgacccggcuuccaucgccgccagaggcuauaucagcacacggguggaaaugggggaggcugcgggcauuuucaugaccgccacaccucccggaucccgcgaucccuuuccucagucuaaugcucccaucauggacgaagagagagagauuccugaacggagcuggaacuccggccacgaguggguuaccgauuucaaagggaagacggugugguuugucccgagcaucaaggccggaaaugacauugccgcuugccugcgcaaaaauggcaagaaagugauccagcucucucgcaagacauucgauuccgaauacaucaaaacccggaccaaugacugggauuuuguggucacaaccgacauuagcgagaugggggccaacuucaaggcggaaagaguuaucgauccccgccgguguaugaagccugugauucugacagacggagaggagagagugauccuugcuggccccaugccugucacccauucuagcgccgcccaacgccgggggagaauuggccgcaaucccaaaaacgaaaaugaccaguacaucuauaugggagagccgcuggaaaacgaugaggacugcgcucacuggaaggaagccaaaaugcuccuggauaauaucaacacgccugagggcauuauccccuccauguuugagccugaaagagagaagguggacgcgauugauggggaauaccggcugcgcggagaggccagaaaaacauucguugaccucaugcggcgcggcgaucuucccguguggcuggcuuauagagucgccgcugaagggaucaacuacgccgaccggagaugguguuuugauggaauuaagaauaaccagauccuggaggagaauguggaaguugagauuuggaccaaagaaggcgagcgcaagaagcucaaaccucgguggcuggacgcuagaaucuauucugauccccuugcccugaaggaguucaaagaguucgcggccgggcgcaagagccucacacugaaccugaucaccgagaugggccggcucccgacguuuaugacccagaaagcuagaaaugcccuugacaaccuggcugugcugcacacagccgaagccggaggccgggcuuacaaucaugcgcucuccgagcugccugaaacccuugagacacugcuccugcugacccuccuugccacagucaccgggggaauuuuccuguuucugaugucuggcaaggggaucggaaagaugacgcucggcaugugcugcauuaucacagcuagcauucugcuuugguaugcccaaauccagccccacuggaucgccgcuuccauuauccuggaguucuuucucauugugcugcugauccccgaaccugagaaacagcgcaccccgcaggauaaccaacucaccuacgucgugauugccauccuuacaguuguggcggccaccauggcuaaugaaaugggcuuccuggagaagaccaaaaaggaccuggggcucggaagcaucgccacgcagcagcccgaaucuaacauucuggacaucgaucuuagaccugcuuccgccuggacccuguacgcgguggccacaaccuuuauuacacccaugcuccggcauagcaucgaaaauuccucugucaacguuagccugaccgcuauugccaaucaggcuacggugcugaugggccucgggaaaggauggccucuuuccaagauggacaucggcgugccccugcuggccauuggguguuauucucaagucaacccuaucacccucacagcugcccugcuucugcucguggcgcacuacgccaucauuggaccgggccugcaggcuaaggccacccgcgaggcucagaaaagagccgccgcgggcaucaugaagaaucccacaguugaugggauuaccgugaucgaccuggauccuauucccuaugacccuaaauucgaaaagcagcucggacaagucaugcuucuggugcugugcgucacacaggugcucaugaugcggacaaccugggcucugugugaggcccuuacacuggcuaccggccccaucagcacccucugggaagggaacccgggacgcuuuuggaauacaacgaucgccguuuccauggccaacauuuucagaggcagcuaccuggcuggggccggacugcucuuuucuaucaugaaaaacaccacaaauacccggcgcggcacaggcaacaccggggagacgcuuggagaaaaguggaagaauagacugaacgcgcugggcaaauccgaguuccagauuuauaagaaaagcgggauccaagagguggaucggacacucgccaaggaaggaauuaaaagaggcgagaccgaccaccaugcugucucucgcggguccgccaagcugcggugguuuguggaaagaaaucuuguuaccccugagggaaaaguggucgaucugggcugcggccgcgggggauggagcuacuauuguggcgggcucaagaacgugcgggaggugaagggacugacaaaaggcgggcccggacacgaggagcccaucccuaugucuaccuacggcuggaaucugguuagacuccagagcggcgucgacguguucuucacacccccugaaaagugcgauacgcuucugugugacaucggggaguccucuccgaaccccaccguggaagcuggacgcacacugcggguccucaaucugguugagaacuggcuuaauaacaauacccaguuuugcauuaaagugcugaacccuuacaugcccagcgugaucgagaagauggaagcccuccagagaaaauauggcggggcgcugguccgcaauccucugucccggaacagcacacaugagauguacuggguguccaacgccucuggaaauauuguuagcuccgugaacaugaucucuagaaugcucauuaaucgcuucaccaugcggcacaagaaggcuacguaugaacccgaugucgaccuuggcagcgggaccagaaacaucggaaucgaguccgaaacaccgaaucuggacauuaucggcaaacgcauugagaagaucaaacaagagcaugaaaccucuuggcacuacgaucaggaccacccuuauaagacaugggccuaccauggcagcuaugagaccaaacagacaggguccgcuagcucuauggugaacggaguugugagacugcucaccaagcccugggaugucauuccuauggugacgcagauggccaugacagacaccacccccuuuggccaacagcggguguucaaggaaaaagucgauacacgcacgcaggagccuaaggaagggaccaaaaagcugaugaaaaucacagcugaguggcuuuggaaggagcugggaaagaaaaagacccccagaauguguacacgggaagaguuuaccagaaaaguucgguccaaugccgcgcucggcgccauuuucacagacgaaaacaaguggaaaagcgcucgcgaggccguggaggauucuagauuuugggaacugguggacaaggagcggaaucugcaccucgaagggaaaugcgagaccugugucuacaacaugaugggaaagcgcgaaaagaaacugggcgaguucggcaaggcuaaaggguccagagccaucugguacauguggcuuggagcccgguuucuggaguucgaagcgcucggcuuucugaaugaggaucauugguucagccgcgaaaacucucuuuccgggguggagggagaaggccugcacaagcucggguauauccugagagacguuagcaaaaaggagggcggagcuauguacgccgaugacacggccggcugggacacccggauuacacuggaggaucucaagaaugaagagauggugaccaaccacauggaaggggagcauaaaaagcuggcugaagccaucuuuaaacuuacauaucagaauaaggucgugcgcguucaaagaccgaccccucggggaacggugauggacauuaucucccgcagagaucagcggggcagcgggcaggucggaacauacggccugaacaccuucacaaacaugggggcucaacucauucgccagauggagggcgaggaaguguucaaaggaauccagcaccugaccgccacggaggaaaucgcgguucagaauuggcuugccagagugggccgggagagacugucucgcauggcuauuagcggggacgauugcgucgugaagccccucgacgaucgguuugccuccgcucugaccgcccugaacgacaugggaaaggucagaaaagauauccaacagugggagcccucucgcggcuggaaugacuggacacaggugccuuucugcagccaucacuuucaugaacucauuaugaaggaugggcggguucugguggucccguguagaaaccaggacgagcuuaucggacgcgcgcggauuucccaaggcgccggguggucucugagagaaaccgcuugccucggcaaaagcuaugcccagauguggucccugauguacuuccaccgccgggaucuuagacuggcugccaaugcuaucuguucugccgugcccagccacugggugccuacaucccgcaccacauggagcauccaugcgcggcacgaguggaugaccacggaagacaugcucacaguuuggaacagaguguggauucaggagaaucccuggauggaggacaagaccccugucgaaucuugggaggaaauccccuaucugggaaaacgggaggaucaguggugcggcucccugauugggcucaccagcagagccacaugggcuaagaacauccaaaccgccauuaaucaggugcgcucucugaucggaaacgaagaguacacagacuacaugccuuccaugaagcgguuuagacgcgaggaagaggaagccggcguucuuugguga

SEQ ID NO: 19720 - RNA, 9876 nt, Artificial Sequence
  derived and/or modified CDS sequence (opt5) from DENV-2__GQ252676__SS-prME
accgccggagugaucauuaugcugauccccaccgcuauggccuuccaccucacgacccggaacggggagccucauaugauugucagcaagcaggaaaaaggaaagucccugcuuuuuaaaacggaggaaggcguuaauaugugcacccugauggcgauggaccucggggagcugugugaagauacaaucaccuacaacugcccccuucugcggcaaaaugagcccgaggacauugauuguuggugcaacucuacaagcaccugggugacguauggaaccuguacagcuaccggcgaacacagaagagagaagcgguccguggcccucgucccucauguggggaugggacuggaaacacgcaccgagacguggaugucuagcgagggcgccuggaaacacgcucagagaaucgaaacauggauccugcggcaucccggcuucaccauuauggccgcuauccucgccuacacaauugggaccaccuauuuucagcgcguucugaucuucauucuucugacagcgguggccccuuccaugacgaugagaugcaucggaauuucuaaucgggacuuugucgagggcgugagcgggggauccuggguugauaucgugcucgaacacggcagcugugucaccacaauggcuaagaacaagcccacccuggacuucgagcuuaucaaaacagaagccaagcagccugcuacccugcgcaaauacugcauugaggccaagcucacgaauacaaccaccgcgucuagauguccgacacaaggggagcccucccugaacgaagaacaggauaaacgguuugugugcaagcacagcaugguggaccgcggauggggcaauggcugugggcuguucggaaagggcgggaucgugacaugcgccauguuuacaugcaaaaagaacauggaaggaaaaauuguucagccugagaaucucgaauauacgaucguggugacaccccauucuggcgaggagaacgcugucgggaaugauacaggaaagcacggcaaagaaauuaaggugaccccucaguccagcaucacagaggccgaacugaccggcuacgggacgguuaccauggaguguucucccagaacaggacuugacuucaacgaaauggugcugcuccaaauggagaauaaggcuuggcugguccaucggcagugguuucuugaucugccgcucccuuggcugcccggcgccgacauccagggguccaacuggauucagaaggagacccuggugacauucaagaacccucacgccaaaaagcaagauguugugguccucggaagccaggaaggcgcuaugcacaccgcgcugacgggggccacagagauccagauguccucuggcaaucuucuguuuaccggacaucucaaaugccgccugagaauggacaaacuucaacugaaaggcaugagcuauuccauguguacagggaaguucaagguggucaaagaaauugcugagacccagcacggaaccaucgugguucgggugcaguacgagggcgacgggagccccugcaagauucccuucgaaaucauggaucucgagaaaagacauguccugggacgccugaucacagugaacccuauuguuacggaaaaggacucuccggugaauaucgaggccgaacccccuuuuggcgauuccuacauuaucauuggggucgagcccggccagcucaaacugagcugguucaagaagggaucuagcaucggccaaauguuugagaccacaaugagaggggccaaaagaauggcuauucuuggagacaccgccugggauuucggcucccucggcgggguguuuacaucuaucgggaaggcgcuccaccagguguucggggcuaucuauggcgccgccuuuagcggaguuuccuggaccaugaaaauucugaucggcgucgugauuacguggaucgggaugaacagccgcucuacaucccugagcgugucucuuguccucgugggaguugugacccuguaccugggcgucauggugcaggcugacuccggguguguugugagcuggaagaauaaagaacucaagugcggauccggcauuuucaucaccgauaacguccauacauggaccgagcaguauaaguuucaaccugaaucucccagcaaacuggccuccgcuauccagaaggcccacgaggaagggauuuguggcauccggucugugacaagacuugagaaucugauguggaaacagauuacgccggagcucaaccacauccugagcgaaaaugagguuaagcuguccauuaugaccggagacaucaaaggcaucaugcaggcggggaagcgcagccuucggccucaacccacagaacucaaauacucuuggaagaccuggggaaaggccaaaaugcuguccacagagccucauaaccagaccuuccugauugauggccccgaaacggcugagugcccuaauaccaacagagccuggaauagccucgagguggaagacuauggguuuggagucuucacaaccaacaucuggcugaaacuuaaagagcgccaggauguguuuugugacucuaagcugauguccgcugccauuaaagacaaucgggcggugcacgccgauaugggcuacuggaucgaaagcgcucucaacgacacauggaagauugagaaggccucuuucaucgaggucaaaagcugccauuggcccaagucccacacccuguggagcaacggcguucuggaaucugagaugaucauuccgaaaaauuucgcugggccugugucccagcacaacuauagacccggauaccauacacaaaccgccggccccuggcaccuugggaagcucgaaauggauuuugacuucugugagggaacgacaguggucgugaccgaagauugcggcaaucgcgggccuagccugcggaccacaaccgccuccggaaaacugaucacggaguggugcuguagaucuugcacacucccgccccugcgguaccgcggcgaggacggcuguugguaugggauggaaauuagaccucuuaaggagaaggaagagaaccugguuaauagccucgugaccgcuggacauggccagaucgauaacuuuucccuggggguccugggaauggcgcuuuuccucgaagagaugcugcggacaagagugggcaccaaacacgccguucugcucguggcugucucuuuuaugacacugauuaccgggaauaugagcuuccgcgaccuuggacgggugaugguuauggugggcgccgccaugacggaugacaucggcaugggggucaccuaccuggcucuccuggccgcguuuaaggugagacccacauucgcugccggacugcuucugcgcaaacucaccuccaaggagcugaugaugacaaccauuggcaucgugcuccugucucagagcacgaucccugaaacaauucuugagcugaccgaugcccucgcucuggggaugaugauccugaaaauugucagaaacauggaaaaguaucaacuugccguuacaaucauggcgauucugugcgugcccaaugcugugauccuccagaacgccuggaaggucuccuguaccauccuggccgcugugagcguuucuccucuccugcuuaccuccagccagcagaaagccgacuggauuccccuggcucucacaaucaagggacugaauccgacggccauuuuucugaccacacuuucucggaccaacaaaaagcgcuccuggccucugaaugaggcgaucauggccgugggcauggucagcauucucgcuucuucccugcucaaaaacgauauccccaugacagggccucugguggccggaggccuucugaccguuugcuacgugcugacgggcagaagcgcugaccucgaacuggagcgggccgccgacguccgcugggaggaucaagcugaaaucuccgggagcucucccauucuuagcaucacaauuuccgaggacggaucuaugagcaucaagaaugaagaggaggaacagacccugaccauucucaucagaacaggccugcucgugauuuccgggcuguucccggucucuaucccuaucaccgcggccgcuugguaucuuugggaggugaaaaagcagcgggccggaguucugugggaugugcccagcccuccgcccgucggcaaggccgaacuggaggacggggcuuaccgcauuaaacagaagggaauccucggcuauucccaaauuggcgccgggguguacaaagaaggaacauuucauacgauguggcacguuaccagaggcgcggugcugaugcacaaggggaaacggaucgagccuucuugggcugauguccgcaaggaccuuauuagcuacggaggcggguggaagcuggagggagaauggaaagagggcgaagagguccaggugcucgcccuggaaccgggcaagaaccccagagccguucagacaaaaccugggcuguucaagaccaacacaggaaccaucggcgcugucucccuggauuuuagccccgggacgucuggauccccuaucguggacaaaaagggcaagguggucgggcuuuauggaaauggcgugguuacccggagcggcacauacgugucugccauugcgcagaccgagaaauccaucgaggauaaccccgaaauugaggacgauaucuucagaaagaaacgccugacaauuauggaccugcauccuggggcuggaaagaccaaacgguaucucccggccaucgucagagaagccaucaagcgcggccugcggacacuuauucuggcucccacgagagugguugccgcugagauggaagaggcccuccgcgggcugccuauccgguaccaaacccccgcgauuagagccgagcacacaggacgcgaaaucguggaucucaugugucaugcuaccuucaccaugcggcugcuuagcccugucagagugcccaauuauaaccugauuaucauggacgaggcccacuuuacagacccggcuuccauugccgcccggggcuacaucucuacgcgcguugaaaugggggaggcugcgggcaucuucaugaccgccacaccucccggaagcagagaucccuuuccucaguccaaugcucccauuauggacgaggaacgggagaucccugaacgcagcuggaacucuggccaugagugggugaccgauuucaaggggaaaacagucugguuugugccguccauuaaggccggaaaugacaucgccgcuugccugcgcaaaaacggcaagaaagugauucagcucagccggaagaccuucgauucugaauauaucaagacgagaacaaaugacugggauuuugucguuaccaccgacaucagcgagaugggggccaacuucaaagcggagcgcgugauugauccccggagauguaugaagccugugauccugacagacggagaggaacgcgucauucuugcuggccccaugccugugacccacuccucugccgcccaacggagagggcgcaucggccggaaucccaaaaacgaaaaugaucaguacauuuacaugggagagccgcuggaaaacgacgaggacugcgcucacuggaaggaggccaaaaugcuccuggauaauaucaacacaccugaaggcaucauucccagcauguuugagccugaaagagagaagguugacgcgaucgauggggaauaucgccugagaggagaggcccggaaaaccuucguggaccucaugcgcagaggcgaucuucccgucuggcuggcuuaccggguggccgcugaggggauuaacuaugccgaccgcagaugguguuuugauggaaucaagaauaaccagauucuggaagagaauguugaaguggagaucuggacgaaggagggcgaacggaaaaagcucaaaccuagauggcuggacgcucgcauuuacuccgauccccuugcccugaaggaguucaaagaguucgcggccgggcggaagucucucacacugaaccugaucaccgagaugggcagacucccgacauuuaugacccagaaggcucgcaaugcccuugacaaccuggcuguccugcauacggccgaagccggaggccgggcuuauaaucacgcgcucagcgagcugccugagacccuugaaacacugcuccugcugacccuccuugccacagugaccgggggaaucuuccuguuucugauguccggcaaagggauuggaaagaugacacucggcaugugcugcaucauuaccgcuagcauccugcuuugguacgcccaaauucagccccauuggaucgccgcuucuaucauucuggaguucuuucucaucguccugcugauucccgaaccugagaaacagagaacgccgcaggauaaccaacucacauaugugguuaucgccauucuuaccgugguggcggccaccauggcuaaugaaaugggcuuccuggagaagaccaagaaggacuuugggcugggauccaucgccacccagcagcccgagagcaacauccucgauauugaccugcggccugcuuccgccuggacacuuuacgcggucgccacgaccuucaucacacccaugcugcgccacucuauugaaaauagcuccguuaacgugucucucaccgcuaucgccaaucaggcuacagugcugaugggccuggggaagggauggccucucagcaaaauggacauuggcgucccccuucuggccaucggguguuacucccaagugaacccuauuacccugacggcugcccuccugcuucugguugcgcacuaugccaucaucggaccgggccuccaggcuaaggccaccagagaggcucagaaacgggccgccgcgggcauuaugaagaaucccacaguggaugggaucaccgucauugaccuggauccuauccccuacgacccuaaauuugaaaagcagcugggacaagugaugcuccuuguccugugcgugacacagguucugaugaugcgcaccacgugggcucucugugaggcccugacacuugcuaccggccccauuagcacacugugggaagggaacccgggaagauucuggaauaccaccaucgccgugucuauggccaacaucuuucggggcuccuaucucgcuggggccggacugcuguucagcauuaugaagaacacaacgaauacccgcagaggcacaggcaacaccggggagacacucggagagaaauggaagaaucggcuuaacucucugggcaaauccgaauuucagaucuacaagcgcagcgggauucaagaggucgauagaacccuggcgaaagaaggaaucaagcggggcgagacggaccaucacgccgugucuagagggagcgcuaaacuccgcugguucguugagcggaaucuggugacaccugaaggaaaggucguggaucuuggcugcggcagagggggaugguccuauuacuguggcgggcugaagaacgugcgcgagguuaaaggacucaccaagggcgggcccggacaugaagaacccauuccuaugucuaccuauggcuggaaucugguccggcugcagagcggcguggacguguucuuuacacccccugaaaaaugcgauacccuccuuugugacaucggggaguccagcccgaaccccacagucgaggccggaagaacgcugcgcguucugaaucucguggaaaacuggcugaauaacaauacccaguucugcaucaaggugcuuaacccuuacaugcccuccgucauugagaaaauggaaacacugcagcggaaguacggcggggcucucgugagaaauccucugucucgcaacagcacccacgagauguauuggguuuccaacgccucuggaaauaucgugagcuccgucaacaugauuucucggaugcugaucaauagauuuacaaugcgccauaagaaagcgaccuacgaacccgauguggaccucggcagcgggacgcggaacauuggaaucgaguccgagaccccgaaucuugauaucauuggcaagagaaucgagaagauuaagcaagagcacgaaacaagcuggcacuaugaccaggaccauccuuacaaaaccugggccuaucacggcucuuacgagacaaagcagaccggguccgcuagcucuaugguuaacggagugguccgccugcugacaaagcccugggaugugaucccuauggugacccagauggccaugacggacacaacccccuucggccaacagagagucuuuaaagaaaagguugauacccggacacaggagccuaaagaggggacgaagaaacucaugaagauuaccgcugaauggcuguggaaggagcuuggcaaaaagaaaacaccccgcauguguaccagagaagaguucgcccggaaggugagauccaaugcugcccugggcgcgaucuuuacagacgagaacaaauggaaaagcgcccgggaagcuguggaggauucucgcuucugggaacucgucgacaaagagagaaaucugcaucuggaagggaagugcgagaccuguguguauaacaugaugggaaagcgggagaaaaagauuggcgaauuuggcaaagccaaggggucccgcgcuaucugguacauguggcucggagccagauuccuggaguuugaagcccuuggcuuccugaaugaggaucacugguuuagccgggaaaacucccucagcgggguugagggagagggccugcacaaacuuggguacauccugcgcgaagugucuaagaaggagggcggagcgauguaugcugacgauacagccggcugggacaccagaauuacgcucgaagaucugaaaaaugaggaaauggucaccaaccauauggagggggagcacaagaaacuggccgaagcuaucuucaagcucacauaccagaauaaagugguucgggugcaacgcccgaccccuagaggaacagucauggacauuaucagccggcgcgaccagagaggcuccggacaggugggaaccuauggccugaacacguucacaaacaugggggcccaacuuauucggcagauggagggcgaaggaguuuuuaagggcauccagcaucugaccgcuacagaggagguggccguccaggauuggcucgcgcgcguggggagagaacggcugucuagaauggccaucagcggagacgauugcgucgugaagccccuugacgaucgcuucgcuuccgcccugaccgcucucaaugacaugggcaaaguucggaaggauauucaacagugggagcccucuagaggguggaacgacuggacacaggugccuuuuugcagccaccauuuccacgaacugaucaugaaagauggacgcguccugguggugccgugucggaaucaggacgagcucauuggcagagcccgcaucucccaaggggcgggcuggucucugcgggaaaccgccugccuuggaaagagcuacgcucagauguggucccugauguauuuucacagacgcgaucuccggcuggccgcuaacgccauuuguagcgcuguucccucucauugggugccuacauccagaaccacauggagcauccacgcccgccaugaguggaugaccacagaggacaugcuuaccgucuggaaucggguguggauccaggaaaaccccuggauggaggauaaaacgccuguugaaucuugggaggaaauucccuaccugggcaagagagaggaccaguggugcgggucccucaucggacugacaagccgggcgaccugggccaagaauauucaaaccgcuaucaaccaggugagaucccugauuggcucugaggaauauacagacuacaugccuagcaugaaacgcuuccggagagaggaagaggaagccgggguccucugguga

SEQ ID NO: 19721 - RNA, 9876 nt, Artificial Sequence
  derived and/or modified CDS sequence (opt5) from DENV-2__GQ252677__SS-prME
accgccggcgugaucauuaugcugauccccaccgcuauggccuuccaccucacgacccggaacggggagccucauaugauugucagcaagcaggaaaaaggaaagucccugcuuuuuaaaacggaggaaggcguuaauaugugcacccugauggcgauggaccucggggagcugugugaagauacaaucaccuacaacugcccccuucugcggcaaaaugagcccgaggacauugauuguuggugcaacucuacaagcaccugggugacguauggaaccuguacagcuaccggcgaacacagaagagagaagcgguccguggcccucgucccucauguggggaugggacuggaaacacgcaccgagacguggaugucuagcgagggcgccuggaaacacgcucagagaaucgaaacauggauccugcggcaucccggcuucaccauuauggccgcuauccucgccuacacaauugggaccaccuauuuucagcgcguucugaucuucauucuucugacagcgguggccccuuccaugacgaugagaugcaucggaauuucuaaucgggacuuugucgagggcgugagcgggggauccuggguugauaucgugcucgaacacggcagcugugucaccacaauggcuaagaacaagcccacccuggacuucgagcuuaucaaaacagaagccaagcagccugcuacccugcgcaaauacugcauugaggccaagcucacgaauacaaccaccgcgucuagauguccgacacaaggggagcccucccugaacgaggaacaggauaaacgguuugugugcaagcacagcaugguggaccgcggauggggcaauggcugugggcuguucggaaagggcgggaucgugacaugcgccauguuuacaugcaaaaagaacauggaaggaaaaauuguucagccugagaaucucgaauauacgaucguggugacaccccauucuggcgaggagaacgcugucgggaaugauacaggaaagcacggcaaagaaauuaaggugaccccucaguccagcaucacagaggccgaacugaccggcuacgggacgguuaccauggaguguucucccagaacaggacuugacuucaacgaaauggugcugcuccaaauggagaauaaggcuuggcugguccaucggcagugguuucuugaucugccgcucccuuggcugcccggcgccgacauccagggguccaacuggauucagaaggagacccuggugacauucaagaacccucacgccaaaaagcaagauguugugguccucggaagccaggaaggcgcuaugcacaccgcgcugacgggggccacagagauccagauguccucuggcaaucuucuguuuaccggacaucucaaaugccgccugagaauggacaaacuucaacugaaaggcaugagcuauuccauguguacagggaaguucaagguggucaaagaaauugcugagacccagcacggaaccaucgugguucgggugcaguacgagggcgacgggagccccugcaagauucccuucgaaaucauggaucucgagaaaagacauguccugggacgccugaucacagugaacccuauuguuacggaaaaggacucuccggugaauaucgaggccgaacccccuuuuggcgauuccuacauuaucauuggggucgagcccggccagcucaaacugagcugguucaagaagggaucuagcaucggccaaauguuugagaccacaaugagaggggccaaaagaauggcuauucuuggagacaccgccugggauuucggcucccucgggggaguguuuacaucuaucggcaaggcgcuccaccagguguucggggcuaucuauggcgccgccuuuagcggaguuuccuggaccaugaaaauucugaucggcgucgugauuacguggaucgggaugaacagccgcucuacaucccugagcgugucucuuguccucgugggaguugugacccuguaccugggcgucauggugcaggcugacuccggguguguugugagcuggaagaauaaagaacucaagugcggauccggcauuuucaucaccgauaacguccauacauggaccgagcaguauaaguuucaaccugaaucucccagcaaacuggccuccgcuauccagaaggcccacgaggaagggauuuguggcauccggucugugacaagacuugagaaucugauguggaaacagauuacgccggagcucaaccacauccugagcgaaaaugagguuaagcuguccauuaugaccggagacaucaaaggcaucaugcaggcggggaagcgcagccuucggccucaacccacagaacucaaauacucuuggaagaccuggggaaaggccaaaaugcuguccacagagccucauaaccagaccuuccugauugauggccccgaaacggcugagugcccuaauaccaacagagccuggaauagccucgagguggaagacuauggguuuggagucuucacaaccaacaucuggcugaaacuuaaagagcgccaggauguguuuugugacucuaagcugauguccgcugccauuaaagacaaucgggcggugcacgccgauaugggcuacuggaucgaaagcgcucucaacgacacauggaagauugagaaggccucuuucaucgaggucaaaagcugccauuggcccaagucccacacccuguggagcaacggcguucuggaaucugagaugaucauuccgaaaaauuucgcugggccugugucccagcacaacuauagacccggauaccauacacaaaccgccggccccuggcaccuugggaagcucgaaauggauuuugacuucugugagggaacgacaguggucgugaccgaagauugcggcaaucgcgggccuagccugcggaccacaaccgccuccggaaaacugaucacggaguggugcuguagaucuugcacacucccgccccugcgguaccgcggcgaggacggcuguugguaugggauggaaauuagaccucuuaaggagaaggaagagaaccugguuaauagccucgugaccgcuggacauggccagaucgauaacuuuucccuggggguccugggaauggcgcuuuuccucgaagagaugcugcggacaagagugggcaccaaacacgccguucugcucguggcugucucuuuuaugacacugauuaccgggaauaugagcuuccgcgaccuuggacgggugaugguuauggugggcgccgccaugacggaugacaucggcaugggggucaccuaccuggcucuccuggccgcguuuaaggugagacccacauucgcugccggacugcuucugcgcaaacucaccuccaaggagcugaugaugacaaccauuggcaucgugcuccugucucagagcacgaucccugaaacaauucuugagcugaccgaugcccucgcucuggggaugaugauccugaaaauugucagaaacauggaaaaguaucaacuugccguuacaaucauggcgauucugugcgugcccaaugcugugauccuccagaacgccuggaaggucuccuguaccauccuggccgcugugagcguuucuccucuccugcuuaccuccagccagcagaaagccgacuggauuccccuggcucucacaaucaagggacugaauccgacggccauuuuucugaccacacuuucucggaccaacaaaaagcgcuccuggccucugaaugaggcgaucauggccgugggcauggucagcauucucgcuucuucccugcucaaaaacgauauccccaugacagggccucugguggccggaggccuucugaccguuugcuacgugcugacgggcagaagcgcugaccucgaacuggagcgggccgccgacguccgcugggaggaucaagcugaaaucuccgggagcucucccauucuuagcaucacaauuuccgaggacggaucuaugagcaucaagaaugaagaggaggaacagacccugaccauucucaucagaacaggccugcucgugauuuccgggcuguucccggucucuaucccuaucaccgcggccgcuugguaucuuugggaggugaaaaagcagcgggccggaguucugugggaugugcccagcccuccgcccgucggcaaggccgaacuggaggacggggcuuaccgcauuaaacagaagggaauccucggcuauucccaaauuggcgccgggguguacaaagaaggaacauuucauacgauguggcacguuaccagaggcgcggugcugaugcacaaggggaaacggaucgagccuucuugggcugauguccgcaaggaccuuauuagcuacggaggcggguggaagcuggagggagaauggaaagagggcgaagagguccaggugcucgcccuggaaccgggcaagaaccccagagccguucagacaaaaccugggcuguucaagaccaacacaggaaccaucggcgcugucucccuggauuuuagccccgggacgucuggauccccuaucguggacaaaaagggcaagguggucgggcuuuauggaaauggcgugguuacccggagcggcacauacgugucugccauugcgcagaccgagaaauccaucgaggauaaccccgaaauugaggacgauaucuucagaaagaaacgccugacaauuauggaccugcauccuggggcuggaaagaccaaacgguaucucccggccaucgucagagaagccaucaagcgcggccugcggacacuuauucuggcucccacgagagugguugccgcugagauggaagaggcccuccgcgggcugccuauccgguaccaaacccccgcgauuagagccgagcacacaggacgcgaaaucguggaucucaugugucaugcuaccuucaccaugcggcugcuuagcccugucagagugcccaauuauaaccugauuaucauggacgaggcccacuuuacagacccggcuuccauugccgcccggggcuacaucucuacgcgcguugaaaugggggaggcugcgggcaucuucaugaccgccacaccucccggaagcagagaucccuuuccucaguccaaugcucccauuauggacgaggaacgggagaucccugaacgcagcuggaacucuggccaugagugggugaccgauuucaaggggaaaacagucugguuugugccguccauuaaggccggaaaugacaucgccgcuugccugcgcaaaaacggcaagaaagugauucagcucagccggaagaccuucgauucugaauauaucaagacgagaacaaaugacugggauuuugucguuaccaccgacaucagcgagaugggggccaacuucaaagcggagcgcgugauugauccccggagauguaugaagccugugauccugacagacggagaggaacgcgucauucuugcuggccccaugccugugacccacuccucugccgcccaacggagagggcgcaucggccggaaucccaaaaacgaaaaugaucaguacauuuacaugggagagccgcuggaaaacgacgaggacugcgcucacuggaaggaggccaaaaugcuccuggauaauaucaacacaccugaaggcaucauucccagcauguuugagccugaaagagagaagguugacgcgaucgauggggaauaucgccugagaggagaggcccggaaaaccuucguggaccucaugcgcagaggcgaucuucccgucuggcuggcuuaccggguggccgcugaggggauuaacuaugccgaccgcagaugguguuuugauggaaucaagaauaaccagauucuggaagagaauguugaaguggagaucuggacgaaggagggcgaacggaaaaagcucaaaccuagauggcuggacgcucgcauuuacuccgauccccuugcccugaaggaguucaaagaguucgcggccgggcggaagucucucacacugaaccugaucaccgagaugggcagacucccgacauuuaugacccagaaggcucgcaaugcccuugacaaccuggcuguccugcauacggccgaagccggaggccgggcuuauaaucacgcgcucagcgagcugccugagacccuugaaacacugcuccugcugacccuccuugccacagugaccgggggaaucuuccuguuucugauguccggcaaagggauuggaaagaugacacucggcaugugcugcaucauuaccgcuagcauccugcuuugguacgcccaaauucagccccauuggaucgccgcuucuaucauucuggaguucuuucucaucguccugcugauucccgaaccugagaaacagagaacgccgcaggauaaccaacucacauaugugguuaucgccauucuuaccgugguggcggccaccauggcuaaugaaaugggcuuccuggagaagaccaagaaggacuuugggcugggauccaucgccacccagcagcccgagagcaacauccucgauauugaccugcggccugcuuccgccuggacacuuuacgcggucgccacgaccuucaucacacccaugcugcgccacucuauugaaaauagcuccguuaacgugucucucaccgcuaucgccaaucaggcuacagugcugaugggccuggggaagggauggccucucagcaaaauggacauuggcgucccccuucuggccaucggguguuacucccaagugaacccuauuacccugacggcugcccuccugcuucugguugcgcacuaugccaucaucggaccgggccuccaggcuaaggccaccagagaggcucagaaacgggccgccgcgggcauuaugaagaaucccacaguggaugggaucaccgucauugaccuggauccuauccccuacgacccuaaauuugaaaagcagcugggacaagugaugcuccuuguccugugcgugacacagguucugaugaugcgcaccacgugggcucucugugaggcccugacacuugcuaccggccccauuagcacacugugggaagggaacccgggaagauucuggaauaccaccaucgccgugucuauggccaacaucuuucggggcuccuaucucgcuggggccggacugcuguucagcauuaugaagaacacaacgaauacccgcagaggcacaggcaacaccggggagacacucggagagaaauggaagaaucggcuuaacucucugggcaaauccgaauuucagaucuacaagcgcagcgggauucaagaggucgauagaacccuggcgaaagaaggaaucaagcggggcgagacggaccaucacgccgugucuagagggagcgcuaaacuccgcugguucguugagcggaaucuggugacaccugaaggaaaggucguggaucuuggcugcggcagagggggaugguccuauuacuguggcgggcugaagaacgugcgcgagguuaaaggacucaccaagggcgggcccggacaugaagaacccauuccuaugucuaccuauggcuggaaucugguccggcugcagagcggcguggacguguucuuuacacccccugaaaaaugcgauacccuccuuugugacaucggggaguccagcccgaaccccacagucgaggccggaagaacgcugcgcguucugaaucucguggaaaacuggcugaauaacaauacccaguucugcaucaaggugcuuaacccuuacaugcccuccgucauugagaaaauggaaacacugcagcggaaguacggcggggcucucgugagaaauccucugucucgcaacagcacccacgagauguauuggguuuccaacgccucuggaaauaucgugagcuccgucaacaugauuucucggaugcugaucaauagauuuacaaugcgccauaagaaagcgaccuacgaacccgauguggaccucggcagcgggacgcggaacauuggaaucgaguccgagaccccgaaucuugauaucauuggcaagagaaucgagaagauuaagcaagagcacgaaacaagcuggcacuaugaccaggaccauccuuacaaaaccugggccuaucacggcucuuacgagacaaagcagaccggguccgcuagcucuaugguuaacggagugguccgccugcugacaaagcccugggaugugaucccuauggugacccagauggccaugacggacacaacccccuucggccaacagagagucuuuaaagaaaagguugauacccggacacaggagccuaaagaggggacgaagaaacucaugaagauuaccgcugaauggcuguggaaggagcuucgcaaaaagaaaacacccagaauguguacccgggaagaguucgccagaaaggugcgguccaaugcugcccugggagcgaucuuuacagacgagaacaaauggaaaagcgcccgcgaagcuguggaggauucuagauucugggaacucgucgacaaagagcggaaucugcaucuggaaggcaagugcgagaccuguguguauaacaugauggggaagcgcgagaaaaagauuggagaauuuggcaaagccaagggcuccagagcuaucugguacauguggcucggggcccgguuccuggaguuugaagcccuuggauuccugaaugaggaucacugguuuagccgcgaaaacucccucagcggcguugagggggagggacugcacaaacuuggcuacauccugagagaagugucuaagaaggaagggggcgcgauguaugcugacgauacagccggaugggacacccggauuacgcucgaagaucugaaaaaugaggaaauggucaccaaccauauggagggcgagcacaagaaacuggccgaagcuaucuucaagcucacauaccagaauaaagugguucgcgugcaaagaccgaccccucgggggacagucauggacauuaucagccgcagagaccagcggggauccggccagguggggaccuauggacugaacacguucacaaacaugggcgcccaacuuauucgccagauggagggggaaggcguuuuuaagggaauccagcaucugaccgcuacagaggagguggccguccaggauuggcucgcgagagugggccgggaaagacugucucgcauggccaucagcggggacgauugcgucgugaagccccuugacgaucgguucgcuuccgcccugaccgcucucaaugacaugggaaaaguuagaaaggauauucaacagugggagcccucucgcggcuggaacgacuggacacaggugccuuuuugcagccaccauuuccacgaacugaucaugaaagaugggcggguccugguggugccguguagaaaucaggacgagcucauuggacgcgcccggaucucccaaggcgcgggguggucucugagagaaaccgccugccuuggcaagagcuacgcucagauguggucccugauguauuuucaccgccgggaucucagacuggccgcuaacgccauuuguagcgcuguucccucucauugggugccuacaucccgcaccacauggagcauccacgcccggcaugaguggaugaccacagaggacaugcuuaccgucuggaauagaguguggauccaggaaaaccccuggauggaggauaaaacgccuguugaaucuugggaggaaauucccuaccugggaaagcgggaggaccaguggugcggcucccucaucgggcugacaagcagagcgaccugggccaagaauauucaaaccgcuaucaaccaggugcgcucccugauuggaucugaggaauauacagacuacaugccuagcaugaaacgguucagacgcgaggaagaggaagccggcguccucugguga

SEQ ID NO: 19722 - RNA, 9876 nt, Artificial Sequence
  derived and/or modified CDS sequence (opt5) from DENV-2__FJ898438__SS-prME
accgugggcgucaucguuaugcugauucccacagccauggcuuuccaccucacgaccagaaacggggagccucauaugaucgugggacggcaggaaaagggcaaaagccugcuuuuuaagacagaggacggggugaauaugugcacccugauggccauugaucucggagaacugugugaggacacaaucaccuacaaaugcccgcuucugcgccaaaacgaacccgaggauauugacuguuggugcaauuccacaucuaccugggucacguauggcaccuguagcacaaccggggagcacagacgggaaaagcgcuccguggcgcucguuccucaugugggaaugggccuggagacaagaaccgaaacguggaugucuagcgagggcgcuuggaaacacguccagcggaucgagacauggauccugcgccaucccggguucaccauuauggccgccauccucgcuuacacaauuggaaccacccacuuucagagagcccugaucuucauucuucugacagcuguggccccuuccaugacgaugcggugcaucggcauuucuaaccgcgauuuuguugaaggggugagcggaggcuccugggucgacaucgugcucgagcacgggagcugugugaccacaauggcgaagaauaagcccacccuggauuucgaacuuaucaaaacagaggccaagcagccugcuacccugagaaaauauugcauugaagccaagcucacgaacacaaccaccgagucucgguguccgacacaaggagagcccucccugaaugaagagcaggacaaacgcuuuaucugcaagcauagcauggucgauagaggcuggggcaacggguguggacuguucggcaaggggggaauuguuaccugcgcuauguuuacaugcaaaaagaauauggaaggcaaaguggugcagccugagaacuucgaauacacgaucgucauuaccccccacucuggggaggagcaugccgugggaaaugacacaggcaagcacggcaaagaaaucaagaucaccccucaguccagcauuacagaggcggaacucaccggguauggaacgguuaccauggaguguucuccccggacaggccuggauuuuaacgaaauggugcuucugcaaauggaggacaaagccuggcucguccaccgccagugguuccuggaucuuccgcugccuuggcuccccggggcugacacccagggauccaauuggauccagaaggagacacuggugaccuuuaagaacccucaugccaaaaagcaagacguugugguccugggcagccaggaaggggcuaugcacacggcccucacaggcgccaccgagauucagauguccucuggaaaucugcuuuucacaggccaucugaaaugcagacuccggauggauaagcugcaacuuaaagggaugagcuacuccauguguaccggaaaguucaagaucgugaaagaaauugcugagacccagcacggcacaaucgucaucagagugcaguaugagggggacggaagccccugcaagauucccuuugaaaucacggaucuggagaaacgccauguucucggccggcugauuaccgugaacccuaucgucacagaaaaggacucuccggugaacauugaggcggaacccccuuucggggauuccuacaucauuaucggcguugagcccggacagcugaaacucaauugguuuaagaagggcagcucuaucgggcaaauguucgagaccacaaugagaggagccaaacgcauggcuauucugggcgacaccgccugggauuuugggagccuuggaggcguguucacguccaucgggaaggcccugcaccaggucuuuggcgcuauuuacggagccgcguucucuggcgugagcuggacaaugaaaauccucauuggggugaucaucaccuggauuggaaugaacucccggagcaccucucuguccguuagccugguccuugugggcguggucacacucuaucugggggcuauggugcaggccgacucuggauguguuguguccuggaagaauaaagaacugaagugcggcagcgggaucuuuauuaccgauaacguccacacauggacggagcaguacaaguuccaaccugaaucccccucuaaacucgccagcgcuauccagaaggcccaugaggaaggcauuuguggaaucagauccgugacccgccuggagaaucuuauguggaaacagaucacaccggagcugaaccacauucucucugaaaaugagguuaagcugaccaucaugacaggcgacauuaaagggaucaugcaggcuggaaagcggagccugagaccucaacccaccgaacuuaaauauuccuggaagacguggggcaaggccaaaaugcucagcaccgagucucauaaccagacauuucugauugaugggccugaaaccgcggagugccccaauuccaaccgcgccuggaauagccuggagguggaagacuacggauucggcgucuuuacaaccaacaucuggcucaagcugcgggagaaacaggacguguucugugauucuaagcuuauguccgcugccaucaaagacaauagagcuguucacgccgauaugggcuauuggauugaaagcgcgcugaacgacacauggaagauggagaaggccucuuucaucgaggugaaaagcugccacuggccuaagucccauacccucuggagcaaugggguccuggaaucugagaugauuauccccaaaaacuuugcuggaccggugucccagcacaacuaccgcccuggcuaucauacgcaaacagccgggcccuggcaccugggaaagcuugaaauggauuucgacuuuugugagggcaccaccguggucguuacagaagauugcgggaaucggggacccagccucagaaccacgacagcuuccggcaaacugauuaccgaguggugcugucggucuugcacacugccuccgcuccgcuacagaggcgaggacggguguugguacggaauggaaauccggccccugaaggagaaggaagagaaccuugugaauagccuggugaccgccggccaugggcagauugauaacuucucccucggaguccugggcauggcccuguuucuugaagagaugcucagaacacgcaucgggaccaaacacgcuauccugcugguggcggccucuuucguuacgcucauuaccggaaauaugagcuuucgggaccugggcagagugauggucauggugggcgcuacaaugaccgaugacaucgggaugggaguuacauaucuugcccugcucgccgcuuucaaggugcgcccuaccuuugccgcgggccugcugcuuagaaaacugacguccaaggagcucaugauggcuacaauugggaucgcccugcucucucagagcaccauucccgaaacaauccuggagcuuaccgaugcccuggcucucggaaugaugguccugaaaaucgugcggaacauggaaaaguaccaacuggccguuaccauuauggcgaucuccugcgugccuaaugcugucauucuucagaacgccuggaaggugagcuguacaauccuggccgcugugucugucuccccccuccugcucacgagcucucagcagaaagccgacuggauuccucuggcucuuaccaucaagggccugaaucccacagccaucuuccucaccacacugucccgcaccagcaaaaagagaucuuggccgcugaacgaggcgguuauggccguggggaugguguccauucuugcuagcucccugcucaaaaaugacaucccuaugacgggaccccuggucgccggcggccuccugacagugugcuauguucuuaccgggcggagcgcugaucuggaacuggagcgcgccgccgacgugaagugggaggaucaagcugaaauuucuggaagcuccccuauccucucuauuaccaucagcgaggacggcuccaugucuauuaaaaacgaagaggaggaacagacacugaccauccuuaucagaacagggcugcucgucauuagcggaguguuucccguuuccaucccgauuacggcggccgcuugguaccugugggaggugaagaagcagcgggccggcguccucugggaugugccuucucccccucccgucgggaaagccgaacuggaggacggagcuuaucgcaucaagcagagaggcauucuuggcuacagccaaaucggggccggaguguauaaagaaggcaccuuccacacaauguggcauguuacccggggggcggugcugaugcaccgcggaaagagaaucgagcccuccugggcugaugucaaaaaggaccugauuagcuacggcgggggauggaagcucgagggcgaauggaaagagggcgaagaggugcagguucuggcccuugaaccugggaagaauccgcgggccgugcagacaaaacccggaaucuuuaagaccaacacgggcaccauuggggcugucucucuggauuucuccccuggaacaagcggcucucccaucguggacagaaaagggaaggugguuggacucuacggcaauggcgucgugacccgcuccggggccuaugugagcgcgauugcucagacagagaaguccaucgaggauaacccugaaaucgaggacgauauuuuccggaaaaagagacugaccaucauggaccuccaucccggagccggcaaaacaaagcgcuaccugccugccauuguccgggaagcuaucaaaagagggcuucgcacgcugauucuggccccgacccgggugguugcugccgagauggaagaggcgcucagaggacugcccauccgcuaucaaacaccugccauuaagaccgagcacaccggccgggaaaucguggaccuuaugugucaugcuacauuuacgaugagacugcucucucccguccgggugccuaacuacaaucugaucauuauggaugaggcccacuucaccgaccccgcuagcaucgccgcccgcggguauauuuccacaagaguugaaaugggcgaggcugcgggaaucuuuaugaccgccacaccgccuggcagccgggaucccuucccccagucuaacgcuccuauuauggacgaggaacgcgagauccccgaaagauccuggaauagcgggcacgagugggugaccgauuuuaagggaaaaacggucugguucgugccuucuaucaaggccggcaacgacauugccgcuugccuccggaaaaaugggaagaaaguuauccagcugagcagaaagacauuugauuccgaauacgugaagacccgcgccaacgacugggauuucgucgugaccacagacauuucugagaugggagcgaauuuuaaagcugagcgggugaucgauccgagacgcuguaugaagcccgucauucuuaccgacggcgaagagcggguuauccuggccgggccuaugcccgugacacauagcuccgccgcucaaagacgcggccggaucggaagaaacccuaaaaaugaaaacgaccaguauauuuacaugggcgagccccuggaaaaugaugaggacugcgcccacuggaaggaggcgaaaaugcuccuggauaacaucaauaccccggaagggauuaucccuucuauguucgagcccgaacgcgagaagguggacgccauugauggagaauacagacuucggggcgaggcucgcaaaacguuugucgaccugaugagacggggggaucucccuguguggcuggccuauaagguugcugccgagggaaucaacuacgcugaccgcaagugguguuucgauggcauuaaaaauaaccagauccuggaagagaacauggaaguggagaucuggacaaaggagggggaaagaaaaaagcucaaaccccgguggcuugacgccagaauuuauagcgauccucuggcgcugaaggaguucaaggaauuugccgcuggccgcaaaucccucacccugaaucuuaucacagagaugggacggcugcccaccuucaugacgcagaaggccagaaacgcucucgacaaucuggccguccugcauaccgccgaagcuggcgggcgcgcguacaaccacgcccucagcgagcuuccggagacacuggaaacccugcuccugcuuacacugcucgcuaccgugacaggaggcauuuuucuguuccugaugucugggaaaggaaucggcaagaugacccucggcaugugcugcauuaucacggccuccauccuucugugguaugcccaaauucagccucacuggaucgcugccagcauuauccuggaguuuuuccucauuguucugcuuauccccgaacccgagaaacagcggacaccucaggauaaucaacugaccuacguggucaucgcgauucucaccguggucgccgcuacaauggccaacgaaaugggguuucuggagaagaccaagaaagaccugggacucggcuccaucacaacgcaggagucugaaagcaauauucuugacaucgaucugagaccggcuuccgccuggacccuguaugcgguggccacaaccuucguuacacccaugcuccggcauucuauugagaacagcuccgugaaugugagccugaccgcuaucgccaaccaggcuacgguccuuauggggcugggaaagggcuggccucucucuaaaauggacauugggguuccccugcuggccaucggauguuacucccaggugaauccuaucacccucacagcugcccuucugcugcucguggcgcacuacgccauuaucggccccggccugcaagcuaaggccacccgcgaagcucagaaaagagccgccgcggggauuaugaagaacccuacagucgauggaaucaccgugauugaccuugagccgauccccuaugauccuaaguuugaaaaacagcugggccagguuaugcuccugauccugugcgugacgcaaguccucaugaugcggacaaccugggcucuuugugaggcccugacacuggcuaccgggcccauuagcacccucugggagggaaauccuggccgcuucuggaacacaacgaucgccgugucuauggccaauauuuuuagaggguccuaccuggcuggagccggccuucuguucagcaucaugaagaacaccacaaauacccggcgcggcacagggaacauuggagaaacccucggcgagaaauggaagucuagacugaacgcgcuggggaaaagcgaauuucagaucuauaagaaauccggaauccaggaggucgaccggacgcucgccaaggagggcauuaagcgcggggaaacagaucaucacgcugugucuagaggaagcgccaaacuucggugguucguugagagaaauauggugacccccgaaggcaaggucguggaccugggcugcgggcgcggaggcugguccuacuauugugggggacugaaaaacguucgggaggugaagggccucaccaaagggggaccgggccaugaagagccuauccccaugagcacauacggcuggaaucuggucagacuucaauccgggguggauguguucuuuacccccccugagaagugcgacacacugcucugugauauuggagaaucuagccccaacccuacgaucgaggcuggccgcacccugcggguucugaaucucgucgaaaacuggcuuaauaacaauacacaguucugcauuaaggugcugaacccguauaugcccuccgugaucgagaaaauggaaacccugcagagaaaguacgggggagcccucguccgcaauccucugucucggaacagcacacacgagauguacuggguuuccaaugcgaccggcaacaucgugucuagcgugaauaugauuuccagaaugcuuaucaaccgcuuuacgaugaaacacaagaaagccaccuaugagcccgacgucgaucuggggagcggaacacggaacauuggcaucgaaucugagauuccuaaucucgacaucauuggcaagagaaucgaaaagaucaaacaggagcaugaaaccuccuggcacuacgaccaagaucaucccuauaagacaugggcuuaccacgggagcuaugagaccaaacagacaggaucugccuccagcauggugaacggcguugugcgccugcugaccaagccgugggacgucgugccuaugguuacgcagauggcuaugacagauaccacccccuucgggcagcaacggguguuuaaagagaaggucgacacaagaacgcaggaaccuaaggagggaaccaaaaagcucaugaaaauuacagccgaauggcuuuggaaggagcugggcaaaaagaaaaccccccgcauguguacaagagaggaauucacccggaaggugcgcucuaaugcugcccugggggcgaucuuuacagaugagaacaaguggaaauccgccagagaagcuguggaggacggacgguucugggaacucgucgauagagagcggaaucugcaccuugagggcaagugcgaaaccuguguuuacaacaugaugggcaaacgcgagaagaaacugggggaauuuggaaaggccaagggcagcagagcuauuugguauauguggcucggggcccgguuccuggaguuugaagcccugggauuccucaaugaggaccauugguuuucccgcggcaacagccugucugggguggagggcgaaggacuucacagacugggcuacauccuccgggauguggggaaaaaggagggaggcgcgauguacgcugacgauacggccgggugggacacccgcauuacacuggaagaccuuaaaaaugaggaaauggucaccaaccauaugaagggagagcacaaaaagcuggccgaggcuaucuucaagcucacauaucagaauaaagugguuagagugcagcggccuaccccccgcggcacggucauggauaucauuagcagacgggaccaacgcggguccggccaggugggaacauacggccugaacaccuucacaaauauggaagcccagcugaucagacaaauggagggggaaggaauuuuuaagucuauccagcaucucaccgcuacggaggagauugccguucagaacuggcuggcgcgggugggccgcgaaagacuuagccggauggccaucuccggggaugacugcgucgugaaaccgaucgaugacagauucgcuucugcccugaccgcucucaaugauaugggaaagguucgcaaagacauucagcaaugggagccuagccggggcuggaacgauuggacacaggugcccuuuugcucccaccacuuccaugaacuggucaugaaggacgggagagugcuugucgugcccugucgcaaccaggaugagcugaucggccgggccagaauuucucagggagcgggcuggagccucaaggaaaccgccugccuggggaaauccuaugcucaaauguggacacugauguacuuucaccgccgggaccucagacuggccgcuaaugccaucuguagcgcuguuccuucucauugggugccgaccucccgcacaaccuggagcauucacgccaagcacgaguggaugacgacagaggauaugcuugcggucuggaaccggguguggauccaggaaaaucccuggauggaggacaaaaccccuguggaaucuugggaggaaguucccuaucugggaaagagagaggaccaguggugcggcucccucauugggcugaccagccgcgccacaugggcuaaaaacauccagaccgccaucaaucaagugcggucccuuauuggaaacgaggaauacacagauuauaugccuucuaugaagagauuccggagagaggaagaggaagccggcguccugugguga

SEQ ID NO: 19723 - RNA, 9876 nt, Artificial Sequence
  derived and/or modified CDS sequence (opt5) from DENV-2__GQ199893__SS-prME
accgccggcgugaucgucaugcugauucccacggcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagaaggcucugaucuucauucuucugacggccgucgcgccuagcaugaccaugagaugcaucggcauuuccaaccgggauuuuguggaagggguuucuggaggcagcuggguggacaucguccucgagcacggguccugugugacaaccauggccaagaauaaacccacacuggauuucgaacuuaucaagaccgaggcuaaacagccugccacgcugcgcaaguauugcauugaagcuaaacucacaaacaccaccacagagagcagauguccgacccaaggagagcccucucugaaugaggaacaggacaagcgguuuaucugcaagcauuccaugguggaucgcggcuggggcaacggguguggacuguucggcaaagggggaauugucacaugcgccauguuuacgugcaagaaaaauauggaaggcaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagccccagaaccggccuugauuucaacgaaaugguucugcuccaaauggaggacaaggcuuggcuggugcaccggcagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugccgccugagaauggauaaacuucaacugaaggggaugucuuacagcauguguaccggaaaguucaaaaucgucaaggaaauugcggagacacagcacggcacgaucgugauccggguccaguaugagggggacggaucccccugcaaaauucccuucgaaaucaccgaucucgagaagagacaugugcugggccgccugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugcggggagcuaagagaauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgcuccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaauccggagcgucacaagacuugagaaucugauguggaagcagaucaccccggagcucaaccacauucuguccgaaaaugaggugaaacugacaaucaugaccggcgacauuaaggggaucaugcaggccggaaaacgcucucuucggccucaacccacggaacucaaguauagcuggaagaccuggggcaaagcgaagaugcuguccacagagagccauaaccagaccuuccugauugaugggccugaaacagccgagugccccaauaccaacagagcuuggaacucucucgagguugaagacuacggauuuggcguguucacaaccaacaucuggcugaaacuucgcgagaagcaggacgucuuuugugauuccaaacugaugagcgccgcuaucaaggacaaucgggccgugcacgcggauaugggcuauuggauugaaucugcccucaacgacacguggaagauggagaaggcuagcuucaucgagguuaagagcugccacuggccuaaaucucauacacuguggagcaauggggugcuggaauccgagaugauuauccccaagaacuucgccggaccggucagccagcacaacuacagaccuggcuaucauacccaaaccgcugggcccuggcaccuuggaaaacucgaaauggauuuugaccugugugagggcacaaccgugguggucacggaagauugcgggaaucgcggacccucucugcggacaaccacagccuccggcaagcucauuaccgaguggugcuguagaagcugcacacugccuccgcuucgguaccgcggcgaggacggguguugguacggaauggaaaucagaccccugaaggagaaagaagagaaccucguuaauucccuggugaccgccggccaugggcagauugauaacuucucucugggagugcuuggcauggcucucuuucuggaagagaugcugcggacgagaaucgggaccaagcacgcgauccuccuggucgccgugagcuucguuacacuuauuaccggaaauauguccuuucgcgaccugggccgggugauggucauggugggcgcuacaaugaccgaugacaucgggaugggaguuacguaucucgcccugcuggccgcuuucaaagugagaccuacauuugccgcgggccuucugcuccgcaagcugaccucuaaagagcucaugauggcuacaauugggaucgcccugcuuagccaguccaccauucccgaaaccauccuggagcucacagaugcccuggcucugggaaugaugguccuuaagaucgugagaaacauggaaaaguaccaacuggccguuacgauuauggcgaucucuugcgugccuaaugcugucauucuccagaacgccuggaaagugagcuguaccauccuggccgcuguguccgucagcccccuccugcuuacaucuucccagcagaaggccgacuggauuccucuggcucucaccaucaaaggccugaaucccacagccaucuuccugaccacgcuuagccggacaucuaagaaacgcuccuggccgcugaacgaggcgauuauggccguugggauggugagcauccucgcuucuucccugcucaagaaugacauuccuaugaccggaccccugguggccggcggccuucugaccgucugcuaugugcugacagggagaagcgcugaucucgaacuggagcgggccgccgacguuaaaugggaggaucaagcugaaaucuccggaagcucuccuauucuuagcaucaccauuuccgaggacggcucuaugagcaucaagaacgaagaggaggaacagacacugacgauccucauucgcaccgggcugcucgugaucuccggagucuuucccgugucuauuccgaucacagcggccgcuugguaccugugggagguuaagaaacagagagccggcgugcuuugggaugucccuucucccccucccguggaaaaggccgagcuggaagacggggcuuaucggauuaaacagcgcggaauccugggcuacucccaaaucggcgccggggucuauaaggagggaaccuuccacacaauguggcaugugaccagaggcgcgguucucaugcaccgggggaaacgcauugagcccuccugggcugaugugaagaaggaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccggaagggcaaggugguggggcucuacggaaauggcguugucaccagaagcggcgccuaugugucugcgaucgcucagacagagaaauccaucgaagauaacccugagauugaagacgauaucuuucgcaagaaacggcugacgauuauggaccuucaucccggggccggaaagaccaaaagauaccugccugccaucgugcgcgaggcuauuaagcggggccugagaacacucauccuggccccgacccgcgucguggcugccgaaauggaggaggcgcuucgggggcugcccauuagauaucaaaccccugccaucaagacagaacacacgggacgcgagaucguugaccucaugugucaugcuaccuucacaaugcggcugcucagccccgugagagucccuaacuacaaucugauuaucauggaugaagcccacuucaccgaccccgcuuccauugccgcccggggcuauaucucuacacgcguggagaugggggaggcugcgggcauuuuuaugaccgccacgccgccuggaagcagagaucccuucccccaguccaacgcuccuaucauggacgaagaacgggaaauccccgagcgcagcuggaacucuggccacgaauggguuacagauuuuaaagggaagaccgugugguucgucccuuccauuaaagccggaaacgacaucgccgcuugccuuagaaagaauggcaaaaaggugauucagcugagccggaagaccuuugauucugaguacguuaaaacaagagccaacgacugggauuucguggucaccacagacaucagcgagaugggggcgaauuuuaaggcugaacgcgugauugauccgcggagauguaugaaacccgugauccugaccgacggagaggaacgcgucauccucgccggcccuaugcccguuacgcauuccucugccgcucaacggagagggcgcauuggccggaacccuaagaaugagaacgaccaguauaucuacaugggagaaccccuggagaaugaugaggacugcgcccacuggaaagaagcgaagaugcuucuggauaacauuaauacaccggagggcaucauuccuagcauguucgaacccgagagagaaaaaguggacgccaucgauggggaguaccgccucagaggagaggcucggaagaccuuuguggaccugaugcgcagaggcgaucugccugucuggcucgccuauaagguggcugccgaagggauuaacuacgcugaccggaaaugguguuucgauggaaucaagaauaaccagauccuugaggaaaacauugagguugagaucuggacaaaagaaggcgagcgcaagaaacugaagcccagauggcuggacgcccggauuuauuccgauccucucgcgcugaaggaauuuaaagaguucgccgcugggagaaagucucuuacccugaaucucaucacggaaaugggccgccugcccaccuucaugacacagaaagcccggaacgcucuggacaaucucgccgugcuucauaccgccgaggcuggaggcagagcguacaaccacgcccugagcgagcugccggaaacacucgagacccugcuucugcucacacugcuggcuaccgucacaggcgggauuuuucucuuccuuauguccgggaaggggaucggaaaaaugacacugggcaugugcugcaucauuaccgccagcauccugcucugguaugcccaaauucagccucacuggaucgcugccucuauuauccuggaauuuuuccuuaucgugcugcucauucccgagcccgaaaagcagcgcaccccucaggauaaucaacugacauacguugugaucgcgauucugaccgucguggccgcuacaauggccaacgagaugggcuuucucgagaagacgaaaaaggaccuugggcugggauccaucaccacacaggaaagcgaguccaauauucuggacaucgaucuccggccggcuucugccuggacccuguaugcggucgccacaaccuucgugacgcccaugcuuagacauagcauugaaaacuccucuguuaaugugagccugaccgcuaucgccaaccaggcuacagugcucaugggccuggggaaaggauggccucuguccaagauggacaucggcgucccccuccuugccauuggguguuacagccagguuaauccuaucacccugacagcugcccugcuccugcuuguggcgcacuacgccauuaucggacccggccugcaagcuaaagccacccgggaggcucagaagcgcgccgccgcgggcauuaugaagaacccuacgguggaugggaucacagucaucgaccucgaaccgauucccuaugauccuaaauuugagaagcagcugggacaggugaugcugcucauccuuugcguuacccaagugcugaugaugagaacaaccugggcucugugugaggcccucacccuggcuacaggccccauuucuacgcuuugggaagggaauccuggacgguucuggaacaccacaaucgccgucuccauggccaauauuuuucgcggcagcuaccuggcuggggccggacuccuguucucuaucaugaaaaacaccacaaauaccagacggggcacgggcaacaucggggagacacugggagaaaaguggaaaucccgccucaacgcgcuuggcaagagcgaguuucagguguauaaaaagucugggauucaggaggucgacagaacccuggccaaggaaggaaucaaacggggcgagaccgaucaucacgcugugagccgcggguccgccaagcugagaugguucguugaacggaauauggugacacccgagggaaaagucguggaccucggcugcggcagagggggauggucuuacuauuguggcgggcugaagaacguucgcgaagugaaaggacuuaccaagggcgggccgggacaugaggagccuauucccaugagcacauacggcuggaaucugguccggcuccaauccggcguggauguguuuuucacgcccccugaaaagugcgacacccugcugugugauaucggggagagcucccccaacccuacaauugaagcuggaagaacccuccgcguucuuaaucuggucgagaacuggcugaauaacaauacacaguucugcaucaaagugcucaacccguauaugcccucugugaucgaaaagauggaggcccugcagcggaaauacggcggggcgcuugucagaaauccucugagccgcaacuccacccacgagauguacuggguuucuaaugccacgggaaacauugugagcuccgugaauaugaucucucggaugcucauuaacagauuuaccaugaagcacaaaaaggcuacauaugaacccgacgucgaucugggcagcgggacccgcaacaucggaauugaguccgaaaucccuaaucuggacauuaucggcaagcggaucgagaaaauuaagcaggaacaugagacaagcuggcacuacgaccaagaucaucccuauaaaaccugggccuaccacggcucuuaugagacaaagcagaccggguccgcuagcucuauggugaacggaguugugagacuccuuacgaaaccgugggacgucgugccuaugguuacacagauggccaugaccgauaccacacccuucggccagcaacgcguguuuaaggaaaaggucgacacgcggacccaggagccuaaagaagggacaaagaaacugaugaagaucaccgcugaguggcuguggaaagagcucggaaagaaaaagacacccagaauguguacccgcgaagaguucacaagaaaggugcgguccaaugccgcgcugggcgccauuuuuaccgaugaaaacaaauggaaaagcgcucgcgaggccguggaagacgggagauucugggagcuugucgaucgggagagaaaucugcaccucgaaggaaaaugcgagacguguguuuacaacaugaugggcaagcgggagaaaaagcugggcgaguuugggaaggcuaaaggaucucgcgccaucugguauauguggcugggcgccagauuccucgaauuugaggcgcugggguuccuuaaugaggaccauugguuuucccggggaaacagccuguccggcguggaaggggagggccuccaccgccugggauacauucuuagagaugugggcaagaaagaagggggagcuauguacgccgacgauaccgccggcugggacacacggaucacccuggaggaccucaagaaugaagagauggucacaaaccauaugaaaggggagcacaagaagcuggcugaagccaucuucaaacugaccuaucagaauaaggugguucgcgugcagagaccuacgccccggggaacagucauggauauuaucagccgcagagaccaacggggcucuggacaggugggcaccuacggacucaacacauuuaccaauauggaggcucagcugauucgccaaauggaaggcgaggggaucuucaaaagcauucagcaucuuacggccaccgaggaaaucgcgguucagaacuggcuggccagagugggacgggagcgccucuccagaauggcuaucucuggcgaugacugcgucgugaagccgauugaugaccgguucgccagcgcucugacagcccuuaaugauauggggaaaguuagaaaggacauccagcaaugggaaccuucccgcggauggaacgauuggacccaggugcccuuuugcucucaccacuuccaugagcuggucaugaaggacggccgggugcucgucgugcccuguagaaaccaggaugaacugauugggcgcgcgcggaucagccagggcgccggauggucccugaaagagacagcuugccucggcaagucuuaugcccaaauguggacccugauguacuuucacagacgcgaccuucggcuggcugccaaugcuauuuguagcgccguuccuccgcauugggugcccacauccagaaccacguggagcauccacgcgaaacacgaguggaugacaaccgaagauaugcucgccgucuggaaccgcguguggauucaggagaauccuuggauggaagacaagacccccguggagucuugggaagagguuccuuaucuggggaaacgggaggaccaguggugcggaucccuuaucggccugacaagcagagcuaccugggccaagaacauccagacagccauuaaucaagugcgcucucucaucgggaacgaagaguacacggauuauaugcccuccaugaagcgguucagacgggaagaggaagaggcuggaguccugugguga

SEQ ID NO: 19724 - RNA, 9876 nt, Artificial Sequence
  derived and/or modified CDS sequence (opt5) from DENV-2__GQ199894__SS-prME
accgccggcgugaucgucaugcugauucccacggcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagaaggcucugaucuucauucuucugacggccgucgcgccuagcaugaccaugagaugcaucggcauuuccaaccgggauuuuguggaagggguuucuggaggcagcuggguggacaucguccucgagcacggguccugugugacaaccauggccaagaauaaacccacacuggauuucgaacuuaucaagaccgaggcuaaacagccugccacgcugcgcaaguauugcauugaagcuaaacucacaaacaccaccacagagagcagauguccgacccaaggagagcccucucugaaugaggaacaggacaagcgguuuaucugcaagcauuccaugguggaucgcggcuggggcaacggguguggacuguucggcaaagggggaauugucacaugcgccauguuuacgugcaagaaaaauauggaaggcaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagccccagaaccggccuugauuucaacgaaaugguucugcuccaaauggaggacaaggcuuggcuggugcaccggcagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugccgccugagaauggauaaacuucaacugaaggggaugucuuacagcauguguaccggaaaguucaaaaucgucaaggaaauugcggagacacagcacggcacgaucgugauccggguccaguaugagggggacggaucccccugcaaaauucccuucgaaaucaccgaucucgagaagagacaugugcugggccgccugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugcggggagcuaagagaauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgcuccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaauccggagcgucacaagacuugagaaucugauguggaagcagaucaccccggagcucaaccacauucuguccgaaaaugaggugaaacugacaaucaugaccggcgacauuaaggggaucaugcaggccggaaaacgcucucuucggccucaacccacggaacucaaguauagcuggaagaccuggggcaaagcgaagaugcuguccacagagagccauaaccagaccuuccugauugaugggccugaaacagccgagugccccaauaccaacagagcuuggaacucucucgagguugaagacuacggauuuggcguguucacaaccaacaucuggcugaaacuucgcgagaagcaggacgucuuuugugauuccaaacugaugagcgccgcuaucaaggacaaucgggccgugcacgcggauaugggcuauuggauugaaucugcccucaacgacacguggaagauggagaaggcuagcuucaucgagguuaagagcugccacuggccuaaaucucauacacuguggagcaauggggugcuggaauccgagaugauuauccccaagcacuucgccggaccggucagccagcauaacuacagaccuggcuaucacacccaaaccgcugggcccuggcaucuuggaaaacucgaaauggauuuugaccugugugagggcacaaccgugguggucacggaagauugcgggaaccgcggacccucucugcggacaaccacagccuccggcaagcucauuaccgaguggugcuguagaagcugcacacugccuccgcuucgguaccgcggcgaggacggguguugguacggaauggaaaucagaccccugaaggagaaagaagagaaucucguuaacucccuggugaccgccggccacgggcagauugauaauuucucucugggagugcuuggcauggcucucuuucuggaagagaugcugcggacgagaaucgggaccaagcacgcgauccuccuggucgccgcuagcuucgugacacuuauuaccggaaacauguccuuucgcgaccugggccggguuauggugauggucggcgccacaaugaccgaugacaucgggaugggagugacguaucucgcccugcuggcugccuucaaaguuagaccuacauuugcggcuggccuucugcuccgcaagcugaccucuaaagagcucaugauggccacaauugggaucgcccugcuuagccaguccaccauucccgaaaccauccuggagcucacagaugcucuggcccugggaaugauggugcuuaagaucgucagaaauauggaaaaguaccaacuggcggugacgauuauggcuaucucuugcguuccuaacgccgugauucuccagaaugccuggaaagucagcuguaccauccuggcugccguguccgugagcccccuccugcuuacaucuucccagcagaaggcugacuggauuccucuggcccucaccaucaaaggccugaaccccacagcgaucuuccugaccacgcuuagccggacaucuaagaaacgcuccuggccgcugaaugaggccauuauggcugucgggaugguuagcauccucgccucuucccugcucaagaacgacauuccuaugaccggaccccugguggcuggcggccuucugaccgugugcuauguccugacagggagaagcgccgaucucgaacuggagcgggccgcugacgugaaaugggaggaucaagcggaaaucuccggaagcucuccuauucuuagcaucaccauuuccgaggacggcucuaugagcaucaagaaugaagaggaggaacagacacugacgauccucauucgcaccgggcugcucguuaucuccggaguguuucccgucucuauuccgaucacagccgcugccugguaccugugggaggugaagaaacagagagccggcguucuuugggaugugccuucucccccucccgucgaaaaggcugagcuggaagacggggccuaucggauuaaacagcgcggaauccugggcuacucccaaaucggcgcggggguguauaaggagggaaccuuccauacaauguggcacgucaccagaggcgcugugcucaugcaucgggggaaacgcauugagcccuccugggccgauguuaagaaggaccugaucagcuacggaggcggguggaaacuugaaggagaguggaaggaaggcgaggaagugcagguccuggcccucgagccuggcaaaaacccgagagcugugcagacgaagcccgggauuuuuaaaaccaauacaggaaccaucggcgccguuucccuggauuucagcccugggacaucuggaucccccauuguggaccggaagggcaaggucguggggcucuacggaaacggcgugguuaccagaagcggcgcguaugucucugcuaucgcccagacagagaaauccaucgaagauaauccugagauugaagacgauaucuuucgcaagaaacggcugacgauuauggaccuucaccccggggccggaaagaccaaaagauaccugccugcuaucgugcgcgaggccauuaagcggggccugagaacacucauccuggcuccgacccgcguggucgccgcggaaauggaggaggcccuucgggggcugcccauuagauaucaaaccccugcuaucaagacagaacauacgggacgcgagaucguggaccucaugugucacgccaccuucacaaugcggcugcucagccccguuagagugccuaacuacaaccugauuaucauggaugaagcucacuucaccgaccccgccuccauugccgcucggggcuauaucucuacacgcgucgagaugggggaggcggccggcauuuuuaugaccgcuacgccgccuggaagcagagaucccuucccccaguccaaugccccuaucauggacgaagaacgggaaauccccgagcgcagcuggaacucuggccaugaaugggugacagauuuuaaagggaagaccguuugguucgugccuuccauuaaagccggaaaugacaucgcugccugccuuagaaagaacggcaaaaaggucauucagcugagccggaagaccuuugauucugaguacgugaaaacaagagcgaaugacugggauuucguugugaccacagacaucagcgagaugggggcuaacuuuaaggccgaacgcgucauugauccgcggagauguaugaaacccgugauccugaccgacggagaggaacgcgugauccucgccggcccuaugcccgucacgcacuccucugcugcccaacggagagggcgcauuggccggaauccuaagaacgagaaugaccaguauaucuacaugggagaaccccuggagaacgaugaggacugcgcgcauuggaaagaagccaagaugcuucuggauaauauuaacacaccggagggcaucauuccuagcauguucgaacccgagagagaaaaaguugacgcuaucgauggggaguaccgccucagaggagaggcccggaagaccuuuguggaccugaugcgcagaggcgaucugccuguguggcucgcuuauaaggucgccgcugaagggauuaauuacgccgaccggaaaugguguuucgauggaaucaagaacaaucagauccuugaggaaaacauugagguggagaucuggacaaaagaaggcgagcgcaagaaacugaagcccagauggcuggacgcgcggauuuauuccgauccucucgcccugaaggaauuuaaagaguucgcugccgggagaaagucucuuacccugaaccucaucacggaaaugggccgccugcccaccuucaugacacagaaagcucggaaugcccuggacaaccucgccguucuucacaccgcugaggcgggaggcagagccuacaaucacgcucugagcgagcugccggaaacacucgagacccugcuucugcucacacugcuggccaccgugacagggggaauuuuucucuuccuuauguccggcaaggggaucggaaaaaugacacugggcaugugcugcaucauuaccgccagcauccugcucugguaugcucaaauucagccucauuggaucgccgcgucuauuauccuggaauuuuuccuuaucguccugcucauucccgagcccgaaaagcagcgcaccccucaggauaaccaacugacauacgugguuaucgccauucugaccguggucgcugccacaauggcuaaugagaugggcuuucucgagaagacgaaaaaggaccuugggcugggauccaucaccacacaggaaagcgaguccaacauucuggacaucgaucuccggccggccucugcguggacccuguaugccguggcuacaaccuucgucacgcccaugcuuagacacagcauugaaaauuccucugugaacguuagccugaccgccaucgcuaaucaggccacagugcucaugggccuggggaaaggauggccucuguccaagauggacaucggcgugccccuccuugcuauuggguguuacagccaggucaacccuaucacccugacagccgcgcugcuccugcuuguugcccauuacgcuauuaucggacccggccugcaagccaaagcuacccgggaggcccagaagcgcgccgcggcuggcauuaugaagaauccuacgguggaugggaucacagugaucgaccucgaaccgauucccuaugauccuaaauuugagaagcagcugggacaggucaugcugcucauccuuugcgugacccaaguucugaugaugagaacaaccugggcccugugugaggcucucacccuggccacaggccccauuucuacgcuuugggaagggaacccuggacgguucuggaauaccacaaucgccguguccauggcuaacauuuuucgcggcagcuaccuggccggggcgggacuccuguucucuaucaugaaaaauaccacaaacaccagacggggcacgggcaauaucggggagacacugggagaaaaguggaaaucccgccucaacgcccuuggcaagagcgaguuucaggucuauaaaaagucugggauucaggagguggacagaacccuggcuaaggaaggaaucaaacggggcgagaccgaucaccaugccgucagccgcggguccgcuaagcugagaugguucguggaacggaacaugguuacacccgagggaaaaguggucgaccucggcugcggcagagggggauggucuuacuauuguggcgggcugaagaaugugcgcgaaguuaaaggacuuaccaagggcgggccgggacacgaggagccuauucccaugagcacauacggcuggaaccuggugcggcuccaauccggcgucgauguguuuuucacgcccccugaaaagugcgacacccugcugugugauaucggggagagcucccccaauccuacaauugaagccggaagaacccuccgcgugcuuaaccugguugagaauuggcugaacaauaacacacaguucugcaucaaaguccucaauccguauaugcccucugugaucgaaaagauggaggcgcugcagcggaaauacggcggggcccuugugagaaacccucugagccgcaauuccacccacgagauguacugggucucuaacgcuacgggaaauauuguuagcuccgugaacaugaucucucggaugcucauuaauagauuuaccaugaagcauaaaaaggccacauaugaacccgacguggaucugggcagcgggacccgcaacaucggaauugaguccgaaaucccuaaccuggacauuaucggcaagcggaucgagaaaauuaagcaggaacacgagacaagcuggcauuacgaccaagaucaccccuauaaaaccugggcuuaccacggcucuuaugagacaaagcagaccggguccgccagcucuauggucaauggagugguuagacuccuuacgaaaccgugggacguggucccuauggugacacagauggcuaugaccgauaccacacccuucggccagcaacgcguuuuuaaggaaaagguggacacgcggacccaggagccuaaagaagggacaaagaaacugaugaagaucaccgccgaguggcuguggaaagagcucggaaagaaaaagacacccagaauguguacccgcgaagaguucacaagaaagguccgguccaacgcggcccugggcgcuauuuuuaccgaugaaaauaaauggaaaagcgcccgcgaggcuguggaagacgggagauucugggagcuuguggaucgggagagaaaccugcaucucgaaggaaaaugcgagacgugugucuacaauaugaugggcaagcgggagaaaaagcugggcgaguuugggaaggccaaaggaucucgcgccaucugguauauguggcugggcgcgagauuccucgaauuugaggcucugggguuccuuaacgaggaccacugguuuucccggggaaauagccuguccggcguugaaggggagggccuccaucgccugggauacauucuuagagaugugggcaagaaagaagggggagccauguacgccgacgauaccgcuggcugggacacacggaucacccuggaggaccucaagaacgaagagauggugacaaaucacaugaaaggggagcauaagaagcuggccgaagcuaucuucaaacugaccuaucagaacaaggucgugcgcguucagagaccuacgccccggggaacagugauggauauuaucagccgcagagaccaacggggcucugggcaggucggcaccuacggacucaauacauuuaccaacauggaggcccagcugauucgccaaauggaaggcgaggggaucuucaaaagcauucagcaccuuacggcgaccgaggaaaucgccgugcagaauuggcuggcuagaguuggacgggagcgccucuccagaauggccaucucuggcgaugacugcguggucaagccgauugaugaccgguucgcuagcgcccugacagcgcuuaacgauauggggaaagugagaaaggacauccagcaaugggaaccuucccgcggauggaaugauuggacccagguucccuuuugcucucaccauuuccacgagcuggugaugaaggacggccggguccucgugguccccuguagaaaccaggaugaacugauugggcgcgcccggaucagccagggcgcuggauggucccugaaagagacagccugccucggcaagucuuaugcucaaauguggacccugauguacuuucauagacgcgaccuucggcuggccgcuaacgccauuuguagcgcggugccuccgcacuggguucccacauccagaaccacguggagcauccacgccaaacaugaguggaugacaaccgaagauaugcucgcuguguggaaucgcgucuggauucaggagaacccuuggauggaagacaagacccccguggagucuugggaagaggugccuuaucuggggaaacgggaggaccaguggugcggaucccuuaucggccugacaagcagagccaccugggccaagaauauccagacagcuauuaaccaaguucgcucucucaucgggaaugaagaguacacggauuauaugcccuccaugaagcgguucagacgggaagaggaagaggccggagugcugugguga

SEQ ID NO: 19725 - RNA, 9876 nt, Artificial Sequence
  derived and/or modified CDS sequence (opt5) from DENV-2__FJ898439__SS-prME
accgccggagucaucgucaugcugauucccaccgcuauggccuuccaccucacgacccggaauggggagccucauaugaucguuggacggcaggaaaagggcaagucccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguagcacaaccggggagcaccggcgggaaaagcgcuccgucgcucucgugccucauguuggaaugggccuggagacacggaccgaaacguggaugucuagcgagggcgccuggaaacacgugcagcggaucgagacauggauccugcgccaucccggguucaccauuauggccgcuauccucgccuacacaauuggaaccacccacuuucagagagcucugaucuucauucuucugacagccgucgcgccuuccaugacgaugcggugcaucggcauuucuaaccgcgauuuuguggaagggguuagcggaggcuccuggguggacaucguccucgagcacgggagcugugugaccacaauggccaagaauaagcccacccuggauuucgaacuuaucaaaacagaggcuaagcagccugccacccugagaaaauauugcauugaagcuaagcucacgaacacaaccaccgagucucgguguccgacacaaggagagcccucccugaaugaagaacaggacaaacgcuuuaucugcaagcauagcaugguggauagaggcuggggcaacggguguggacuguucggcaaagggggaauugugaccugcgccauguuuacaugcaaaaagaauauggaaggcaaaguugugcagccugagaaccucgaauacacgaucgugauuacaccccacucuggggaggagcaugcggucggaaaugacacaggcaagcacggcaaagaaaucaagaucaccccucaguccagcauuacagaggccgaacugaccggguauggaacggugaccauggaguguucuccccggacaggccuugauuucaacgaaaugguucugcuccaaauggaggacaaggcuuggcuggugcaccgccagugguuucuugaucugccgcucccuuggcugcccggggccgacacccagggauccaauuggauccagaaggagacacuggucaccuucaagaacccucaugcuaaaaagcaagacgugguugugcucggcagccaggaaggggccaugcacacggcccugacaggcgcuaccgagauucagauguccucuggaaaucuucuguuuacaggccaucucaaaugcagacugcggauggauaaacuucaacugaaagggaugagcuacuccauguguaccggaaaguucaagaucgucaaagaaauugcggagacccagcacggcacaaucgugaucagaguccaguaugagggggacggaagccccugcaagauucccuucgaaaucacggaucucgagaaacgccaugugcugggccggcugauuaccguuaacccuaucgugacagggaaggacucuccggucaacauugaagccgagcccccuuuuggcgauuccuacaucauuaucggaguggaacccggccagcucaaacugaauugguucaagaaggggagcucuaucggacaaauguuugagaccacaaugagaggcgcuaaacgcauggccauucuuggggacaccgccugggauuucggaagccugggcgggguuuuuacguccaucggcaaggcucuccaccagguguucggagccauuuacggcgcggcuuuuucuggggucagcuggacaaugaaaauccugauuggagugaucaucaccuggauuggcaugaacucccggagcaccucucuguccgugagccuuguucucgucgggguggugacacuguaucugggagccaugguccaggccgacucuggcugugugguuuccuggaagaauaaagagcucaagugcgggagcggcaucuucauuaccgauaacgugcacacauggacggaacaguacaaguuucaaccugagucccccucuaaacuggcuagcgccauccagaaggcucaugaagagggaauuuguggcaucagauccgucacccgccuugaaaaucugauguggaaacagaucacaccggagcucaaccacauucugucugagaaugaagugaagcugaccaucaugacaggggacauuaaaggaaucaugcaggccggcaagcggagccuuagaccucaacccaccgagcucaaauauuccuggaagacgugggggaaggcgaaaaugcugagcaccgaaucucauaaccagacauuccugauugauggaccugagaccgccgaaugccccaauacaaaccgcgcuuggaacucccucgagguugaggacuacggcuuuggcguguucaccacaaacaucuggcugaaacuucgggaaaaacaggacgucuuuugugauagcaagcugaugucugccgcuaucaaagacaauagagccgugcacgcggauaugggguauuggauugaguccgcccucaacgacaccuggaagauggaaaaggcuagcuucaucgagguuaaaucuugccacuggccuaagagccauacgcugugguccaauggagugcuggagagcgaaaugauuauccccaaaaacuucgccggcccggucucucagcacaacuaccgcccuggguaucauacacaaaccgcuggacccuggcaccuuggcaagcucgagauggauuuugaccugugugaagggaccacagugguggucaccgaggauugcggaaaucggggccccucccugagaacgacaaccgccagcggcaaacucauuacagaauggugcugucgguccugcacccugccuccgcuucgcuacagaggggaggacggauguugguacggcauggagauccggccccugaaggaaaaggaggaaaaccucguuaauucucuggugacagccgggcauggacagguggauaacuucagccugggcguccuugggauggcucucuuucuggaggaaaugcugagaacccgcauuggaacgaaacacgcgauccuccugguggccgcuuccuucguuacccuuaucacaggcaauaugucuuuucgggaccugggcagagugauggucauggugggggccaccaugacagaugacauuggaaugggcguuaccuaucucgcccugcuggcugccuucaaggugcgcccuacguuugcggcugggcuucugcucagaaaacugacaagcaaggagcucaugauggccaccaucggaauugcccugcuuucccagucuacaauccccgagaccauucuggaacucaccgaugcucuggcccugggcaugaugguccuuaaaaucgugcggaacauggagaaguaccaacuggcgguuacaaucauggcuauuagcugcgugccuaaugccgucauccuccagaacgccuggaagguguccuguacgauucuggcugccgugagcgucucuccccuccugcuuaccuccagccagcagaaagcugacuggaucccucuggcccucacaauuaaggggcugaaucccaccgcgaucuuccugacaacccuuucucgcacguccaaaaagagaagcuggccgcugaacgaagccguuauggcugugggaauggugucuauccucgccuccagccugcucaaaaaugacauuccuaugacaggcccccuggucgcuggcgggcuucugaccgugugcuauguucugaccggacgguccgccgaucucgagcuggaacgcgccgcugacgugaagugggaggaucaagcggagaucagcggcucuagcccuauucuuuccaucacaauuucugaagacgggagcauguccaucaaaaacgaggaagaggagcagacccugacaauucucaucagaacgggacugcucgucaucucuggcguguuucccguuagcauuccgaucaccgccgcugccugguaccugugggaagugaagaagcagcgggccgggguccuuugggaugugccuucucccccucccgucgagaaagcugaacuggaggacggagccuaucgcauuaagcagagaggcauccugggcuacagccaaauuggggcgggaguguauaaagaaggcacauuccacaccauguggcauguuacaagaggggcugugcucaugcaccgcggaaagagaaucgagcccagcugggccgaugucaaaaaggaccugaucuccuacggcgggggauggaaacuugagggcgaauggaaagagggcgaagaggugcagguucuggcccucgaaccugggaagaauccgcgggcugugcagaccaaacccggaauuuuuaagacgaacaccggcacaaucggggccgucagccuggauuucucuccuggaaccuccggcagccccauuguggacagaaaagggaaggugguuggacucuacggcaauggcgucgugacacgcucuggggcguauguguccgcuaucgcccagaccgaaaagagcauugaggauaacccugaaaucgaggacgauaucuuucggaaaaagagacugacaauuauggaccuucaucccggagccggcaaaacgaagcgcuaccugccugcuaucguccgggaagccauuaaaagagggcugcgcacccucauccuggcuccgacacgggugguugccgcggagauggaagaggcccuuagaggacugcccauucgcuaucaaaccccugcuaucaagaccgagcacacaggccgggaaauuguggaccucaugugucaugccacguucaccaugagacugcucucccccguccgggugccuaacuacaaucugaucaucauggaugaggcucacuucacagaccccgccucuauugccgcucgcggguauaucagcaccagaguugaaaugggcgaggcggccggaauuuuuaugacagcuaccccgccuggcucccgggaucccuucccccagagcaacgccccuaucauggacgaggaacgcgagauucccgaaagaucuuggaacuccgggcacgagugggugacggauuuuaagggaaaaacagucugguucgugccuagcaucaaggccggcaacgacaucgcugccugccuucggaaaaaugggaagaaaguuauucagcugucuagaaagaccuuugauagcgaauacgugaagacccgcgcgaacgacugggauuucgucgugacaaccgacaucuccgagaugggagcuaauuuuaaagccgagcgggugauugauccgagacgcuguaugaagcccgucauccugacagacggcgaagaacggguuauucucgccgggccuaugcccgugacccauucuagcgcugcccaaagacgcggccggaucggaagaaacccuaaaaaugaaaacgaccaguauaucuacaugggcgagccccuggaaaaugaugaggacugcgcgcacuggaaggaggccaaaaugcuucuggauaacauuaauacgccggaagggaucauuccuuccauguucgagcccgaacgcgagaagguggacgcuaucgauggagaauacagacuccggggcgaggcccgcaaaacauuugucgaccugaugagaagaggggaucugccuguguggcucgcuuauaagguugccgcugagggaauuaacuacgccgaccgcaagugguguuucgauggcaucaaaaauaaccagauucuugaagagaacauggaaguggagaucuggaccaaggagggggaacgcaagaagcugaaaccccgguggcuggacgcgagaaucuauucugauccucucgcccugaaggaguuuaaggaguucgcugccggccgcaaaagccuuacacugaaucucauuaccgagaugggacggcugcccacguucaugacccagaaggcuagaaacgcccuggacaaucucgccguccuucauacagcugaaaccggcgggaaagcguacaaccacgcccuguccgagcugccggagacacucgaaacccugcuucugcucacacugcuggcuaccgugacgggaggcaucuuucucuuccuuaugagcgggaagggaauuggcaaaaugacacugggcaugugcugcaucauuaccgccucuauccugcucugguaugcccaaauccagccucacuggauugcugccuccaucauucuggaguuuuuccuuaucguucugcucauucccgaacccgagaagcagcgcaccccucaggauaaucaacugacauacguggucaucgcgauccugaccguggucgccgcuacaauggccaacgaaaugggguuucucgagaagacgaaaaaggaccuuggauucggcagcauuaccacacaggaguccgaaucuaauauccuggacauugaucugcggccggcuagcgccuggacccucuaugcgguggccacaaccuuuguuacgcccaugcugagacauuccaucgagaacucuagcgugaaugugucccuuaccgcuauugccaaccaggcuacaguccugauggggcucggaaaaggcuggccucugagcaagauggacaucgggguuccccugcucgccauuggauguuacucucaggugaauccuaucacccuuacagcugcccugcugcuccugguggcgcacuacgccaucgucggccccggccuucaagcuaaagccacccgggaagcucagaagcgcgccgccgcggggauuaugaagaacccuacgguggauggaaucacaguuauugaccuggagccgauccccuaugauccuaaauucgaaaagcagcucggccaggugaugcugcugauucucugcgucacccaagugcuuaugaugagaacaaccugggcucugugugaggcccugacccucgcuacagggcccaucuccacgcugugggagggaaauccuggccgguuuuggaacaccacaaucgccgucagcauggccaauauuuuccgcgggucuuaccuugcuggagccggccugcucuuuuccaucaugaaaaacaccacaaauaccagacggggcacggggaacauuggagaaacacugggcgagaaguggaaaagccgccugaacgcgcucgggaagucugaguuccagaucuauaaaaagagcggcauucaggagguggacagaacccuugccaaggagggcaucaaaagaggggaaaccgaucaucacgcuguuucccgcggaucugccaagcugagaugguuuguggagcggaauauggucacacccgaaggcaaagugguugaccugggcugcgggagaggaggcuggagcuacuauugugggggacucaagaacgugcgcgaggucaaaggccugaccaaagggggaccgggccaugaagaaccuauccccauguccacauacggcuggaaucuugugcggcugcaaagcgggguggauguuuucuucacgcccccugagaagugcgacacccuccugugugauauuggagaauccucucccaacccuacaaucgaggcuggcagaacccugcgcguccucaaucuuguggaaaacuggcugaauaacaauacacaguuuugcauuaaagugcugaacccguauaugcccagcgucaucgagaagauggaaacccuccagcggaaauacgggggagcccugguuagaaauccucuuucccgcaacucuacgcacgagauguacugggugagcaaugcgaccggcaacauuguguccucugucaauaugaucagccggaugcugaucaacagauucacaaugaagcacaaaaaggccaccuaugagcccgacguggaucucggguccggaacacgcaacauuggcaucgaaagcgagauuccuaaucuggacaucauuggcaagcggaucgagaagauuaagcaggagcaugaaaccucuuggcacuacgaccaagaucaucccuauaaaacaugggcuuaccacggguccuaugagaccaagcagacgggaagcgccucuuccaugguuaacggcguggucagacugcucacaaaaccgugggacgugguuccuauggugacccagauggcuaugaccgauacaacgcccuuugggcagcaacgcgucuucaaggagaagguggacacccggacacaggaaccuaaagagggaaccaagaaacuuaugaagaucacagccgaauggcuguggaaagagcugggcaagagaaaaacccccagaauguguacaagagaggaauuuacccggaaggugcgcagcaaugcugcccucggggcgaucuucacggaugagaacaaguggaaaucugccagagaagcugucgaggacggacgguuuugggaacugguugauagagagcggaaucuucaccuggagggcaagugcgaaaccuguguguacaacaugaugggcaaacgcgagaagaaacucggggaguucggaaaggccaagggcuccagagcuauuugguauauguggcugggggcccgguuucuggaguucgaagcccucggauuucugaaugaggaccauugguucagccgcggcaacucccuuagcgggguggagggcgaaggacugcacagacucggcuacauccugcgggaugucgggaaaaaggagggaggcgcgauguacgcugacgauacagccgggugggacacccgcauuacacuugaagaccugaaaaaugaggaaauggugaccaaccauaugaagggagagcacaaaaagcucgccgaggcuaucuuuaagcugacguaucagaauaaaguugugagaguccagcggccuacaccccgcggcaccgugauggauauuaucucuagacgggaccaacgcgggagcggccagguuggaacauacggccugaacaccuucacgaauauggaagcccagcucaucagacaaauggagggggaaggaauuuucaaguccauccagcaucugaccgcuacagaggagguggccguccagaacuggcuugcgcgggugggccgcgaaagacugucucggauggccauuagcggggaugacugcguugugaaaccgaucgaugacagauuugcuuccgcccucaccgcucugaaugauaugggaaagguccgcaaagacauucagcaaugggagccuucucggggcuggaacgauuggacacaggugcccuucugcagccaccacuuucaugaacuugucaugaaggacgggagagugcugguugugcccugucgcaaccaggaugagcucaucggccgggccagaaucucccagggagcgggcuggucucugaaggaaaccgccugccuggggaaaagcuaugcucaaauguggacacucauguacuuccaccgccgggaccugagacuugccgcuaaugccauuuguuccgcugucccuagccauugggugccgaccucucgcacgacaugguccauccacgccaagcacgaguggaugaccaccgaggauaugcuggcgguguggaaccggguuuggauucaggaaaaucccuggauggaggacaaaacaccuguggaaagcugggaggaaguccccuaucucggaaagagagaggaccaguggugcggcucucugaucgggcuuaccucccgcgccacaugggcuaaaaacauucagacggccaucaaucaagugcggagccugauuggaaacgaggaauacaccgauuauaugccuuccaugaagagauuucggagagaggaagaggaagccggcguucucugguga

SEQ ID NO: 19726 - RNA, 9876 nt, Artificial Sequence
  derived and/or modified CDS sequence (opt5) from DENV-2__GQ868588__SS-prME
accgccggcaugaucauuaugcugauccccaccgugauggcuuuccaccugacgacccggaacggggagccucauaugauugucagccggcaggaaaagggaaagucccugcuuuucaagaccaaggacggcaccaauaugugcacacugauggcccucgaucugggggagcuuugugaagacaccaucacauacaagugcccguuccugaaacaaaacgagcccgaagauauugacuguuggugcaauucuaccagcacguggguuaccuauggaacauguaccacaaccggcgagcacagaagagagaagcgguccguggcgcucgugccucaugucgggaugggacuggaaacgcgcacagagaccuggaugucuagcgaaggcgcuuggaagcacgcccagagaaucgagacauggauccugcggcaucccggcuuuaccauuauggccgcuauccucgccuacaccauugggacaacgcacuuccagcgcgugcugaucuuuauucuucugaccgcuaucgccccuuccauggcgaugagaugcauuggaaucucuaaccgggauuucguugagggcgugagcgggggauccugggucgacaucgugcucgaacacggcagcuguguuacaaccauggccaaaaauaagcccacacuggauuuugagcuuauuaaaaccgaagcuaagcagccugccacgcugcgcaaauauugcaucgaggcuaagcucacaaacaccaccacagacucuagauguccgacccaaggggaacccacacugaaugaggagcaggauaagcgguucgugugcaaacauuccauggucgaccgcggauggggcaacggcugugggcuguuuggaaagggcgggauugugacgugcgccauguuuaccugcaaaaagaauauggaaggaaaaaucgugcagccugagaaccucgaauacacagucguuauuacaccccacagcggcgaggaacaugcgguggggaaugauacaggaaagcacggcaaagaggugaagaucaccccucagucuuccaucacggaggccgaacugaccggcuaugggacagucaccauggaguguagccccagaacaggacuugacuuuaacgaaauggugcugcuccaaauggaggauaaggcuuggcugguucaccggcagugguuccuugaccugccgcucccuuggcugcccggcgccgacacccaggggucuaauuggauucagaaagaaacgcuggugacauuuaagaacccucaugcuaaaaagcaagaugucgugguucucggaucccaggagggcgccaugcacaccgcccugacaggggcuaccgagauccagaugagcuccggcaaucuucuguucaccggacaucucaaaugccgccugagaauggacaaacuucaacugaagggcaugucuuacagcauguguacagggaaauucaagauugugaaagaaaucgcggagacgcagcacggaaccauugucauccgggugcaguaugaaggcgaugggucccccugcaagauccccuuugagauuauggaccucgagaaaagacauguccugggacgccugaucacagugaacccuauuguuaccgaaaaggauagcccggugaacaucgaggccgaacccccuuucggcgacucuuacauuaucauuggggucgagcccggccagcucaagcuggauugguuucggaaaggauccagcaucggccaaauguucgaaacaaccaugagaggggcuaagcgcauggccauccuuggagacacggccugggauuuuggcucucucgggggaguguucacaagcauuggcaaagcucuccaccagguuuuuggggccaucuacggcgcggcuuucuccggagugucuuggaccaugaagauucugaucggcgucauuaucaccuggaucgggaugaauagccgguccacaagccugucugugucccuugugcucguuggaauugucacccuguaucugggcgugauggugcaggccgacagcgggugugucgugucuuggaaaaacaaggagcucaagugcggauccggcaucuuuguuacagauaaugugcacacguggaccgagcaguacaaauuccaaccugaaagccccuccaagcuggccucugcuauucagaaagcccaugaggaagggaucuguggcauuagaagcgucacacgccuugagaaccugauguggaagcagaucaccuccgaacucaaucacauccugucugagaacgaggugaaacugacaauuaugaccggagacaucaagggcauuaugcagguugggaaacggagccuuagaccgcaaccuacggaacuccgcuauuccuggaagaccuggggaaaggcuaaaaugcugagcacagagcugcauaaucagaccuuucucaucgacggccccgaaacagccgagugcccuaacaccaaucgggcguggaacucucuggaaguggaggauuacggguucggagucuuuacaaccaauauuuggcuuagacugcgcgagaagcaggacguguucugugauuccaaacucaugagcgccgcuaucaaggacaaccgggccguucacgcugauaugggcuauuggaucgaaucugcccugaaugacacguggaaaauugagaaggcguccuucaucgaagucaagagcugccacuggcccaaaucucauacacuguggagcaacggcgugcuugaguccgagauggugauuccuaagaauuuugccgggcccgugagccagcacaacaacagaccgggauaccauacccaaaccgcuggcccuuggcaccucgggaaacuggaaauggauuucgacuuuugugagggaacaaccgucguugugacggaagagugcggcaaucgggggcccucucugcgcacaaccacagccuccggaaagcucaucaccgaauggugcuguagaagcugcacacugcccccucuucgguauagaggcgaggauggcuguugguacgggauggagauucgcccgcugaaagaaaaggaggaaaaccucguguccucucuggucaccgcuggacauggccagaucgacaauuucagccuggggauucuuggaauggcccucuuucuggaggaaaugcugcggacgagagugggcaccaagcacgccauccuccugguugcuguguccuucgucacacuuaucaccgggaacaugucuuuucgcgaucugggaagagugaugguuauggugggcgcgacaaugaccgacgauauuggcaugggggucacguaccucgcccugcuggcugccuucaaagugcggcccacauuugccgcuggacuucugcuccgcaagcugaccagcaaagagcucaugaugacaaccaucggcauuguucugcuuucccagucuagcaucccugagaccauucuggaacucacagacgcccuggcgcuggggaugauggugcuuaagauggucagaaauauggagaaauaucaacuggcugugacgaucauggccauccucugcgugcccaacgccgucauucugcagaaugcuuggaagguuuccuguaccauccucgccguggugagcgucucuccucugcuucugacauccagccagcagaaggcggacuggauuccccucgcucugaccaucaaaggacugaacccuacagccauuuuccuuaccacgcugucucggacauccaagaaacgcagcuggccccucaaugaagccaucauggcugugggcaugguuucuauccuggccuccagccuccugaagaacgauauuccgaugaccgggccucuuguggcuggaggccugcugaccgucugcuacgugcucacaggcagauccgccgaccuggagcuugaacgggcgaccgauguuaaaugggacgaucaagccgagaucagcgggucuagccccauucuguccaucacaauuucugaggacggaagcauguccaucaagaaugaagaggaggaacagacgcucaccauucugauccgcacaggccuccuggugaucucugggcuuuuuccugucagcauucccaucaccgcugccgcuugguaucugugggaggugaaaaagcagagagccggaguccugugggauauuccguccccucccccugugggcaaggccgaacucgaggacggggcuuaccggaucaaacagaagggcauucugggauauucucaaaucggcgcggggguuuacaaagaaggaacauuccacaccauguggcaugugacgcgcggcgccguccuuaugcacaaggggaaaagaaucgagcccagcugggcugaugugaagaaggaccugauuuccuauggaggcggguggaaacucgaaggagaguggaaggagggcgaagagguucaggugcuggcccucgaacccggcaaaaacccucgggccguccagaccaagccggggcuguuuagaacaaauaccggaacaaucggcgcugugagccuugauuucucucccgggaccuccggaagcccuauuguggacaaaaagggcaagguugucgggcuguacggaaacggcguggugacacgcucuggcgccuacgucuccgcgaucgcucagacggagaaaagcauugaagauaaucccgagaucgaggacgacaucuuccggaagagacgccugaccauuauggaucuccauccuggggccggaaaaacaaagaaauaucugcccgccaucgugcgggaagcuauuaagagaggccuucgcacccugauccucgccccuacccggguuguggcggcugagauggaagaggcccugagagggcucccgauucgcuaccaaacacccgccauccgggcugaacacacgggaagagagauugucgaccugaugugucaugccaccuuuacaaugcggcuucuguccccuauccgcgugcccaacuauaaccugaucauuauggaugaggcucacuucaccgacccugccucuaucgcggccagaggcuacauuagcacacggguugaaaugggggaggcugccggcaucuuuaugaccgcuacgcccccgggaucccgcgauccuuucccccagagcaaugcccccauuauggacgaagagagagagaucccugaacggucuuggaacuccggccacgagugggugacagauuuuaaggggaaaaccgucugguucgugcccagcaucaagaccggaaaugacauugccgcuugccuccgcaagaacggcaagcgcguuauccagcugucucggaaaacauuugauagcgaauaugugaagaccagaacaaaugacugggauuucgucgugaccacggacauuuccgagaugggggcgaacuuuaaggccgaacgcgugaucgacccucggagauguaugaaaccggucauucuuacagauggagaggagcgcguuauccuggcuggccccaugccugugacccauucuagcgccgcccaacggagagggcgcaucggcagaaauccccggaacgaaaaugaccaguacauuuauaugggagagccucucgaaaacgaugaggacugcgcucacuggaaggaagccaaaaugcugcuggauaauaucaacacacccgagggcauuaucccguccauguucgagccugaacgcgagaagguggacgcgauugauggggaauacagacuccggggagaggcucgcaaaaccuuugucgaccuuaugagacggggcgaucugcccguguggcuggccuacaagguugccucugaagggaucaauuaugcugacagacgcugguguuucgauggaacgcggaacaaucagauucucgaggagaacguggaagucgagaucuggaccaaagaaggcgagagaaagaagcugaaaccucgcuggcuugacgcccggaucuacagcgauccccuggcgcucaaggaguucaaagaauuugccgcugggagaaagucccugacacugaaccucauuaccgagaugggccggcuuccuacauucaugacccagaaagcccgcgacgcucuggacaaucuggccgugcuccauacagcugaagccggaggcaaggcguauaaccacgcccugagcgagcuucccgaaacccuggagacgcuccugcugcucacacuucuggcuaccguuaccgggggaaucuuucuguuccucaugucuggcagagggauuggaaagaugacacugggcaugugcugcaucauuaccgccuccauccuucugugguacgcucaaauccagccgcacuggauugccgccagcaucauucucgaguuuuuccugaucgugcugcucauuccugaacccgagaaacagcggacaccccaggauaaucaacuuacguaugucaucaucgcuauucugaccguggucgcggccacaauggcuaacgaaaugggcuuucuggagaagaccaaaaaggaccucgggcugggacauaucgccacacagcagccugaauccaauauucuugauaucgaccugcgcccggccucugcuuggacccucuacgccguggcgacgaccuucauuacacccaugcugagacacagcaucgagaacuccucuguuaaugugagccugaccgccauugcuaaccaggccacagugcucaugggccuugggaaaggauggccucuguccaagauggauaucggcgucccccugcucgcuaucggguguuauagccaaguuaauccuauuacccugacggccgcgcuucugcuccugguggcccauuacgcuaucauuggacccggccugcaggccaaggcuacacgggaggcccagaaacgcgcugccgcgggcaucaugaagaacccuaccguggacgggauuacagucaucgaucucgacccgauccccuacgauccuaaauuugaaaagcagcuuggacaagugaugcugcugguucucugcgugacccagguccugaugaugagaaccacaugggcccuuugugaggcucugacgcucgccaccggccccgugucuacacugugggaagggaauccuggacgguucuggaacaccacaauugcugucuccauggccaauaucuuucgcggcagcuaucuggccggggcgggacuccuuuucucuauuaugaaaaacaccacguccacaagacggggcaccggcaauaucggggagacccugggagaaaaguggaaaagcagacugaacgcucucggcaaaucugaguuucagauuuacaagaaaagcgggauccaagagguggaccgcacacuggccaaggaaggaaucaaacggggcgagaccgaucaccaugcuguuuccagagggucugccaaacuucgcugguucguggaacggaaucuggucacacccgagggaaaagugguugaccucggcugcggcagagggggauggagcuauuacuguggcgggcugaagaacgugcgcgaggucaagggacugacgaaaggcgggccgggacacgaggaaccuauucccauguccaccuauggcuggaaccucgugcggcuucagagcggcguggauguuuucuuugugcccccugaaaagugcgacacacugcugugugacaucggggaguccucucccaauccuaccguggaagccggaagaacacuccgcgugcugaaccuugucgagaauuggcugaacaauaacacccaguucugcguuaaagugcucaauccguacaugcccagcgugauugagcggauggaaacgcugcagagaaaguauggcggggcucugguccgcaacccucucuccagaaauucuacccacgagauguacugggugagcaacgccuccggaaauaucguuucuagcgugaacaugauuuccagaaugcuuaucaaucgcuuuacaaugagacauaaaaaggcgaccuacgaacccgaugucgaccugggcagcgggacacggaacaucggaauugagucugaaaccccuaaucuggauaucauuggcaagcgcaucgagaaaauuaagcaagagcacgaagccuccuggcauuaugaccaggaucaccccuacaaaacaugggcuuaucacggcagcuacgagaccaagcagacggggucugccuccagcauggugaacggaguugugagacuccugacaaaaccgugggacgucgugccuauggugacccagauggcuaugaccgauacaacgcccuucggccaacagcgggucuuuaaggaaaagguugacaccagaacacaggagccuaaagaagggaccaagaaacuuaugaagaucacagccgaguggcuguggaaagagcucggaaagaagaaaacaccccggauguguacacgcgaagaguucaccaagaaagugagaucuaacgcggcccugggcgcuauuuuuacggaugaaaauaaguggaaauccgcccgggaggcuguggaggacaaccgcuucugggaacuggucgauaaggagagaaaucuccaucuggaagggaaaugcgagaccuguaucuauaacaugaugggaaagcgggaaaagaaacuuggcgaguuuggcaaggccaaagggagccgcgcuaucugguacauguggcugggagccagauuccucgaguuugaagcgcugggcuuccuuaaugaggaccacugguuuucccgggaaaacagccugucugggguggagggagaaggccuccauaagcugggguauauucugcgcgagguuagcaaaaaggagggcggagccauguacgcugacgauacagccggcugggacaccagaaucacaauugaagaucucaagaaugaggaaaugaucaccaaccacauggcuggggagcauaaaaagcuggccgaagccauuuucaaacuuacguaccagaauaaggugguccgggugcaacgcccuacacccagaggaaccguuauggacaucaucucccggcgcgaucagagaggcucugggcaggucggaacauauggccugaacaccuucacgaauauggaggcgcaacucauucggcagauggagggggaaggcaucuuuaaaagcauucagcaccugaccgcuuccgaggaaaucgccguccaggacuggcuugugagaguuggacgcgagcggcugucuagaauggccauuagcggcgaugacugcguggucaagccgcucgaugaccgcuucgcucgggcccugacagcucugaacgauauggggaaggugagaaaagacauccaacagugggagccuucccgcggauggaaugauuggacccagguccccuuuugcucucaccauuuccacgaacucaucaugaaggacggccggauucuggugguucccuguagaaaccaggacgagcuuaucgggcgcgcccggauuagccaaggagcgggcuggucccugagagaaacagccugccucgggaaaagcuacgcucagauguggucucugauguauuuucaucgccgggaucuuagacuggccgcuaaugccaucuguuccgcggugccuagccacugggucccgaccucucggacaaccugguccauucacgccagccaugaguggaugacgacagaagacaugcucaccguguggaacagaguguggauccuggagaaccccuggauggaggauaagaccccuguugaauccugggaggaaauucccuaccugggcaaacgcgaggaccaguggugcggaucucucaucggccugacaagccgggcuaccugggccaagaauauccagacagcuauuaaccaagugagaucccuuaucgggaaugaagaguauacggauuacaugccuagcaugaagcgcuucagacgggaggaagaggaagccggaguccugugguga

SEQ ID NO: 19727 - RNA, 9876 nt, Artificial Sequence
  derived and/or modified CDS sequence (opt5) from DENV-2__GQ868590__SS-prME
accgccggcaugaucauuaugcugauccccacagugauggcuuuccaccucacgaccagaaacggggagccucauaugauugucagccggcaggaaaagggaaaaucccugcuuuuuaagacaaaagacggcaccaauaugugcacacugauggccauggaucucggggagcugugugaagacaccaucacauacaagugcccguuccuuaaacaaaacgagcccgaagauauugacuguuggugcaauucuaccagcacguggguuaccuauggaacauguaccacaaccggcgagcaccgcagagagaagcgguccguggcgcuggugccucaugucgggaugggacucgaaacgcgcacagagaccuggaugucuagcgaaggcgcuuggaagcacgcccagagaaucgagacauggauccugcggcaucccggcuuuaccauuauggccgcuauccuggccuacaccauugggacaacgcacuuccagcgcgugcucaucuuuauucugcuuaccgcuaucgccccuuccaugacaaugagaugcauuggaaucucuaaccgggauuucguugagggcgugagcgggggauccugggucgacaucgugcuggaacacggcagcuguguuaccacaauggcgaaaaauaagcccacccucgauuuugagcugauuaaaacggaagccaagcagccugcuacacuucgcaaauauugcaucgaggccaagcugaccaacaccacaaccgacucuagauguccgacacaaggggaacccacgcucaaugaggagcaggauaagcgguucgugugcaaacauuccauggucgaccgcggauggggcaacggcugugggcuguuuggaaagggcgggauugugaccugcgcuauguucacaugcaaaaagaauauggaaggaaaaaucgugcagccugagaaccuggaauacaccgucguuauuacaccccacagcggcgaggaacaugccguggggaaugauaccggaaagcacggcaaagaggugaagaucacgccucagucuuccaucaccgaggcggaacucacaggcuaugggaccgucacaauggaguguagccccagaaccggacuggacuuuaacgaaauggugcuucugcaaauggaggauaaggccuggcucguucaccggcagugguuccuggaccuuccgcugccuuggcuccccggcgcugacacgcaggggucuaauuggauucagaaagaaacacuggugaccuuuaagaacccucaugccaaaaagcaagaugucgugguucugggaucccaggagggcgcuaugcacacagcccucaccggggccaccgagauccagaugagcuccggcaaucugcuuuucacaggacaucugaaaugccgccucagaauggacaagcugcaacuuaagggcaugucuuacagcauguguacggggaaauucaagauugugaaagaaaucgcugagacccagcacggaacaauugucauccgggugcaguaugaaggcgaugggucccccugcaagauccccuuugagauuauggaccuggagaaaagacauguccucggacgccugaucaccgugaacccuauuguuacagaaaaggauagcccggugaacaucgaggcggaacccccuuucggcgacucuuacauuaucauuggggucgagcccggccagcugaagcucgauugguuuaaaaagggauccagcaucggccaaauguucgaaaccacgaugcggggggccaaaagaauggcuauccugggagacacagccugggauuuuggcucucuugggggaauguucaccagcauuggcaaggcccugcaccagguguuuggggcuaucuacggcgccgcguucuccggaguuucuuggaccaugaaaauucucaucggcgugauuaucacauggaucgggaugaauagccgcuccaccagccugucugucucccuggugcuugugggaauuguuacacucuaucugggcgucauggugcaggcugacagcggguguguggucucuuggaagaacaaggagcugaaaugcggauccggcaucuuugugacggauaauguucacaccuggacagagcaguacaaguuccaaccugaaagccccuccaaacucgccucugccauucagaaggcucaugaggaagggaucuguggcauucggagcgugaccagacuggagaaccuuauguggaaacagaucacaccggaacugaaucacauccucuccgagaacgaggucaagcugaccauuaugacgggagacaccaaaggcaucaugcagguggggaagcgcucucugcggccucaacccacagaacuuagauauagcuggaagaccuggggaaaagccaagaugcucccuacagagcugcauaaucagaccuuucugauugacggccccgaaacagcugagugcccuaacaccaaucgcgccuggaacucccucgaaguugaggauuacggguucggaguguuuacgacaaauaucuggcugcggcuuagagagaaacaggacgucuucugugauagcaagcugaugucugcggccauuaaagacaaccgcgcugugcacgccgauaugggcuauuggaucgaauccgcucucaaugacaccuggaagaucgagaaggccagcuucauugaaguuaaaucuugccacuggcccaagucccauacccuguggagcaacggcgugcuggagucugagauggucaucccgaaaaaucuugcggggccugugagccagcacaacaaccggcccggauaccauacacaaaccgccggccccuggcaccucgggaagcuggaaauggauuuuaauuucugugagggaacgacaguggucguuaccgaagagugcggcaacagagggccuucccugcggacaaccacagcuagcggaaaacucauuaccgaauggugcugucgcucuugcacgcugccgccccuuagauaucggggcgaggacggcuguugguacgggauggagaucagaccucugaaggaaaaggaggaaaaucucguguccagccuggugaccgccggacauggccagauugauaacuuuucccuggggauccuuggaauggcucucuuccuggaggaaaugcugcgcacacgggucggcaccaaacacgccauucuccugguggccguuucuuuugugacacuuaucaccgggaauaugagcuucagagaccugggacgcgucauggugaugguuggcgcuacgaugacagaugacaucggcaugggggugaccuaccucgcgcugcuggccgcuuauaaggucagacccacauuugccgccggacuucugcuccggaaacugaccuccaaggagcucaugaugaccacaauuggcaucgugcugcuuucucagagcuccauuccugagacgauccuggaacucaccgaugcucuggcccuggggaugaugguucuuaaaauggugcgcaacauggagaaguaccaacuggcggucacaauuauggcuauccucugcgugcccaaugccgugauccugcagaacgccuggaaggucucuuguaccauucucgcuguugugagcguguccccucugcuucugacaagcucucagcagaaagccgacuggaucccccucgcgcugaccauuaagggacugaauccgacggcuaucuuccuuacaacccuguccagaaccagcaaaaagcggucuuggccucucaacgaagccauuauggccgucggcaugguguccauccuggcuagcucucuccugaaaaaugacauccccaugacagggccucuuguugccggaggccugcugaccgugugcuauguccucacaggccgcuccgcugaucuggagcuugaaaaggccacggacgugaaaugggaugaccaagcggagauuagcggguccagccccauccugucuauuaccaucagcgaggauggauccaugucuauuaagaacgaagaggaagagcagacacucaccauccugauuagaacaggccuccugguuaucagcgggcuuuuuccgguguccaucccuauuaccgccgcugccugguaccugugggaggucaagaaacagcgggcuggagugcugugggacguccccucuccuccccccgugggcaaggccgaacucgaggauggggccuaucgcaucaaacagaagggaauucugggcuacagccaaaucggcgcugggguuuauaaagaaggaacguuccacaccauguggcaugugacaagaggcgcgguccuuaugcacaaggggaagcggauugagccuuccugggccgacgugaaaaaggaucugaucucuuacggaggcggguggaaacucgaaggagaguggaaggagggcgaagagguucaggugcuggcucucgaaccgggcaaaaauccccgcgccguccagaccaagccugggcuguuuagaacaaacaccggaacaaucggcgccgugagccuugacuucucccccgggacgagcggaucuccuauuguggauaagaaaggcaagguugucgggcuguacggaaauggcguggugacccgguccggcgcuuaugucagcgccaucgcgcagacagagaaaucuauugaagacaaccccgagaucgaggaugacauuuuuagaaagcgccggcugaccaucauggaccuccauccuggggcuggaaaaaccaagaaguaccugccggccaucgugagagaagccauuaaacgcggccuucggacacugauccucgcucccacgagaguuguggccgcggagauggaagaggcucugcgcgggcucccuauucgguaucaaacccccgccaucagagccgaacacacaggacgcgagauugucgaucugaugugucaugcuaccuucacaaugcggcuucuguccccuaucagagugcccaacuacaaucugauuaucauggacgaggcccacuucaccgauccggcuagcaucgccgcgcggggcuauauuuccacgcgcguugaaaugggggaggccgcuggcaucuuuaugacagccaccccucccggaucuagagaccccuucccucagagcaacgcucccauuauggaugaagagcgggagaucccugaacgcuccuggaauagcggccacgagugggugaccgacuuuaaggggaaaacagucugguucgugccgucuauuaagaccggaaacgauaucgccgccugccucagaaaaaauggcaagcggguuauccagcuguccagaaagacauuugacagcgaauacgugaaaacccgcacgaacgauugggacuucgucgugacaaccgauauuucugagaugggggcuaauuuuaaggcggaacgggugaucgaccccagacgcuguaugaaaccugucauucuuacagacggagaggagcggguuauccuggccggccccaugccugugacccauagcuccgcugcccaaagacgcgggcggauuggcagaaacccccgcaaugaaaacgaucaguauaucuacaugggagagccgcucgaaaaugacgaggauugcgcccacuggaaggaagcuaaaaugcugcuggacaacaucaauacgccugagggcauuauccccucuauguucgggccugagagagaaaagguggaugccauugacggagaguaccggcuccgcggcgaagcgagaaaaaccuuugucgagcuuaugcggcgcggggaucugcccguguggcuggcuuauaagguugccagcgaaggaaucaacuacgccgacagacggugguguuucgauggcacaagaaauaaccagauucucgaggagaacguggaagucgagaucuggaccaaggaaggggagcgcaaaaagcugaaaccucgguggcuugacgcuagaauuuauuccgauccccuggcccucaaggaguuuaaagaauucgcggccggccgcaagucucugacacugaaucucaucaccgagaugggacggcuuccgacauucaugacccagaaggcuagagacgcccuggauaaccuggcugugcuccauacggccgaagcuggcgggaaagccuacaaucacgcgcugagcgagcuuccugaaacacuggagacccuccugcugcucacccuucuggccacaguuaccggaggcaucuuucuguuccucauguccgggcggggaauuggcaagaugacacugggcaugugcugcaucauuacggcuagcauccuucugugguaugcccaaauucagccccacuggaucgcugccucuaucauucucgaguuuuuccugaucgugcugcucauucccgaaccugagaaacagcgcaccccgcaggacaaccaacuuacauacgucaucauugccauccugaccguggucgcugcgacaauggccaaugaaaugggguuucuggagaagaccaaaaaggaccucggacugggccauaucgcuacgcagcagcccgaauccaacauucuugauaucgaccugagaccugccagcgccuggacccucuaugcuguggccacaaccuucauuacacccaugcugcggcacuccaucgagaauucuagcguuaacgugucccugaccgcgauugccaaucaggcuacggugcucauggggcuuggaaagggcuggccucugucuaaaauggauaucggggucccccugcucgccauuggauguuacagccaaguuaacccuaucacacugaccgcugcccuucugcuccugguggcgcauuacgccaucauuggcccgggccugcaggcuaaggccacacgcgaggcucagaaaagagccgcugccgggaucaugaagaaucccaccguggacggaauuaccgucaucgaucucgacccuauucccuaugauccuaaauuugaaaagcagcuuggccaagugaugcugcugguucucugcgugacacagguccugaugaugcggacgaccugggcgcuuugugaggcccugacacucgcuaccgggcccguguccacacugugggaaggaaacccgggccgcuucuggaauaccacgaucgccgucagcauggcuaacaucuuuagagggucuuaccuggccggagccggccuccuuuucuccauuaugaagaauacaaccagcacccggcgcggcacagggaacaucggagagacccugggcgaaaaauggaagucuagacugaaugcgcucgggaaauccgaguuucagauuuauaagaaaagcggaauccaagagguggaccggacacuggcuaaggaaggcauuaaaagaggggagacggaucaccaugccguuucucgcggaagcgcuaagcuucggugguucguggaaagaaaccuggucaccccugagggcaaggugguugaccucggcugcgggcgcggaggcugguccuacuauugugggggacugaaaaacgugcgggaggucaagggccugacaaaagggggacccggccacgaagagcccaucccuaugucuaccuacggcuggaaucucgugagacuucagagcgggguggauguuuuuuucauccccccugaaaagugcgacacacugcugugugauauuggagaguccagcccgaaccccaccgucgaagccggccgcacgcuccgggugcugaaucuuguggaguccuggcugaacaauaacacccaguucugcgucaaaguucucaauccuuauaugcccucugugaucgagagaauggaaacacugcagcgcaaguacgggggagcccuggugcggaacccucucagcagaaauuccacccacgagauguacugggucucuaacgcuagcggcaaugugguuuccucugugaacaugauuagccgcaugcuuaucaaucgguuuacaaugagacauaagaaagccaccuaugaacccgacgucgaccugggguccggaacacgcaacauuggcaucgagagcgaaaccccgaaucuggauaucauuggcaagagaaucgagaaaauuaagcaagagcacgaagcgucuuggcauuacgaccaggaucacccuuauaaaacgugggccuaccacggguccuaugagacaaagcagaccggaagcgcuucuuccauggugaacggcguugugcggcuccugaccaagcccugggacgucgugccuauggugacacagauggccaugacggauaccacacccuucgggcaacagcgcgucuuuaaagaaaagguugacaccagaacacaggagccuaaagaaggaaccaagaaacuuaugaagaucacagcugaguggcuguggaaggagcucggcaaaaagaaaaccccccggauguguacgagagaagaguucaccaagaaagugcggagcaacgccgcgcugggggccauuuuuacagaugaaaauaaguggaaaucugcucgcgaggccguggaggacaacagauucugggaacuggucgauaaggagcggaaucuccaucuggaaggaaagugcgagaccuguguguacaacaugaugggcaaacgcgaaaagaaacuuggcgaguuugggaaggcuaaaggauccagagccaucugguauauguggcugggcgcucgguuccucgaguuugaagcccugggguuccuuaaugaggaccacugguuuagccgcgaaaacucccugagcggaguugagggcgaagggcuccauaagcugggcuacauucugagagaggugucuaagaaagagggaggcgcgauguacgccgaugacacagcugggugggacacccggaucacgaucgaagaucucaagaaugaggaaaugauuacaaaccacauggccggagagcauaaaaagcuggcugaagccaucuucaaacuuaccuaucagaauaaggucgugcgcguucaaagaccgacaccuauuggcaccgugauggacaucauuagccggcgcgaucagagaggguccggacaggucggcacguacgggcugaacaccuuuacaaauauggaggcccaacucauccggcagauggagggcgaaggaaucuucaagucuauucagcaccugaccgcgagcgaggaaaucgcugugcaggacuggcuuguucgcgugggcagagagcggcuguccagaauggccauuucuggggaugacugcgucgugaaaccccucgaugaccgcuucgcccgggcucugacagcccugaacgauaugggaaaggucagaaaagacauccaacagugggagcccagccgcggcuggaaugauuggacccaggugccuuuuugcucccaccauuuccacgaacucauuaugaaggacgggcggacacugguugugccguguagaaaccaggaugagcuuaucggacgcgcucggaucucucaaggcgccggguggagccugagagaaaccgcgugccucggcaaauccuaugcccagauguggagccugauguacuuucaucgccgggaccuuagacuggcugccaaugcuauuuguucugccguccccucccacugggugccuacgagccgcacaaccuggucuauccacgcgucccaugaguggaugaccacagaagacaugcucaccguguggaaccggguuuggauucuggagaaccccuggauggaggauaagacaccuguggaaagcugggaggaaauccccuaucugggaaagagagaggaccaguggugcggcucccucauugggcugacgucucgggccaccugggcuaaaaauauccagacagccauuaaccaagucagaagccuuaucggaaaugaagaguacaccgauuauaugccuuccaugaagcgcuuccggagagaggaagaggaagcuggcgugcugugguga

SEQ ID NO: 19728 - RNA, 9876 nt, Artificial Sequence
  derived and/or modified CDS sequence (opt5) from DENV-2__GQ868497__SS-prME
accgccagcgugaucgucaugcugauucccacaguuauggcuuuccaccucacgaccagaaacggcgagccucauaugaucguggggcggcaggaaaagggaaaaucccugcuuuuuaagacagaggacggcgugaauaugugcacccugauggccauugaucucggggaacugugugaggacacaaucaccuacaaaugcccgcuucugcgccaaaacgaacccgaggauauugacuguuggugcaauucuacaagcaccugggucacguauggaaccuguuccacaaccggcgagcacagacgggaaaagcgcucuguggcgcucguuccucauguggggaugggacuggagacaagaaccgaaacguggaugagcuccgagggcgcuuggaaacacguccagcggaucgagacauggauccugcgccaucccggcuucaccauuauggccgccauccucgcuuacacaauugggaccacccacuuucagagagcccugaucuucauucuucugacagcuguggccccuucuaugacgaugcggugcaucggaauuagcaaccgcgauuuuguugaaggcguguccgggggaagcugggucgacaucgugcucgagcacggcucuugugugaccacaauggcgaagaauaagcccacccuggauuucgaacuuaucaaaacagaggccaagcagccugcuacccugagaaaauauugcauugaagccaagcucacgaacacaaccaccgagucccgguguccgacacaaggggagcccagccugaaugaagagcaggacaaacgcuuuaucugcaagcauucuauggucgauagaggauggggcaacggcugugggcuguucggaaagggcgggauuguuaccugcgcuauguuuacaugcaaaaagaauauggaaggaaaagugaugcagccugagaaccucgaauacacgaucgugauuaccccccacuccggcgaggagcaugccgucgggaaugacacaggaaagcacggcaaagaaaucaagaucaccccucagagcucuauuacagaggcggaacugaccggcuaugggacggugaccauggaguguuccccccggacaggacuugauuucaacgaaaugguucugcuccaaauggaggacaaagccuggcuggugcaccgccagugguuucuugaucugccgcucccuuggcugcccggcgcugacacccaggggagcaauuggauccagaaggagacacuggucaccuucaagaacccucaugccaaaaagcaagacgugguugugcucggaucccaggaaggcgcuaugcacacggcccugacaggggccaccgagauucagaugucuagcggcaaucuucuguuuacaggacaucucaaaugcagacugcggauggauaagcuucaacugaaaggcauguccuacagcauguguaccgggaaguucaagaucgucaaagaaauugcugagacccagcacggaacaaucgugaucagaguccaguaugagggcgacgggucucccugcaagauucccuucgaaaucacggaucucgagaaacgccaugugcugggacggcugauuaccguuaacccuaucgugacagaaaaggacuccccggucaacauugaggcggaacccccuuuuggcgauagcuacaucauuaucgggguggagcccggccagcucaaacugaauugguucaagaagggaucuagcaucggccaaauguuugagaccacaaugagaggggccaaacgcauggcuauucuuggagacaccgccugggauuucggcucccuggggggaguuuuuacgucuaucggcaaggcccuccaccagguguucggggcuauuuacggcgccgcguuuagcggagucuccuggacaaugaaaauccugauuggcgugaucaucaccuggauugggaugaacagccggucuaccucccugagcgugucucuuguucucgucggaguggugacacuguaucugggcgcuaugguccaggccgacuccgggugugugguuagcuggaagaauaaagaacucaagugcggauccggcaucuucauuaccgauaacgugcacacauggacggagcaguacaaguuucaaccugaaucucccagcaaacuggccuccgcuauccagaaggcccaugaggaagggauuuguggcaucagaucugucacccgccuugagaaucugauguggaaacagaucacaccggagcucaaccacauucugagcgaaaaugaggugaagcugaccaucaugacaggagacauuaaaggcaucaugcaggcugggaagcggucccuuagaccucaacccaccgaacucaaauauagcuggaagacguggggaaaggccaaaaugcugucuaccgagucccauaaccagacauuccugauugauggcccugaaaccgcggagugccccaauacaaaccgcgccuggaauagccucgagguugaagacuacggguuuggaguguucaccacaaacaucuggcugaagcuucgggagaaacaggacgucuuuugugauucuaagcugauguccgcugccaucaaagacaauagagcugugcacgccgauaugggcuauuggauugaaagcgcgcucaacgacaccuggaagauggagaaggccucuuucaucgagguuaaaagcugccacuggccuaagucccauacgcuguggagcaauggcgugcuggaaucugagaugauuauccccaaaaacuucgcugggccggucucccagcacaacuaccgcccuggauaucauacacaaaccgccggccccuggcaccuugggaagcucgaaauggauuuugacuucugugagggaaccacagugguggucaccgaagauugcggcaaucgggggcccagccugagaacgacaaccgcuuccggaaaacugauuacagaguggugcugucggucuugcacccucccuccgcugcgcuacagaggcgaggacggcuguugguacgggauggaaauccggccccuuaaggagaaggaagagaaccugguuaauagccucgugacagccggacauggccagauugauaacuuuucccugggggugcugggaauggcccuuuuccucgaagagaugcugagaacccgcaucggcacgaaacacgcuauccugcucgucgcggccucuuuugugacccugauuacagggaauaugagcuuccgggaccuuggaagaguuauggugauggucggcgcuaccaugacagaugacaucggcaugggggugaccuaucuggcccuccuggccgcuuuuaagguucgcccuacguucgccgcgggacugcuucugagaaaacucacauccaaggagcugaugauggcuaccauuggcaucgcccuccugucucagagcacaauucccgaaaccauccuugagcugaccgaugcccucgcucuggggaugauggugcugaaaaucguccggaacauggaaaaguaccaacuugccgugacaauuauggcgaucuccugcguuccuaaugcugugauucugcagaacgccuggaaggucagcuguacgauccucgccgcugugucuguguccccccugcuccugaccagcucucagcagaaagccgacuggauuccucuugcucugacaaucaagggacucaaucccaccgccaucuuucugacaacccugucccgcacgagcaaaaagagaucuuggccgcuuaacgaggcggucauggccguuggcaugguguccauucuggcuagcucccuccugaaaaaugacaucccuaugacagggccccucguggccggaggccugcuuaccgucugcuaugugcugaccggccggagcgcugaucuggaacucgagcgcgccgccgacguuaagugggaggaucaagcugaaauuucugggagcuccccuauccugucuauuacaaucagcgaggacggauccaugucugugaaaaacgaagaggaggaacagacccuuacaauucugaucagaacgggccuccuggucaucagcgggguguuccccguuuccauuccgaucaccgcggccgcuugguaccucugggaggugaagaagcagcgggccggaguccugugggaugugccuucucccccucccgucgaaaaagccgagcuugaagacggcgcuuaucgcauuaagcagagagggauccugggauacagccaaauuggcgccggcguguauaaagaggggacauuucacaccauguggcauguuacacggggagcggugcugaugcaccgcggcaagagaaucgagcccuccugggcugaugucaaaaaggaccucaucagcuacgggggaggcuggaagcuggaaggggaguggaaagaaggagaggaagugcagguucuugcccuggagccuggcaagaauccgcgggccgugcagaccaaacccggcauuuucaagacgaacaccgggacaaucggagcugucucucucgauuuuuccccuggcaccagcgggucucccauuguggacagaaaaggaaaggugguuggccuguacgggaauggagucgugacacgcuccggcgccuaugugagcgcgaucgcucagaccgagaaguccauugaagauaacccugagaucgaagacgauaucuuccggaaaaagagacucacaauuauggaccugcaucccggcgccgggaaaacgaagcgcuaccuuccugccaucguccgggaggcuauuaaaagaggacugcgcacccugauccucgccccgacacgggugguugcugccgaaauggaggaggcgcugagaggccuucccauucgcuaucaaaccccugccaucaagaccgaacacacagggcgggagauuguggaccugaugugucaugcuacguucaccaugagacuccugucucccguccgggugccuaacuacaaucucaucaucauggaugaagcccacuuuacagaccccgcuagcauugccgcccgcggauauaucuccaccagaguugagaugggcgaggcugcggggauuuucaugacagccaccccgccuggcagccgggaucccuuuccccagucuaacgcuccuaucauggacgaagagcgcgaaauucccgagagauccuggaauagcggacacgaaugggugacggauuucaagggcaaaacagucugguuugugccuucuaucaaggccgggaacgacaucgccgcuugccugcggaaaaauggaaagaaaguuauucagcuuagcagaaagaccuucgauuccgaguacgugaagacccgcgccaacgacugggauuuugucgugacaaccgacaucucugagaugggcgcgaauuucaaagcugaacgggugauugauccgagacgcuguaugaagcccgucauccugacagacggggaggaacggguuauucuggccggaccuaugcccgugacccauagcuccgccgcucaaagacgcggccggaucgggagaaacccuaaaaaugagaacgaccaguauaucuacaugggcgaaccccucgagaaugaugaggacugcgcccacuggaaggaagcgaaaaugcugcuugauaacauuaauacgccggagggaaucauuccuucuauguuugaacccgagcgcgaaaagguggacgccaucgauggcgaguacagacugcggggggaggcucgcaaaacauucgucgaccucaugagacggggagaucugccuguguggcuggccuauaagguugcugccgaaggcauuaacuacgcugaccgcaagugguguuuugaugggaucaaaaauaaccagauucucgaggaaaacauggagguggagaucuggaccaaggaaggagagagaaaaaagcuuaaaccccgguggcuggacgccagaaucuauagcgauccucuggcgcucaaggaauucaaggaguucgccgcuggccgcaaaucccugacacuuaaucugauuaccgaaauggggcggcuccccacguuuaugacccagaaggccagaaacgcucuggacaaucuggccguccuccauacagccgaggcuggcggacgcgcguacaaccacgcccuuagcgagcugccggaaacccuggagacacuccugcuucugacccuccuggcuacagugaccggcgggaucuuccuguuucucaugucuggaaaaggcauugggaagaugacgcuuggaaugugcugcaucauuacagccuccauccugcugugguaugcccaaauccagccucacuggauugcugccagcaucauucucgaauucuuucugaucguucuucugauucccgagcccgaaaaacagcggaccccucaggauaaucaacucaccuacguggucaucgcgauccugacaguggucgccgcuaccauggccaacgagaugggcuuccuggagaagacaaagaaagaccucggccuuggguccauuacgacccaggaaucugagagcaauauccuggacauugaucugagaccggcuuccgccuggacacucuaugcgguggccaccacauuuguuacccccaugcugcggcauucuaucgaaaacagcuccgugaaugugagccuuacggcuauugccaaccaggcuaccguccugaugggacucggcaagggguggccucugucuaaaauggacaucggaguuccccugcucgccauuggcuguuacucccaggugaauccuaucacacuuaccgcugcccugcugcuccugguggcgcacuacgccaucauugggcccggacuucaagcuaaggccacacgcgaggcucagaaaagagccgccgcgggcaucaugaagaacccuaccgucgauggcauuacggugaucgaccuggaaccgauucccuaugauccuaaguucgagaaacagcucgggcagguuaugcugcugauccucugcgugacacaaguccuuaugaugcggaccacaugggcucugugugaggcccugacccucgcuaccggacccaucagcacacugugggaaggcaauccugggcgcuuuuggaacacgaccauugccgugucuauggccaauaucuucagaggauccuaccuugcuggcgccgggcugcucuuuagcauuaugaagaacacaaccaauacacggcgcggaaccggcaacaucggcgagacgcugggggaaaaauggaagucuagacugaacgcgcucggaaaaagcgaguuccagauuuauaagaaauccggcauccaggaggucgaccggacacuugccaaggaagggaucaagcgcggagagaccgaucaucacgcugugucuagaggcagcgccaaacugcggugguuuguugaaagaaauauggugacccccgaggggaaggucguggaccugggaugcggccgcggcgggugguccuacuauuguggaggccucaaagauguucgggaagugaaggggcugacaaaaggaggcccggggcaugaggagccuauucccaugagcaccuacggauggaaccuugucagacugcaauccggcaucgacguguucuucacacccccugaaaagugcgauacgcuccugugugacauuggcgagucuagccccaauccuaccaucgaagcugggcgcacacugcgggugcucaaccuuguugagaauuggcugaacaauaacacccaguuuugcauuaagguccugaauccguauaugcccuccgugaucgaaaaaauggagacacuccagagaaaguacggaggcgcccuggugcgcaacccucuuucucggaauagcacccacgagauguacugggucuccaacgcgacggggaauaucguuucuagcgugaacaugauuuccagaaugcugaucaaucgcuucaccaugaaacacaagaaagccacauaugaacccgauguggaccucggaagcggcacccggaacauugggaucgagucugaaauuccuaaccuggacaucauuggaaagagaaucgagaagaucaaacgcgaacaugagacauccuggcacuacgaucaggaccaucccuauaagaccugggcuuaccacggcagcuaugagacaaaacaaaccggcucugccuccagcauggucaauggggugguucggcugcucacgaagccgugggauguggucccuauggugacacagauggcuaugaccgacaccacacccuuuggacagcagagaguuuucaaagaaaagguggauacgcgcacccaagagccuaaggaaggcacaaaaaagcuuaugaaaauuaccgccgaguggcuguggaaggagcuggggaaaaagaaaacacccagaauguguacccgggaagaguuuacacgcaaggucagaucuaacgcugcccucggagcgaucuucaccgacgaaaauaaguggaaauccgcccgggaggcuguggaagauggcagauuuugggagcugguggaccgggagcgcaaccuucaccuggaagggaagugcgagacgugugucuacaauaugaugggaaaaagagaaaagaaacucggcgaguucggcaaggccaaggggagccgggcuauuugguauauguggcugggagcccgcuuucuggaauucgaggcccucggcuuucugaacgaggaucauugguucuccagagggaauagccuuucuggaguugaaggcgaggggcugcaccggcucggcuacauccugcgcgacgugggaaaaaaggaaggcggggcgauguacgcugaugacaccgccggaugggacacaagaauuacccuugaggaucugaaaaacgaagagauggugacaaaucauaugaagggcgagcacaaaaagcucgccgaagcuaucuuuaagcugaccuaucagaacaaagucgugcggguucagcgcccuacgcccagagggacagugauggacaucauuagccggcgcgaucagagaggauccggccaagucgggaccuacggccugaauacauucaccaacauggaggcccagcucauccggcagauggaaggagagggcauuuucaagucuauccaacaucugacggcuaccgaggaaauugccgugcagaauuggcuugcgcgcguugggagagagcggcugagcagaauggccaucuccggagacgauugcguggucaaaccgaucgacgaucgcuuugcuucugcccucacagcucugaacgacaugggcaaggugcggaaagauauucagcagugggaaccuagcagaggguggaaugacuggacccaaguucccuucugcucccaccacuuucaugagcuugugaugaaggauggacgcguccuggugguccccugucggaaccaggacgaacucaucggcagagcccgcauuucucagggggcgggcuggagccugaaggagacagccugccugggaaaauccuaugcucagauguggacccucauguacuuccaccggagagaucugcgccuugccgcuaacgccaucuguagcgcugugccuucucauuggguuccgacaucccggaccacguggagcauucacgccaagcacgaguggaugacaaccgaagacaugcuggcgguguggaauagagucuggauccaagagaaccccuggauggaagacaaaaccccuguggagucuugggaagaggugcccuaucucggcaagcgcgaggaucaguggugcgggucccugauuggacuuacaagccgggccaccugggcuaaaaauauccagacagccaucaaccagguuagaucccugauuggcaaugaagaguacacggacuauaugccuucuaugaagcgguuuagaaaggaagaggaagaggccggggugcucugguga

SEQ ID NO: 19729 - RNA, 9876 nt, Artificial Sequence
  derived and/or modified CDS sequence (opt5) from DENV-2__GU131959__SS-prME
accgccggagugaucgucaugcugauucccaccguuauggcuuuccaccucacgacccggaauggggagccucauaugaucgugggacggcaggaaaagggcaagagccugcuuuuuaagacggaggacggggugaauaugugcacccugauggccauugaucucggagaacugugugaggacacaaucaccuacaagugcccgcuucugcgccaaaaugaacccgaggauauugacuguuggugcaauuccacaucuaccugggucacguauggcaccuguagcacaaccggggagcacagacgggaaaagcgcuccguggcgcucguuccucaugugggaaugggccuggagacaagaaccgaaacguggaugucuagcgagggcgcuuggaaacacguccagcggaucgagacauggauccugcgccaucccggguucaccauuauggccgccauccucgcuuacacaauuggaaccacccacuuucagagagcccugaucuucauucuucugacagcuguggccccuuccaugacgaugcggugcaucggcauuucuaaccgcgauuuuguugaaggggugagcggaggcuccugggucgacaucgugcucgagcacgggagcugugugaccacaauggcgaagaauaagcccacccuggauuucgaacuuaucaaaacagaggccaagcagccugcuacccugagaaaauauugcauugaagccaagcucacgaacacaaccaccgagucucgguguccgacacaaggagagcccucccugaaugaggaacaggacaaacgcuuuaucugcaagcauagcauggucgauagaggcuggggcaacggguguggacuguucggcaaagggggaauuguuaccugcgcuauguuuacaugcaaaaagaauauggaaggcaaaguggugcagccugagaaccucgaauacacgaucgucauuacaccccacucuggggaggagcaugccgugggaaaugacacaggcaagcacggcaaagaaaucaagaucaccccucaguccagcauuacagaggcggaacugaccggguauggaacgguuaccauggaguguucuccccggacaggccuugauuucaacgaaauggugcugcuccaaauggaggacaaagccuggcugguccaccgccagugguuucuugaucugccgcucccuuggcugcccggggcugacacccagggauccaauuggauccagaaggagacacuggugaccuucaagaacccucaugccaaaaagcaagacguugugguccucggcagccaggaaggggcuaugcacacggcccugacaggcgccaccgagauucagauguccucuggaaaucuucuguuuacaggccaucucaaaugcagacugcggauggauaaacuucaacugaaagggaugagcuacuccauguguaccggaaaguucaagaucgugaaagaaauugcugagacccagcacggcacaaucgucaucagagugcaguaugagggggacggaagccccugcaagauucccuucgaaaucacggaucucgagaaacgccauguucugggccggcugauuaccgugaacccuaucgucacagaaaaggacucuccggugaacauugaggcggaacccccuuuuggggauuccuacaucauuaucggcguugagcccggacagcucaaacugaauugguucaagaagggcagcucuaucgggcaaauguuugagaccacaaugagaggagccaaacgcauggcuauucuuggcgacaccgccugggauuucgggagccugggaggcguguuuacguccaucgggaaggcccuccaccaggucuucggcgcuauuuacggagccgcguuuucuggcgugagcuggacaaugaaaauccugauuggggugaucaucaccuggauuggaaugaacacccgguccacaagccugucuguuucccuuguccucgugggcguggucacccuguaucugggggcuauggugcaggccgacagcggauguguugugucuuggaagaauaaagaacucaagugcggcuccgggaucuucauuacagauaacguccacacguggaccgagcaguacaaguuucaaccugaaagccccuccaaacuggccucugcuauccagaaggcccaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggcuggaaagcggucucuuagaccucaacccacggaacucaaauauagcuggaagaccuggggcaaggccaaaaugcuguccacagagagccauaaccagaccuuccugauugaugggccugaaacagcggagugccccaauaccaaccgcgccuggaacucucucgagguggaagacuacggauuuggcgucuucacaaccaacaucuggcugaaacuucgggagaaacaggacguguuuugugauuccaagcugaugagcgcugccaucaaagacaauagagcuguucacgccgauaugggcuauuggauugaaucugcgcucaacgagacguggaagauggagaaggccuccuucaucgaagugaaaagcugcuacuggccuaagucucacacacuguggagcaaugggguccuggaguccgaaaugauuauccccaaaaacuucgcuggaccggugagccagcauaacuaucgcccuggcuaccacacccaaaccgccgggcccuggcaucuuggaaagcucgagauggacuuugaucugugugaaggcacaaccguggucguuacggaggacugcgggaaucggggacccucucugagaacaaccacagcuuccggcaaacucauuaccgaguggugcugucggagcugcacacugccuccgcuucgcuacagaggcgaagauggguguugguauggaauggagauccggccccugaaggaaaaggaggaaaaccucgugaauagccuggugaccgccggccacgggcagauugacaacuucucucugggaguccuuggcauggcccucuuucuggaggagaugcugagaacgcgcaucgggaccaaacaugcuauccuccugguggcggccagcuucguuacacuuauuaccggaaauauguccuuucgggaucugggcagagugauggucauggugggcgcuacaaugaccgacgauaucgggaugggaguuacguaccucgcccugcuggccgcuuucaaggugcgcccuacauuugccgcgggccuucugcucagaaaacugaccucuaaggaacucaugauggcuacaauugggaucgcccugcuuagccaguccaccauucccgagaccauccuggaacucacagacgcccuggcucugggaaugaugguccuuaaaaucgugcggaacauggagaaguaucaacuggccguuacgauuauggcgaucucuugcgugccuaaugcugucauucuccagaacgccuggaaggugagcuguaccauccuggccgcuguguccgucagcccccuccugcuuacaucuucccagcagaaagccgauuggauuccucuggcucucaccaucaagggccugaaucccacagccaucuuccugaccacgcuuagccgcacaucuaaaaagagauccuggccgcugaacgaagcgguuauggccguggggauggugagcauucucgcuucuucccugcucaaaaaugacaucccuaugaccggaccccuggucgccggcggccuucugaccgugugcuacguucugacagggcggagcgcugaccucgagcuggagcgcgccgccgaugugaagugggaagaccaagcugagauuuccggaagcucuccuauccuuagcauuaccaucuccgaagauggcucuaugagcauuaaaaacgaggaggaagaacagacacugacgauccucaucagaaccgggcugcucgucauuuccggaguguuucccguuucuaucccgauuacagcggccgcuugguaucugugggaagugaagaagcagcgggccggcguccuuugggacgugccuucucccccucccgucgagaaagccgaacuggaggauggggcuuaccgcaucaagcagagaggcauucugggauauucccaaaucggcgccgggguguacaaagagggaaccuuccacacaauguggcacguuacccggggcgcggugcucaugcaucgcgggaagagaaucgaacccuccugggcugacgucaaaaaggaucugauuagcuacggaggcggguggaaacuugagggagaauggaaagagggcgaagaggugcagguucuggcccucgagccuggcaagaauccgcgggccgugcagacgaaacccgggaucuuuaagaccaacacaggaaccauuggcgcugucucccuggacuucagcccugggacaucuggaucccccaucguggauagaaaaggcaaggugguugggcucuauggaaauggcgucgugacccgcagcggcgccuacgugucugcgauugcucagacagaaaaguccaucgaggacaacccugaaaucgaggaugacauuuuucggaaaaagagacugacgaucauggaucuucaccccggggccggaaaaaccaagcgcuaucugccugccauuguccgggaagcuaucaaaagaggccugcgcacacucauucuggccccgacccgggugguugcugccgagauggaggaagcgcuuagagggcugcccauccgcuaccaaaccccugccauuaagacagagcauacgggacgggaaaucguggaccucaugugucacgcuaccuucacaaugagacugcucagccccguccgggugccuaacuauaaucugaucauuauggacgaggcccauuucaccgaucccgcuuccaucgccgcccgcggcuacauuucuacaagaguugagaugggggaagcugcgggcaucuuuaugaccgccacgccgccuggaagccgggaccccuucccccaguccaacgcuccuauuauggaugaggaacgcgagauccccgaaagaagcuggaacucuggccacgagugggugacagacuuuaaggggaaaaccgucugguucgugccuuccaucaaggccggaaacgauauugccgcuugccuucggaaaaauggcaagaaaguuauccagcugagcagaaagaccuuugacucugaguaugugaagacacgcgccaacgauugggacuucgucgugaccacagauauuagcgaaaugggggcgaauuuuaaagcugagcgggugaucgacccgagacgcuguaugaagcccgucauucugaccgauggagaggaacggguuauccucgccggcccuaugcccgugacgcacuccucugccgcucaaagacgcgggcggaucggcagaaacccuaaaaaugaaaacgaccaguacauuuacaugggagagccccuggagaaugacgaagauugcgcccauuggaaggaggcgaaaaugcuucuggacaacaucaauacaccggaaggcauuaucccuagcauguucgagcccgaacgcgagaagguggaugccauugacggggaguauagacuccggggagaagcucgcaaaaccuuugucgaucugaugagacggggcgaccugccuguguggcucgccuacaagguugcugccgaggggaucaacuaugcugaucgcaagugguguuucgacggaauuaaaaauaaccagauccuugaagagaacauggagguggaaaucuggacaaaggagggcgaacgcaagaagcugaaaccccgguggcuggaugccagaauuuacuccgacccucucgcgcugaaggaguuuaaggaguucgccgcugggcgcaaaucucuuacccugaaucucaucacggagaugggccggcugcccaccuucaugacacagaaggccagaaacgcucuggauaaucucgccguccuucacaccgccgaggcuggaggccgcgcguauaaccaugcccugagcgaacugccggagacacucgaaacccugcuucugcucacacugcuggcuaccgugacagggggaauuuuucucuuccuuauguccggcaaagggaucggaaagaugacacugggcaugugcugcauuaucaccgccagcauccugcucugguacgcccaaauucagccucacuggaucgcugccucuauuauccuggaguuuuuccuuauuguucugcucauccccgaacccgagaaacagcggaccccucaggacaaucaacugacauauguggucaucgcgauucugaccguggucgccgcuacaauggccaacgagaugggcuuucucgaaaagacgaagaaagaucuugggcugggauccaucaccacacaggagagcgaauccaauauucuggacaucgaccucagaccggcuucugccuggacccuguacgcgguggccacaaccuucguuacgcccaugcuucggcacagcauugagaacuccucugugaaugugagccugaccgcuaucgccaaccaggcuacaguccucaugggccuggggaagggauggccucuguccaaaauggauauuggcguuccccuccuugccaucggguguuacagccaggugaauccuaucacccugacagcugcccugcuccugcuuguggcgcauuaugccauuaucggacccggccugcaagcuaaggccacccgcgaagcucagaaaagagccgccgcgggcauuaugaagaacccuacggucgacgggaucacagugauugaucucgagccgauccccuacgacccuaaguuugagaaacagcugggacagguuaugcugcucauccuuugcgugacccaaguccugaugaugcggacaaccugggcucugugugaagcccucacccuggcuacaggccccauuucuacgcuuugggaggggaauccuggacgcuucuggaacaccacaaucgccguguccauggccaauauuuuuagaggcagcuaucuggcuggggccggacuccuguucucuaucaugaagaacaccacaaauacccggcgcggcacgggcaacauuggggaaacacugggagagaaauggaaguccagacucaacgcgcuuggcaaaagcgaguuucagaucuacaagaaaucugggauccaggaagucgaucggacccuggccaaggagggaauuaagcgcggcgaaaccgaccaccaugcugugagcagaggguccgccaaacugcggugguucguugagagaaauauggugacacccgaaggaaaggucguggaucucggcugcggccgcgggggauggucuuauuacuguggcgggcugaaagacguucgggaggugaagggacuuaccaaaggcgggccgggacacgaggaaccuauccccaugagcacauauggcuggaaccuggucagacuccaauccggcauugauguguuuuucacgcccccugagaagugcgacacccugcugugugauaucggggaaagcucccccaauccuacaauugaggcuggacgcacccuccgggugcuuaaccugguugaaaauuggcugaacaauaacacacaguucugcaucaagguccucaauccguacaugcccucugugaucgagaaaauggagacccugcagagaaaguacggcggggcccuugugcgcaacccucugagcagaaauuccacgcaugaaauguauugggucucuaacgcgaccggaaauauuguuagcuccgugaacaugaucucuagaaugcucauuaaucgcuuuacaaugaaacacaagaaagccaccuacgagcccgacguggaucugggcagcgggacacggaacaucggaauugaauccgagaucccuaaccuggacauuaucggcaagagaaucgaaaagauuaaacaggagcacgagaccagcuggcauuaugaccaagaucaccccuacaagacaugggcuuaucauggcucuuacgaaaccaaacagacgggguccgccagcucuauggucaauggagugguucgccuccuuacaaagccgugggacguggucccuauggugacccagauggcuaugaccgauacaacgcccuucggccagcaacggguuuuuaaagagaagguggacaccagaacacaggaaccuaaggaggggaccaaaaagcugaugaaaaucacagccgaguggcuguggaaggaacucggcaagaagaaaacccccagaauguguacaagagaggaguucacccggaagguccgcuccaacgcugcccugggcgcgauuuuuacggaugagaauaaguggaaaagcgccagagaagcuguggaggacgggcgguucugggagcuuguggauagagaacggaaccugcaccucgagggaaagugcgaaaccugugucuauaauaugaugggcaaacgcgagaagaaacugggcgaauuugggaaggccaagggaucuagagcuaucugguacauguggcugggcgcccgguuccucgaguuugaggcccugggguuccuuaacgaagaccacugguuuucccgcggaaauagccuguccggcguugagggggaaggccuccauagacugggauacauucuucgggaugugggcaaaaaggaagggggagcgauguaugcugacgauacagccggcugggacacccgcaucacacuggaagaccucaaaaacgaggagauggugaccaaucacaugaagggggaacauaaaaagcuggccgaggcuaucuucaagcugacguaccagaacaaagucgugagaguucagcggccuacaccccgcggaaccgugauggauauuaucagcagacgggaccaacgcggcucugggcaggucggcacauauggacucaauaccuuuacgaacauggaagcccagcugauuagacaaauggagggcgaggggaucuucaagagcauucagcaccuuaccgcuacagaagagaucgccgugcagaauuggcuggcgcggguuggacgcgaaagacucucccggauggccaucucuggcgaugacugcguggucaaaccgauugaugacagauucgcuagcgcccugaccgcucuuaacgauauggggaaggugcgcaaagacauccagcaaugggagccuucccggggauggaaugauuggacacagguucccuuuugcucucaucacuuccacgaacuggugaugaaggacggcagaguccucgugguccccugucgcaaccaggaugagcugauugggcgggccagaaucagccagggcgcgggauggucccugaaggagaccgccugccucggcaaaucuuacgcucaaauguggacacugauguauuuucaucgccgggaccuuagacuggccgcuaacgccauuuguagcgcugugccuucccacuggguuccgaccagccgcacgacauggucuauccaugccaagcacgaauggaugaccaccgaggauaugcucgcgguguggaaucgggucuggauucaggaaaaccccuggauggaggacaaaacaccuguggaauccugggaggaggugcccuaccuggggaagagagaagaccaguggugcggaagccuuaucggccugaccucucgcgccacaugggcuaaaaauauccagacggccauuaaccaaguucggucccucaucgggaaugaggaauauaccgauuacaugccuagcaugaagagauuccggaaggaggaagaggaggccggagugcugugguga

SEQ ID NO: 19730 - RNA, 9876 nt, Artificial Sequence
  derived and/or modified CDS sequence (opt5) from DENV-2__GQ868515__SS-prME
accgccggagucaucgucaugcugauucccaccguuauggcuuuccaccucacgaccagaaauggggagccucauaugaucgugggacggcaggaaaagggcaagagccugcuuuuuaagacagaggacggggugaauaugugcacccugauggccauugaucucggagaacugugugaggacacaaucaccuacaagugcccgcuucugagacaaaacgaacccgaggauauugacuguuggugcaauagcacaucuaccuggaucacguauggcaccuguagcacaaccggggagcaccggcgggaaaagcgcuccgucgcgcucgugccucauguuggaaugggccuggagacaagaaccgaaacguggaugucuagcgagggcgcuuggaagcacgugcagcggaucgagacauggauucugcgccaucccggguucaccaucauggccgccauucucgcuuacacaaucggaaccacccacuuucagagagcccugauuuucauccuucugacagcugucgccccuuccaugacgaugcggugcauuggcaucucuaaccgcgauuuuguggaagggguuagcggaggcuccuggguggacaucguccucgagcacgggagcugugugaccacaauggcgaagaauaagcccacccuggauuucgaacuuauuaaaacagaggccaagcagccugcuacccugagaaaauauugcaucgaagccaagcucacgaacacaaccaccgagucucgguguccgacacaaggagagcccucccugaaugaagaacaggacaaacgcuuuauuugcaagcauagcaugguggauagaggcuggggcaacggguguggacuguucggcaaagggggaaucgugaccugcgcuauguuuacaugcaaaaagaauauggaaggcaaaguugugcagccugagaaccucgaauacacgauugugaucacaccccacucuggggaggagcaugccgucggaaaugacacaggcaagcacggcaaagaaaucaagauuaccccucaguccagcaucacagaggcggaacugaccggguauggaacggugaccauggaguguucuccccggacaggccuugauuucaacgaaaugguucugcuccaaauggaggacaaagccuggcuggugcaccgccagugguuucuugaucugccgcucccuuggcugcccggggcugacacccagggauccaauuggauucagaaggagacacuggucaccuucaagaacccucaugccaaaaagcaagacgugguugugcucggcagccaggaaggggcuaugcacacggcccugacaggcgccaccgagauccagauguccucuggaaaucuucuguuuacaggccaucucaaaugcagacugcggauggauaaacuucaacugaaagggaugagcuacuccauguguaccggaaaguucaagauugucaaagaaaucgcugagacccagcacggcacaaucgugauuagaguccgcuaugagggggacggaagccccugcaagauccccuucgaaauuacggauucugagaaacggcaugugcucggcagacugaucaccguuaacccuauugugacagaaaaggacuccccggucaacaucgaggcggaacccccuuuuggggauagcuacauuaucaucggcguggagcccggacagcugaaacucaauugguucaagaagggcucuagcauugggcagauguuugagaccacaaugcgcggagccaaacggauggcuauccugggcgacaccgccugggauuucgggucccuuggaggcguuuuuacgucuauugggaaggcccugcaccaaguguucggcgcuaucuacggagccgcguuuagcggcgucuccuggacaaugaaaauucucaucggggugaucauuaccuggaucggaaugaacagcagaucuaccucccugagcgugucucugguucuugucggcguggugauucucuaucugggggcuaugguccaggccgacuccggaugugugguuagcuggaagaauaaagaacugaagugcggcuccgggaucuucauuacagauaacgugcacaccuggacagagcaguacaaguuucagccugaaucucccagcaaacucgccuccgcuauccaaaaggcccaugaggaaggcaucuguggaauuagaucugucacgcggcuggagaaucuuauguggaaacagaucaccccggagcugaaccacauucucagcgaaaaugaggugaagcugacaaucaugaccggcgacauuaaagggaucaugcaggcuggaaagagaucccugcgcccucagcccacagaacuuaaauauagcuggaagaccuggggcaaggccaaaaugcucucuacggagucccauaaccaaaccuuccugaucgaugggccugaaacagcggagugccccaauaccaaccgggccuggaauagccuggagguugaagacuacggauuuggcguguucacaaccaacauuuggcucaagcugagagagaaacaggacgucuuuugugauucuaaacuuauguccgcugccaucaaagacaaucgcgcugugcacgccgauaugggcuauuggauugaaagcgcgcugaacgacacauggaagauggagaaggccucuuucaucgagguuaaaagcugccacuggccuaagucccauacccucuggagcaauggggugcuggaaucugagaugauuauccccaaaaacuucgcuggaccggucucccagcacaacuaccggccuggcuaucauacgcagacagccgggcccuggcaccugggaaaacuugaaauggauuuugaccucugugagggcaccaccgugguggucacagaagauugcgggaauagaggacccagccugcggaccacgacagcuuccggcaaacugauuaccgaguggugcugucgcucuugcacacucccuccgcugagauaccggggcgaggacggguguugguacggaauggaaaucagaccccuuaaggagaaggaagagaaccugguuaauagccucgugaccgccggccaugggcaaaucgauaacuucucccugggagugcugggcauggcccuuuuucucgaagagaugcugcgcacacggauugggaccaaacacgcuauccugcucgucgcggccucuuucgugacgcugauuaccggaaauaugagcuuuagagaccuuggccgcguuauggugauggucggcgcuacaaugaccgaugacaucgggaugggagugacauaucuggcccuccuggccgcuuucaagguuagaccuaccuuugccgcgggccugcuucugcggaaacucacguccaaggagcugaugauggcuacaauugggaucgcccuccugucucagagcaccauccccgaauccauucuugagcugacagaugcccucgcucugggaaugauggugcugaaaaucguccgcaacauggaaaaguaccagcuugccgugaccauuauggcgaucagcugcguuccuaaugcugugauucugcaaaacgccuggaaggucucuuguaccauccucgccgcuguguccgugagcccccugcuccugacaucuucccagcagaaagccgacuggaucccucuugcucugacgauuaagggccucaaucccaccgccaucuuccugacaacccugagcagaacaucuaaaaagcgguccuggccgcuuaacgaggcggucauggccguugggauggugagcauucuggcuuccagccuccugaaaaaugacaucccuaugaccggaccccucguggccggcggccugcuuacggucugcuaugugcugacagggcgcucugcugaucuggaacucgagagagccgccgacguuaagugggaggaucaggcugaaauuagcggauccucuccuauccugagcauuaccaucuccgaggacggcucuaugagcaucaaaaacgaagaggaggaacaaacccuuacaauucugauccggaccgggcuccuggugauuuccggagucuuucccgugucuaucccgauuacagcggccgcuugguaccucugggagguuaagaagcagcgcgccggcgugcugugggaugucccuagcccuccucccguggaaaaagccgagcuugaagacggggcuuauagaaucaagcagcggggaauccugggcuacucccagauuggcgccggggucuauaaagagggaacguuccacaccauguggcaugugacacgcggcgcgguucugaugcacagagggaagcggaucgagcccuccugggcugaugugaaaaaggaccucauuucuuacggaggcggguggaagcuggaaggagaguggaaagaaggcgaggaaguccaagugcuugcccuggagcccggcaagaauccgagagccguucagaccaaacccgggaucuuuaagacaaacaccggaacgauuggcgcugugucccucgauuucagcccugggaccucuggaucccccaucgucgaccgcaaaggcaaggugguggggcuguacggaaauggcguugucacacggagcggcgccuauguguccgcgaucgcucagaccgagaagucuauugaagauaacccugagaucgaagacgauauuuuucgcaagaagcgccucacaaucauggaccugcaucccggggccggaaaaaccaagcgguaccuuccugccauugugagagaggcuaucaaacgcggccugcggacacugauucucgccccgacgagagucguggcugccgaaauggaggaggcgcugcgcgggcuucccauccgguaucagaccccugccaucaagacagaacacaccggaagagagauuguugaccugaugugucaugcuaccuucacaaugcggcuccugagccccgugcgcgucccuaacuacaaucucaucauuauggaugaagcccacuucacggaccccgcuuccaucgccgccagaggcuauauuagcacccggguggagaugggggaggcugcgggcaucuuuaugacagccaccccgccuggaucucgcgaucccuucccccaauccaacgcuccuaucauggacgaagagagagaaauucccgagcggagcuggaacucuggccacgaauggguuacagauuuuaaggggaaaaccgugugguucgucccuagcaucaaggccggaaacgacauugccgcuugccugcgcaagaauggcaagaaagugauccagcuuucccgcaagacguuugauucugaguacguuaagacacgggccaacgacugggauuucguggucaccaccgacauuagcgagaugggggcgaauuuuaaagcugaaagagugaucgauccgcgccgguguaugaagcccgugauccugacagacggagaggaaagagucauucuggccggcccuaugcccguuacccauuccucugccgcucagcgccgggggagaaucggccgcaacccuaaaaaugagaacgaccaauauauuuacaugggagaaccccucgagaaugaugaggacugcgcccacuggaaggaagcgaaaaugcugcuugauaacaucaauacaccggagggcauuaucccuagcauguucgaacccgagagagaaaagguggacgccauugauggggaguaccggcugcgcggagaggcuagaaaaaccuuuguggaccucaugcggcgcggcgaucugccugucuggcuggccuauaagguggcugccgaagggaucaacuacgcugacagaaagugguguuucgauggaaucaaaaauaaccagauucucgaggaaaacauggagguugagaucuggacgaaggaaggcgagcggaagaaacuuaaacccagauggcuggacgcccgcauuuauuccgauccucuggcgcucaaagaauuuaaggaguucgccgcugggcggaaaagccugacacuuaaucugaucaccgaaaugggcagacuccccacauucaugacccagaaggcccgcaacgcucuggacaaucuggccgugcuccauacggccgaggcuggaggccgggcguacaaccacgcccuuucugagcugccggaaacccuggagacacuccugcuucugacccuccuggcuacagucaccgggggaauuuuucuguuccucauguccggcaaagggaucggaaagaugacacuuggcaugugcugcaucauuaccgccagcauccugcugugguaugcccagauucaaccucacuggaucgcugccuccauuauccucgaauuuuuccugaucgugcuucugauucccgagcccgaaaaacagagaacgccucaggauaaucagcucacauacguugugaucgcgauucugaccgucguggccgcuaccauggccaacgagaugggcuuucuggagaagacaaagaaagaccucgggcuuggaucuaucaccacacaagaaagcgaguccaauauucuggacaucgaucugcggccggcuucugccuggacgcucuaugcggucgccaccacauucgugacccccaugcugcgccauagcauugaaaacuccagcguuaaugugucucuuacagcuaucgccaaccaggcuaccgugcugaugggccucgggaagggauggccucuguccaaaauggacaucggcgucccccugcucgccauuggguguuacagccagguuaauccuaucacgcuuaccgcugcccugcugcuccugguggcgcacuacgccauuaucggacccggccuucaggcuaaggccacaagagaggcucaaaaacgggccgccgcgggcauuaugaagaacccuaccguggaugggaucacagucaucgaccuggaaccgauucccuaugauccuaaguuugagaaacagcucggacaggugaugcugcugauccucugcguuacccaggugcuuaugaugcgcacgacaugggcucugugugaggcccugacccucgcuacaggccccauuucuacccugugggaagggaauccuggaagauucuggaacaccacaaucgccgucuccauggccaauauuuuucggggcagcuaccuugcuggggccggacuccuguucucuaucaugaagaacacgaccaauacacgcagaggcaccggcaacaucggggagacacugggagaaaaauggaaaagccggcugaacgcgcucggcaaauccgaguuucaaauuuauaagaaaucugggauccaggagguggaccgcacccuugccaaggaaggaauuaagagaggcgagacggaucaucacgcugucagccggggguccgccaaacugagaugguucguggaacgcaauaugguuacacccgagggaaagguggucgaccugggcugcggcagagggggauggagcuacuauuguggcgggcucaaagaugugagagaaguuaagggacugaccaaaggcgggccgggacaugaggagccuauccccauguccaccuacggcuggaaccuugugcgccugcagucuggcauugacgucuuuuucacacccccugaaaagugcgauacccuccugugugacaucggggagagcucccccaauccuacaaucgaagcuggacggacgcugagagugcucaaccuuguggagaauuggcugaacaauaacacccaauucugcauuaagguucugaauccguauaugcccucugucaucgagaagauggagacacuccagcgcaaguacggcggggcccuggugcggaacccucuuagcagaaauuccacccacgagauguacugggugucuaacgcgacaggaaauauugucagcuccguuaacaugaucagccgcaugcugauuaaucgguuuaccaugaaacacaagaaagccacguaugaacccgauguggaccucggcucugggaccagaaacaucggaauugaguccgaaaucccuaaccuggacaucauuggcaagcgcaucgagaagauuaaacaggaacaugagacaagcuggcacuacgaucaggaccaucccuauaagaccugggcuuaccacggcucuuaugagacaaaacaaaccggguccgccagcucuauggugaauggagucgugcggcugcucacaaagccgugggauguugugccuauggucacccagauggcuaugacggacacaacccccuucggccagcagagaguguuuaaagaaaagguugauacccgcacacaagagccuaaggaagggacgaagaaacuuaugaaaaucaccgccgaguggcuguggaaagagcugggcaagaagaaaacacccagaauguguacccgggaagaguucacacgcaaggugagauccaacgcugcccucggcgcgauuuuuaccgacgaaaauaaguggaaaagcgcccgggaggcugucgaagaugggagauucugggagcugguggaccgggagcgcaaccuucaccuggaaggaaagugcgagacauguguguacaauaugaugggcaaaagagaaaagaaacucggcgaguuugggaaggccaagggaucccgggcuaucugguauauguggcugggcgcccgcuuccuggaauuugaggcccucggguuccugaacgaggaucauugguuuagcagaggaaauucucuuagcggcgucgaaggggagggccugcaccggcucggauacauccugcgcgacguuggcaaaaaggaagggggagcgauguacgcugaugacaccgccggcugggacacgagaauuacccuugaggaucugaaaaacgaagagauggugacaaaucauaugaagggggagcacaaaaagcucgccgaagcuaucuucaagcugaccuaucagaacaaagugguccgggugcagcgcccuacacccagaggaaccguuauggacauuaucucccggcgcgaucagagaggcucugggcaagugggcacguacggacugaauacauuuaccaacauggaggcccagcucauucggcagauggaaggcgaggggaucuucaagaauauccaacaucugacagcuaccgaggaaauugccguccagaacuggcuugcgcgcgugggaagagagcggcugagcagaauggccaucuccggcgacgauugcguugugaaaccgauugacgaucgcuucgcuucugcccucacggcucugaaugacauggggaagguccggaaagauauccagcagugggaaccuagcagaggauggaacgacuggacccaagugcccuuuugcucccaccacuuccaugagcuuguuaugaaggauggccgcgugcuggucgugcccugucggaaccaggacgaacucauugggagagcccgcaucucucagggcgcgggauggagccugaaggagacagccugccugggcaaauccuaugcucagauguggacccucauguacuuucaccggagagaucugcgccuugccgcuaaugccauuuguagcgcugucccuucucauugggugccgacaucccggaccacauggagcauccacgccaagcacgaguggaugaccacggaagacaugcuggcgguuuggaacagaguguggauccaagagaaucccuggauggaagacaaaacaccugucgagucuugggaagaggugcccuaucucgggaagcgcgaggaucaguggugcggaucccugauuggccuuaccagccgggccaccugggcuaaaaacauccagacagccauuaaucaggugagaucccugaucgggaacgaagaguacaccgacuauaugccuucuaugaagcgguucagaaaggaagaggaagaggccggaguucucugguga

SEQ ID NO: 19731 - RNA, 9876 nt, Artificial Sequence
  derived and/or modified CDS sequence (opt5) from DENV-2__GQ868516__SS-prME
accgccggcgugaucgucaugcugauucccacaguuauggcuuuccaccucacgaccagaaacggggagccucauaugaucgugggacggcaggaaaagggcaaaagccugcuuuuuaagacagaggacggggugaauaugugcacccugauggccauugaucucggagaacugugugaggacacaaucaccuacaaaugcccgcuucugcgccaaaacgaacccgaggauauugacuguuggugcaauuccacaucuaccuggaucacguauggcaccuguagcacaaccggggagcacagacgggaaaagcgcuccgucgcgcucgugccucauguuggaaugggccuggagacaagaaccgaaacguggaugucuagcgagggcgcuuggaaacacgugcagcggaucgagacauggauucugcgccaucccggguucaccaucauggccgccauucucgcuuacacaaucggaaccacccacuuucagagagcccugauuuucauccuucugacagcugucgccccuuccaugacgaugcggugcauuggcaucucuaaccgcgauuuuguggaagggguuagcggaggcuccuggguggacaucguccucgagcacgggagcugugugaccacaauggcgaagaauaagcccacccuggauuucgaacuuauuaaaacagaggccaagcagccugcuacccugagaaaauauugcaucgaagccaagcucacgaacacaaccaccgagucucgguguccgacacaaggagagcccucccugaaugaagagcaggacaaacgcuuuauuugcaagcauagcaugguggauagaggcuggggcaacggguguggacuguucggcaaggggggaaucgucaccugcgcuauguuuacaugcaaaaagaauauggaaggcaaaguugugcagccugagaaccucgaauacacgauugugaucaccccccacucuggggaggagcaugccgucggaaaugacacaggcaagcacggcaaagaaaucaagauuaccccucaguccagcaucacagaggcggaacugaccggguauggaacggugaccauggaguguucuccccggacaggccuugauuucaacgaaaugguucugcuccaaauggaggacaaagccuggcuggugcaccgccagugguuucuugaucugccgcucccuuggcugcccggggcugacacccagggauccaauuggauucagaaggagacacuggucaccuucaagaacccucaugccaaaaagcaagacgugguugugcucggcagccaggaaggggcuaugcacacggcccugacaggcgccaccgagauccagauguccucuggaaaucuucuguuuacaggccaucucaaaugcagacugcggauggauaagcuucaacugaaagggaugagcuacuccauguguaccggaaaguucaagauugucaaagaaaucgcugagacccagcacggcacaaucgugauuagaguccaguaugagggggacggaagccccugcaagauccccuucgaaauuacggaucucgagaaacgccaugugcugggccggcugaucaccguuaacccuauugugacagaaaaggacucuccggucaacaucgaggcggaacccccuuuuggggauuccuacauuaucaucggcguggagcccggacagcucaaacugaauugguucaagaagggcagcucuauugggcaaauguuugagaccacaaugagaggagccaaacgcauggcuauccuuggcgacaccgccugggauuucgggagccugggaggcguuuuuacguccauugggaaggcccuccaccagguguucggcgcuaucuacggagccgcguuuucuggcgucagcuggacaaugaaaauucugaucggggugaucauuaccuggaucggaaugaacucccggagcaccucucuguccgugagccuuguucucgucggcguggugauucuguaucugggggcuaugguccaggccgacucuggaugugugguuuccuggaagaauaaagaacucaagugcggcagcgggaucuucauuacagauaacgugcacaccuggacagagcaguacaaguuucaaccugaaucccccucuaaacuggccagcgcuauccagaaggcccaugaggaaggcaucuguggaauuagauccgucacgcgccuugagaaucugauguggaaacagaucaccccggagcucaaccacauucugucugaaaaugaggugaagcugacaaucaugaccggcgacauuaaagggaucaugcaggcuggaaagcggagccuuagaccucaacccacagaacucaaauauuccuggaagaccuggggcaaggccaaaaugcugagcacggagucucauaaccagaccuuccugaucgaugggccugaaacagcggagugccccaauaccaaccgcgccuggaauucccucgagguugaagacuacggauuuggcguguucacaaccaacauuuggcugaagcuucgggagaaacaggacgucuuuugugauagcaagcugaugucugcugccaucaaagacaauagagcugugcacgccgauaugggcuauuggauugaauccgcgcucaacgacacauggaagauggagaaggccagcuucaucgagguuaaaucuugccacuggccuaagagccauacccugugguccaauggggugcuggaaagcgagaugauuauccccaaaaacuucgcuggaccggucucucagcacaacuaccgcccuggcuaucauacgcaaacagccgggcccuggcaccuuggaaagcucgaaauggauuuugaccugugugagggcaccaccgugguggucacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucguuaauucucuggugaccgccggccaugggcagaucgauaacuucagccugggagugcuuggcauggcccucuuucuggaagagaugcugagaacacgcauugggaccaaacacgcuauccuccuggucgcggccuccuucgugacgcuuauuaccggaaauaugucuuuucgggaccugggcagaguuauggugauggucggcgcuacaaugaccgaugacaucgggaugggagugacauaucucgcccugcuggccgcuuucaagguucgcccuaccuuugccgcgggccuucugcucagaaaacugacgagcaaggagcucaugauggcuacaauugggaucgcccugcuuucccagucuaccauccccgaaagcauucuggagcucacagaugcccuggcucugggaaugauggugcuuaaaaucguccggaacauggaaaaguaccaacuggccgugaccauuauggcgaucuccugcguuccuaaugcugugauucuccagaacgccuggaaggucagcuguaccauccuggccgcugugucuguguccccccuccugcuuacaagcucucagcagaaagccgacuggaucccucuggcucucacgauuaagggccugaaucccaccgccaucuuccugacaacccuuucccgcacaagcaaaaagagaucuuggccgcugaacgaggcggucauggccguugggaugguguccauucucgcuagcucccugcucaaaaaugacaucccuaugaccggaccccugguggccggcggccuucugacggucugcuaugugcugacagggcggagcgcugaucucgaacuggagcgcgccgccgacguuaagugggaggaucaagcugaaauuucuggaagcuccccuauccuuucuauuaccaucagcgaggacggcuccaugucuaucaaaaacgaagaggaggaacagacccugacaauucucaucagaaccgggcugcucgugauuagcggagucuuucccguguccaucccgauuacagcggccgcuugguaccugugggagguuaagaagcagcgggccggcgugcuuugggaugucccuucucccccucccguggaaaaagccgagcuggaagacggggcuuaucgcaucaagcagagaggaauccugggcuacagccaaauuggcgccggggucuauaaagagggaacguuccacaccauguggcaugugacacggggcgcgguucucaugcaccgcgggaagagaaucgagcccuccugggcugaugugaaaaaggaccugauuagcuacggaggcggguggaagcuugaaggagaguggaaagaaggcgaggaaguccaggugcuggcccucgagccuggcaagaauccgcgggccguucagaccaaacccgggaucuuuaagacaaacaccggaacgauuggcgcugugucucuggauuucuccccugggaccagcggaucucccaucgucgacagaaaaggcaaggugguggggcucuacggaaauggcguugucacacgcuccggcgccuaugugagcgcgaucgcucagaccgagaaguccauugaagauaacccugagaucgaagacgauauuuuucggaaaaagagacugacaaucauggaccuucaucccggggccggaaaaaccaagcgcuaccugccugccauugugcgggaggcuaucaaaagaggccugcgcacacucauucuggccccgacgcgggucguggcugccgaaauggaggaggcgcuuagagggcugcccauccgcuaucaaaccccugccaucaagacagaacacaccggacgggagauuguugaccucaugugucaugcuaccuucacaaugagacugcucucucccgugcgggucccuaacuacaaucugaucauuauggaugaagcccacuucacggaccccgcuagcaucgccgcccgcggcuauauuuccaccagaguggagaugggggaggcugcgggcaucuuuaugacagccaccccgccuggaagccgggaucccuucccccagucuaacgcuccuaucauggacgaagagcgcgaaauucccgagagauccuggaauagcggccacgaauggguuacagauuuuaaggggaaaaccgugugguucgucccuucuaucaaggccggaaacgacauugccgcuugccuucggaaaaauggcaagaaagugauccagcugagcagaaagacguuugauuccgaguacguuaagacacgcgccaacgacugggauuucguggucaccaccgacauuucugagaugggggcgaauuuuaaagcugaacgggugaucgauccgagacgcuguaugaagcccgugauccugacagacggagaggaacgggucauucucgccggcccuaugcccguuacccauagcuccgccgcucaaagacgcgggcggaucggcagaaacccuaaaaaugagaacgaccaguauauuuacaugggagaaccccuggagaaugaugaggacugcgcccacuggaaggaagcgaaaaugcuucuggauaacaucaauacaccggagggcauuaucccuucuauguucgaacccgagcgcgaaaagguggacgccauugauggggaguacagacuccggggagaggcucgcaaaaccuuuguggaccugaugagacggggcgaucugccugucuggcucgccuauaagguggcugccgaagggaucaacuacgcugaccgcaagugguguuucgauggaaucaaaaauaaccagauucuugaggaaaacauggagguugagaucuggacgaaggaaggcgagagaaaaaagcugaaaccccgguggcuggacgccagaauuuauagcgauccucucgcgcugaaggaauuuaaggaguucgccgcugggcgcaaaucccuuacacugaaucucaucaccgaaaugggccggcugcccacauucaugacccagaaggccagaaacgcucuggacaaucucgccgugcuucauacggccgaggcuggaggccgcgcguacaaccacgcccugagcgagcugccggaaacccucgagacacugcuucugcucacccugcuggcuacagucaccgggggaauuuuucucuuccuuaugucuggcaaagggaucggaaagaugacacugggcaugugcugcaucauuaccgccuccauccugcucugguaugcccaaauucagccucacuggaucgcugccagcauuauccuggaauuuuuccuuaucgugcugcucauucccgagcccgaaaaacagcggacgccucaggauaaucaacugacauacguugugaucgcgauucugaccgucguggccgcuaccauggccaacgagaugggcuuucucgagaagacaaagaaagaccuugggcugggauccaucaccacacaggaaucugagagcaauauucuggacaucgaucucagaccggcuuccgccuggacgcuguaugcggucgccaccacauucgugacccccaugcuucggcauucuauugaaaacagcuccguuaaugugagccugacagcuaucgccaaccaggcuaccgugcucaugggccuggggaagggauggccucugucuaaaauggacaucggcgucccccuccuugccauuggguguuacucccagguuaauccuaucacgcugaccgcugcccugcuccugcuuguggcgcacuacgccauuaucggacccggccugcaagcuaaggccacacgcgaggcucagaaaagagccgccgcgggcauuaugaagaacccuaccguggaugggaucacagucaucgaccucgaaccgauucccuaugauccuaaguuugagaaacagcugggacaggugaugcugcucauccuuugcguuacccaagugcugaugaugcggacgacaugggcucugugugaggcccucacccuggcuacaggccccauuagcacccuuugggaagggaauccuggacgcuucuggaacaccacaaucgccgucucuauggccaauauuuuuagaggcuccuaccuggcuggggccggacuccuguucagcaucaugaagaacacgaccaauacacggcgcggcaccggcaacaucggggagacacugggagaaaaauggaagucuagacucaacgcgcuuggcaaaagcgaguuucagauuuauaagaaauccgggauccaggagguggaccggacccuggccaaggaaggaauuaagcgcggcgagacggaucaucacgcugucucuagagggagcgccaaacugcggugguucguggaaagaaauaugguuacacccgagggaaagguggucgaccucggcugcggccgcgggggaugguccuacuauuguggcgggcugaaagaugugcgggaaguuaagggacuuaccaaaggcgggccgggacaugaggagccuauccccaugagcaccuacggcuggaaccuggugagacuccaauccggcauugacgucuuuuucacacccccugaaaagugcgauacccugcugugugacaucggggagucuagccccaauccuacaaucgaagcuggacgcacgcuccgggugcuuaaccugguggagaauuggcugaacaauaacacccaguucugcauuaagguucucaauccguauaugcccuccgucaucgaaaaaauggagacacugcagagaaaguacggcggggcccuugugcgcaacccucugucucggaauagcacccacgagauguacuggguguccaacgcgacaggaaauauugucucuagcguuaacaugaucuccagaaugcucauuaaucgcuuuaccaugaaacacaagaaagccacguaugaacccgauguggaccugggcagcgggacccggaacaucggaauugagucugaaaucccuaaccuggacaucauuggcaagagaaucgagaagauuaaacaggaacaugagacauccuggcacuacgaucaagaccaucccuauaagaccugggcuuaccacggcagcuaugagacaaaacagaccgggucugccuccagcauggugaauggagucgugcgccuccuuacaaagccgugggauguugugccuauggucacccagauggcuaugacggacacaacccccuucggccagcaacggguguuuaaagaaaagguugauaccagaacacaggagccuaaggaagggacgaaaaagcugaugaaaaucaccgccgaguggcuguggaaggagcucggaaaaaagaaaacaccccgcauguguaccagagaagaguucacacggaaggugcgcucuaacgcugcccugggcgcgauuuuuaccgacgaaaauaaguggaaauccgccagagaggcugucgaagaugggcgguucugggagcuuguggacagagagcggaaccugcaccucgaaggaaagugcgagacauguguguacaauaugaugggcaaacgcgaaaagaaacugggcgaguuugggaaggccaagggaagcagagcuaucugguauauguggcugggcgcccgguuccucgaauuugaggcccugggguuccuuaacgaggaucauugguuuucccgcggaaauagccugucuggcgucgaaggggagggccuccacagacugggauacauccuucgggacguuggcaaaaaggaagggggagcgauguacgcugaugacaccgccggcugggacacgcgcauuacccuggaggaucucaaaaacgaagagauggugacaaaucauaugaagggggagcacaaaaagcuggccgaagcuaucuucaagcugaccuaucagaacaaaguggucagagugcagcggccuacaccccgcggaaccguuauggacauuaucagcagacgggaucaacgcggcuccgggcaggugggcacguacggacucaauacauuuaccaacauggaggcccagcugauuagacaaauggaaggcgaggggaucuucaagaauauccagcaucuuacagcuaccgaggaaauugccguccagaacuggcuggcgcgggugggacgcgagagacucucucggauggccaucagcggcgacgauugcguugugaaaccgauugacgauagauucgcuuccgcccugacggcucuuaaugacauggggaagguccgcaaagauauccagcaaugggaaccuucucggggauggaacgacuggacccaggugcccuuuugcagccaccacuuccaugagcugguuaugaaggauggcagagugcucgucgugcccugucgcaaccaggacgaacugauugggcgggccagaaucucccagggcgcgggauggucucugaaggagacagccugccucggcaaaagcuaugcucaaauguggacccugauguacuuucaccgccgggaucuuagacuggccgcuaaugccauuuguuccgcugucccuagccauugggugccgacaucucgcaccacaugguccauccacgccaagcacgaguggaugaccacggaagacaugcucgcgguuuggaaccggguguggauccaggagaaucccuggauggaagacaaaacaccugucgagagcugggaagaggugcccuaucuggggaagagagaggaucaguggugcggaucucuuauuggccugaccucccgcgccaccugggcuaaaaacauccagacagccauuaaucaagugcggagccucaucgggaacgaagaguacaccgacuauaugccuuccaugaagagauuccggaaggaagaggaagaggccggaguucugugguga

SEQ ID NO: 19732 - RNA, 9876 nt, Artificial Sequence
  derived and/or modified CDS sequence (opt5) from DENV-2__GU131975__SS-prME
accgccggcgugaucgucaugcugauucccacaguuauggcuuuccaccucacgaccagaaacggggagccucauaugaucgugggacggcaggaaaagggcaaaagccugcuuuuuaagacagaggacggggugaauaugugcacccugauggccauugaucucggagaacugugugaggacacaaucaccuacaaaugcccgcuucugcgccaaaacgaacccgaggauauugacuguuggugcaauuccacaucuaccuggaucacguauggcaccuguagcacaaccggggagcacagacgggaaaagcgcuccgucgcgcucgugccucauguuggaaugggccuggagacaagaaccgaaacguggaugucuagcgagggcgcuuggaaacacgugcagcggaucgagacauggauucugcgccaucccggguucaccaucauggccgccauucucgcuuacacaaucggaaccacccacuuucagagagcccugauuuucauccuucugacagcugucgccccuuccaugacgaugcggugcauuggcaucucuaaccgcgauuuuguggaagggguuagcggaggcuccuggguggacaucguccucgagcacgggagcugugugaccacaauggcgaagaauaagcccacccuggauuucgaacuuauuaaaacagaggccaagcagccugcuacccugagaaaauauugcaucgaagccaagcucacgaacacaaccaccgagucucgguguccgacacaaggagagcccucccugaaugaagagcaggacaaacgcuuuauuugcaagcauagcaugguggauagaggcuggggcaacggguguggacuguucggcaaggggggaaucgucaccugcgcuauguuuacaugcaaaaagaauauggaaggcaaaguugugcagccugagaaccucgaauacacgauugugaucaccccccacucuggggaggagcaugccgucggaaaugacacaggcaagcacggcaaagaaaucaagauuaccccucaguccagcaucacagaggcggaacugaccggguauggaacggugaccauggaguguucuccccggacaggccuugauuucaacgaaaugguucugcuccaaauggaggacaaagccuggcuggugcaccgccagugguuucuugaucugccgcucccuuggcugcccggggcugacacccagggauccaauuggauucagaaggagacacuggucaccuucaagaacccucaugccaaaaagcaagacgugguugugcucggcagccaggaaggggcuaugcacacggcccugacaggcgccaccgagauccagauguccucuggaaaucuucuguuuacaggccaucucaaaugcagacugcggauggauaagcuucaacugaaagggaugagcuacuccauguguaccggaaaguucaagauugucaaagaaaucgcugagacccagcacggcacaaucgugauuagaguccaguaugagggggacggaagccccugcaagauccccuucgaaauuacggaucucgagaaacgccaugugcugggccggcugaucaccguuaacccuauugugacagaaaaggacucuccggucaacaucgaggcggaacccccuuuuggggauuccuacauuaucaucggcguggagcccggacagcucaaacugaauugguucaagaagggcagcucuauugggcaaauguuugagaccacaaugagaggagccaaacgcauggcuauccuuggcgacaccgccugggauuucgggagccugggaggcguuuuuacguccauugggaaggcccuccaccagguguucggcgcuaucuacggagccgcguuuucuggcgucagcuggacaaugaaaauucugaucggggugaucauuaccuggaucggaaugaacucccggagcaccucucuguccgugagccuuguucucgucggcguggugauucuguaucugggggcuaugguccaggccgacucuggaugugugguuuccuggaagaauaaagaacucaagugcggcagcgggaucuucauuacagauaacgugcacaccuggacagagcaguacaaguuucaaccugaaucccccucuaaacuggccagcgcuauccagaaggcccaugaggaaggcaucuguggaauuagauccgucacgcgccuugagaaucugauguggaaacagaucaccccggagcucaaccacauucugucugaaaaugaggugaagcugacaaucaugaccggcgacauuaaagggaucaugcaggcuggaaagcggagccuuagaccucaacccacagaacucaaauauuccuggaagaccuggggcaaggccaaaaugcugagcacggagucucauaaccagaccuuccugaucgaugggccugaaacagcggagugccccaauaccaaccgcgccuggaauucccucgagguugaagacuacggauuuggcguguucacaaccaacauuuggcugaagcuucgggagaaacaggacgucuuuugugauagcaagcugaugucugcugccaucaaagacaauagagcugugcacgccgauaugggcuauuggauugaauccgcgcucaacgacacauggaagauggagaaggccagcuucaucgagguuaaaucuugccacuggccuaagagccauacccugugguccaauggggugcuggaaagcgagaugauuauccccaaaaacuucgcuggaccggucucucagcacaacuaccgcccuggcuaucauacgcaaacagccgggcccuggcaccuuggaaagcucgaaauggauuuugaccugugugagggcaccaccgugguggucacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucguuaauucucuggugaccgccggccaugggcagaucgauaacuucagccugggagugcuuggcauggcccucuuucuggaagagaugcugagaacacgcauugggaccaaacacgcuauccuccuggucgcggccuccuucgugacgcuuauuaccggaaauaugucuuuucgggaccugggcagaguuauggugauggucggcgcuacaaugaccgaugacaucgggaugggagugacauaucucgcccugcuggccgcuuucaagguucgcccuaccuuugccgcgggccuucugcucagaaaacugacgagcaaggagcucaugauggcuacaauugggaucgcccugcuuucccagucuaccauccccgaaagcauucuggagcucacagaugcccuggcucugggaaugauggugcuuaaaaucguccggaacauggaaaaguaccaacuggccgugaccauuauggcgaucuccugcguuccuaaugcugugauucuccagaacgccuggaaggucagcuguaccauccuggccgcugugucuguguccccccuccugcuuacaagcucucagcagaaagccgacuggaucccucuggcucucacgauuaagggccugaaucccaccgccaucuuccugacaacccuuucccgcacaagcaaaaagagaucuuggccgcugaacgaggcggucauggccguugggaugguguccauucucgcuagcucccugcucaaaaaugacaucccuaugaccggaccccugguggccggcggccuucugacggucugcuaugugcugacagggcggagcgcugaucucgaacuggagcgcgccgccgacguuaagugggaggaucaagcugaaauuucuggaagcuccccuauccuuucuauuaccaucagcgaggacggcuccaugucuaucaaaaacgaagaggaggaacagacccugacaauucucaucagaaccgggcugcucgugauuagcggagucuuucccguguccaucccgauuacagcggccgcuugguaccugugggagguuaagaagcagcgggccggcgugcuuugggaugucccuucucccccucccguggaaaaagccgagcuggaagacggggcuuaucgcaucaagcagagaggaauccugggcuacagccaaauuggcgccggggucuauaaagagggaacguuccacaccauguggcaugugacacggggcgcgguucucaugcaccgcgggaagagaaucgagcccuccugggcugaugugaaaaaggaccugauuagcuacggaggcggguggaagcuugaaggagaguggaaagaaggcgaggaaguccaggugcuggcccucgagccuggcaagaauccgcgggccguucagaccaaacccgggaucuuuaagacaaacaccggaacgauuggcgcugugucucuggauuucuccccugggaccagcggaucucccaucgucgacagaaaaggcaaggugguggggcucuacggaaauggcguugucacacgcuccggcgccuaugugagcgcgaucgcucagaccgagaaguccauugaagauaacccugagaucgaagacgauauuuuucggaaaaagagacugacaaucauggaccuucaucccggggccggaaaaaccaagcgcuaccugccugccauugugcgggaggcuaucaaaagaggccugcgcacacucauucuggccccgacgcgggucguggcugccgaaauggaggaggcgcuuagagggcugcccauccgcuaucaaaccccugccaucaagacagaacacaccggacgggagauuguugaccucaugugucaugcuaccuucacaaugagacugcucucucccgugcgggucccuaacuacaaucugaucauuauggaugaagcccacuucacggaccccgcuagcaucgccgcccgcggcuauauuuccaccagaguggagaugggggaggcugcgggcaucuuuaugacagccaccccgccuggaagccgggaucccuucccccagucuaacgcuccuaucauggacgaagagcgcgaaauucccgagagauccuggaauagcggccacgaauggguuacagauuuuaaggggaaaaccgugugguucgucccuucuaucaaggccggaaacgacauugccgcuugccuucggaaaaauggcaagaaagugauccagcugagcagaaagacguuugauuccgaguacguuaagacacgcgccaacgacugggauuucguggucaccaccgacauuucugagaugggggcgaauuuuaaagcugaacgggugaucgauccgagacgcuguaugaagcccgugauccugacagacggagaggaacgggucauucucgccggcccuaugcccguuacccauagcuccgccgcucaaagacgcgggcggaucggcagaaacccuaaaaaugagaacgaccaguauauuuacaugggagaaccccuggagaaugaugaggacugcgcccacuggaaggaagcgaaaaugcuucuggauaacaucaauacaccggagggcauuaucccuucuauguucgaacccgagcgcgaaaagguggacgccauugauggggaguacagacuccggggagaggcucgcaaaaccuuuguggaccugaugagacggggcgaucugccugucuggcucgccuauaagguggcugccgaagggaucaacuacgcugaccgcaagugguguuucgauggaaucaaaaauaaccagauucuugaggaaaacauggagguugagaucuggacgaaggaaggcgagagaaaaaagcugaaaccccgguggcuggacgccagaauuuauagcgauccucucgcgcugaaggaauuuaaggaguucgccgcugggcgcaaaucccuuacacugaaucucaucaccgaaaugggccggcugcccacauucaugacccagaaggccagaaacgcucuggacaaucucgccgugcuucauacggccgaggcuggaggccgcgcguacaaccacgcccugagcgagcugccggaaacccucgagacacugcuucugcucacccugcuggcuacagucaccgggggaauuuuucucuuccuuaugucuggcaaagggaucggaaagaugacacugggcaugugcugcaucauuaccgccuccauccugcucugguaugcccaaauucagccucacuggaucgcugccagcauuauccuggaauuuuuccuuaucgugcugcucauucccgagcccgaaaaacagcggacgccucaggauaaucaacugacauacguugugaucgcgauucugaccgucguggccgcuaccauggccaacgagaugggcuuucucgagaagacaaagaaagaccuugggcugggauccaucaccacacaggaaucugagagcaauauucuggacaucgaucucagaccggcuuccgccuggacgcuguaugcggucgccaccacauucgugacccccaugcuucggcauucuauugaaaacagcuccguuaaugugagccugacagcuaucgccaaccaggcuaccgugcucaugggccuggggaagggauggccucugucuaaaauggacaucggcgucccccuccuugccauuggguguuacucccagguuaauccuaucacgcugaccgcugcccugcuccugcuuguggcgcacuacgccauuaucggacccggccugcaagcuaaggccacacgcgaggcucagaaaagagccgccgcgggcauuaugaagaacccuaccguggaugggaucacagucaucgaccucgaaccgauucccuaugauccuaaguuugagaaacagcugggacaggugaugcugcucauccuuugcguuacccaagugcugaugaugcggacgacaugggcucugugugaggcccucacccuggcuacaggccccauuagcacccuuugggaagggaauccuggacgcuucuggaacaccacaaucgccgucucuauggccaauauuuuuagaggcuccuaccuggcuggggccggacuccuguucagcaucaugaagaacacgaccaauacacggcgcggcaccggcaacaucggggagacacugggagaaaaauggaagucuagacucaacgcgcuuggcaaaagcgaguuucagauuuauaagaaauccgggauccaggagguggaccggacccuggccaaggaaggaauuaagcgcggcgagacggaucaucacgcugucucuagagggagcgccaaacugcggugguucguggaaagaaauaugguuacacccgagggaaagguggucgaccucggcugcggccgcgggggaugguccuacuauuguggcgggcugaaagaugugcgggaaguuaagggacuuaccaaaggcgggccgggacaugaggagccuauccccaugagcaccuacggcuggaaccuggugagacuccaauccggcauugacgucuuuuucacacccccugaaaagugcgauacccugcugugugacaucggggagucuagccccaauccuacaaucgaagcuggacgcacgcuccgggugcuuaaccugguggagaauuggcugaacaauaacacccaguucugcauuaagguucucaauccguauaugcccuccgucaucgaaaaaauggagacacugcagagaaaguacggcggggcccuugugcgcaacccucugucucggaauagcacccacgagauguacuggguguccaacgcgacaggaaauauugucucuagcguuaacaugaucuccagaaugcucauuaaucgcuuuaccaugaaacacaagaaagccacguaugaacccgauguggaccugggcagcgggacccggaacaucggaauugagucugaaaucccuaaccuggacaucauuggcaagagaaucgagaagauuaaacaggaacaugagacauccuggcacuacgaucaagaccaucccuauaagaccugggcuuaccacggcagcuaugagacaaaacagaccgggucugccuccagcauggugaauggagucgugcgccuccuuacaaagccgugggauguugugccuauggucacccagauggcuaugacggacacaacccccuucggccagcaacggguguuuaaagaaaagguugauaccagaacacaggagccuaaggaagggacgaaaaagcugaugaaaaucaccgccgaguggcuguggaaggagcucggaaaaaagaaaacaccccgcauguguaccagagaagaguucacacggaaggugcgcucuaacgcugcccugggcgcgauuuuuaccgacgaaaauaaguggaaauccgccagagaggcugucgaagaugggcgguucugggagcuuguggacagagagcggagccugcaccucgaaggaaagugcgagacauguguguacaacaugaugggcaaacgcgaaaagaaacugggcgaguuugggaaggccaagggauccagagcuaucugguauauguggcugggcgcccgguuccucgaauuugaggcccugggguuccuuaaugaggaucauugguuuagccgcggaaacucucugagcggcgucgaaggggagggccuccacagacugggauacauccuucgggacguuggcaaaaaggaagggggagcgauguacgcugaugacaccgccggcugggacacgcgcauuacccuggaggaucucaaaaaugaagagauggugacaaaccauaugaagggggagcacaaaaagcuggccgaagcuaucuucaagcugaccuaucagaauaaaguggucagagugcagcggccuacaccccgcggaaccguuauggacauuaucuccagacgggaucaacgcggcucugggcaggugggcacguacggacucaacacauuuaccaauauggaggcccagcugauuagacaaauggaaggcgaggggaucuucaagaacauccagcaucuuacagcuaccgaggaaauugccguccagaauuggcuggcgcgggugggacgcgagagacucagccggauggccaucuccggcgacgauugcguugugaaaccgauugacgauagauucgcuucugcccugacggcucuuaacgacauggggaagguccgcaaagauauccagcaaugggaaccuagccggggauggaaugacuggacccaggugcccuuuugcucccaccacuuccaugagcugguuaugaaggauggcagagugcucgucgugcccugucgcaaccaggacgaacugauugggcgggccagaaucucucagggcgcgggauggagccugaaggagacagccugccucggcaaauccuaugcucaaauguggacccugauguacuuucaccgccgggaucuuagacuggccgcuaacgccauuuguagcgcugucccuucucauugggugccgacaucccgcaccacauggagcauccacgccaagcacgaguggaugaccacggaagacaugcucgcgguuuggaaucggguguggauccaggagaaccccuggauggaagacaaaacaccugucgagucuugggaagaggugcccuaucuggggaagagagaggaucaguggugcggaucccuuauuggccugaccagccgcgccaccugggcuaaaaauauccagacagccauuaaccaagugcggucccucaucgggaaugaagaguacaccgacuauaugccuucuaugaagagauuccggaaggaagaggaagaggccggaguucugugguga

SEQ ID NO: 19733 - RNA, 9876 nt, Artificial Sequence
  derived and/or modified CDS sequence (opt5) from DENV-2__JN819422__SS-prME
accgccggcgugaucgucaugcugauucccacggcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcguugcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagaaggcucugaucuucauucuucugacggccgucgcgccuagcaugaccaugagaugcaucggcauuuccaaccgggauuuuguggaagggguuucuggaggcagcuggguggacaucguccucgagcacggguccugugugacaaccauggccaagaauaaacccacacuggauuucgaacuuaucaagaccgaggcuaaacagccugccacgcugcgcaaguauugcauugaagcuaaacucacaaacaccaccacagagagcagauguccgacccaaggagagcccucucugaaugaggaacaggacaagcgguuuaucugcaagcauuccaugguggaucgcggcuggggcaacggguguggacuguucggcaaagggggaauugucacaugcgccauguuuacgugcaagaaaaauauggaaggcaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagccccagaaccggccuugauuucaacgaaaugguucugcuccaaauggaggacaaggcuuggcuggugcaccggcagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugccgccugagaauggauaaacuucaacugaaggggaugucuuacagcauguguaccggaaaguucaaaaucgucaaggaaauugcggagacacagcacggcacgaucgugauccggguccaguaugagggggacggaucccccugcaaaauucccuucgaaaucaccgaucucgagaagagacaugugcugggccgccugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugcggggagcuaagagaauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgcuccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaauccggagcgucacaagacuugagaaucugauguggaagcagaucaccccggagcucaaccacauucuguccgaaaaugaggugaaacugacaaucaugaccggcgacauuaaggggaucaugcaggccggaaaacgcucucuucggccucaacccacggaacucaaguauagcuggaagaccuggggcaaagcgaagaugcuguccacagagagccauaaccagaccuuccugauugaugggccugaaacagccgagugccccaauaccaacagagcuuggaacucucucgagguugaagacuacggauuuggcguguucacaaccaacaucuggcugaaacuucgcgagaagcaggacgucuuuugugauuccaaacugaugagcgccgcuaucaaggacaaucgggccgugcacgcggauaugggcuauuggauugaaucugcccucaacgacacguggaagauggagaaggcuagcuucaucgagguuaagagcugccacuggccuaaaucucauacacuguggagcaauggggugcuggaauccgagaugauuauccccaagaacuucgccggaccggucagccagcacaacuacagaccuggcuaucauacccaaaccgcugggcccuggcaccuuggaaaacucgaaauggauuuugaccugugugagggcacaaccgugguggucacggaagauugcgggaaucgcggacccucucugcggacaaccacagccuccggcaagcucauuaccgaguggugcuguagaagcugcacacugccuccgcuucgguaccgcggcgaggacggguguugguacggaauggaaaucagaccccugaaggagaaagaagagaaccucguuaauucccuggugaccgccggccaugggcagauugauaacuucucucugggagugcuuggcauggcucucuuucuggaagagaugcugcggacgagaaucgggaccaagcacgcgauccuccuggucgccgugagcuucguuacacuuauuaccggaaauauguccuuucgcgaccugggccgggugauggucauggugggcgcuacaaugaccgaugacaucgggaugggaguuacguaucucgcccugcuggccgcuuucaaagugagaccuacauuugccgcgggccuucugcuccgcaagcugaccucuaaagagcucaugauggcuacaauugggaucgcccugcuuagccaguccaccauucccgaaaccauccuggagcucacagaugcccuggcucugggaaugaugguccuuaagaucgugagaaacauggaaaaguaccaacuggccguuacgauuauggcgaucucuugcgugccuaaugcugucauucuccagaacgccuggaaagugagcuguaccauccuggccgcuguguccgucagcccccuccugcuuacaucuucccagcagaaggccgacuggauuccucuggcucucaccaucaaaggccugaaucccacagccaucuuccugaccacgcuuagccggacaucuaagaaacgcuccuggccgcugaacgaggcgauuauggccguugggauggugagcauccucgcuucuucccugcucaagaaugacauuccuaugaccggaccccugguggccggcggccuucugaccgucugcuaugugcugacagggagaagcgcugaucucgaacuggagcgggccgccgacguuaaaugggaggaucaagcugaaaucuccggaagcucuccuauucuuagcaucaccauuuccgaggacggcucuaugagcaucaagaacgaagaggaggaacagacacugacgauccucauucgcaccgggcugcucgugaucuccggagucuuucccgugucuauuccgaucacagcggccgcuugguaccugugggagguuaagaaacagagagccggcgugcuuugggaugucccuucucccccucccguggaaaaggccgagcuggaagacggggcuuaucggauuaaacagcgcggaauccugggcuacucccaaaucggcgccggggucuauaaggagggaaccuuccacacaauguggcaugugaccagaggcgcgguucucaugcaccgggggaaacgcauugagcccuccugggcugaugugaagaaggaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccggaagggcaaggugguggggcucuacggaaauggcguugucaccagaagcggcgccuaugugucugcgaucgcucagacagagaaauccaucgaagauaacccugagauugaagacgauaucuuucgcaagaaacggcugacgauuauggaccuucaucccggggccggaaagaccaaaagauaccugccugccaucgugcgcgaggcuauuaagcggggccugagaacacucauccuggccccgacccgcgucguggcugccgaaauggaggaggcgcuucgggggcugcccauuagauaucaaaccccugccaucaagacacagcacacgggacgcgaaaucguugaccucaugugucaugcuaccuucacaaugcggcugcucagccccgugagagucccuaacuacaaucugauuaucauggaugaggcccacuucaccgaccccgcuuccauugccgcccggggcuauaucucuacacgcguggaaaugggggaggcugcgggcauuuuuaugaccgccacgccgccuggaagcagagaucccuucccccaguccaacgcuccuaucauggacgaggaacgggagauccccgaacgcagcuggaacucuggccacgaguggguuacagauuuuaaagggaagaccgugugguucgucccuuccauuaaagccggaaacgacaucgccgcuugccuuagaaagaauggcaaaaaggugauucaacugagccggaagaccuuugauucugaauacguuaaaacaagagccaacgacugggauuucguggucaccacagacaucagcgagaugggggcgaauuuuaaggcugagcgcgugauugauccgcggagauguaugaaacccgugauccugaccgacggagaagaacgcgucauccucgccggcccuaugcccguuacgcauuccucugccgcucagcggagagggcgcauuggccggaacccuaagaaugaaaacgaccaguauaucuacaugggagagccccuggaaaaugaugaggacugcgcccacuggaaagaggcgaagaugcuucuggauaacauuaauacaccggaaggcaucauuccuagcauguucgagcccgaaagagagaaaguggacgccaucgauggggaauaccgccucagaggagaggcucggaagaccuuuguggaccugaugcgcagaggcgaucugccugucuggcucgccuauaagguggcugccgaggggauuaacuacgcugaccggaaaugguguuucgauggaaucaagaauaaccagauccuugaagagaacauugaaguugagaucuggacaaaagagggcgaacgcaagaaacugaagcccagauggcuggacgcccggauuuauuccgauccucucgcgcugaaggaguuuaaagaguucgccgcugggagaaagucucuuacccugaaucucaucacggagaugggccgccugcccaccuucaugacacaaaaagcccggaacgcucuggacaaucucgccgugcuucauaccgccgaagcuggaggcagagcguacaaccacgcccugagcgagcugccggagacacucgaaacccugcuucugcucacacugcuggcuaccgucacagggggaauuuuucucuuccuuauguccggcaagggggugggaaaaaugacacugggcaugugcugcaucaucaccgccagcauucugcucugguaugcccagauccagccucacuggauugcugccucuaucauucuggaguuuuuccuuaucguucugcucauccccgaacccgagaagcagcgcaccccucaagauaaucagcugacauacguggucauugcgauccugaccguggucgccgcuacaauggccaacgaaaugggcuuucucgagaagacgaaaaaggaccuugggcugggauccauuaccacacaggagagcgaauccaauauccuggacauugaucuccggccggcuucugccuggacccuguaugcgguggccacaaccuucguuacgcccaugcuuagacauagcaucgagaacuccucugugaaugugagccugaccgcuauugccaaccaggcuacaguccucaugggccuggggaaaggauggccucuguccaagauggacaucggcguuccccuccuugccaucggguguuacagccaagugaauccuauuacccugacagcugcccugcuccugcuuguggcgcacuacgccaucauuggacccggccugcaggcuaaagccacccgggaagcucagaagcgcgccgccgcgggcaucaugaagaacccuacggucgaugggauuacagugaucgaccucgagccgauccccuaugauccuaaauuugaaaagcagcugggacaaguuaugcugcucauucuuugcgugacccagguccugaugaugagaacaaccugggcucugugugaggcccucacccuggcuacaggccccaucucuacgcuuugggaggggaauccuggacgguucuggaacaccacaauugccguguccauggccaauaucuuucgcggcagcuaccuggcuggggccggacuccuguucucuauuaugaaaaacaccacaaauaccagacggggcacgggcaacaucggggaaacacugggagagaaguggaaaucccgccucaacgcgcuuggcaagagcgaauuucaggucuauaaaaagucugggauccaagagguggacagaacccuggccaaggagggaauuaaacggggcgaaaccgaucaucacgcuguuagccgcggguccgccaagcugagaugguucguggagcggaauauggucacacccgaaggaaaagugguugaccucggcugcggcagagggggauggucuuacuauuguggcgggcugaagaacgugcgcgaggucaaaggacuuaccaagggcgggccgggacaugaagaaccuauccccaugagcacauacggcuggaaucuggugcggcuccaguccggcguggaugucuuuuucacgcccccugagaagugcgacacccugcugugugauauuggggaaagcucccccaacccuacaaucgaggcuggaagaacccuccgcguccuuaaucugguggaaaacuggcugaauaacaauacacaguucugcauuaaagugcucaacccguauaugcccucugucaucgagaagauggaagcccugcagcggaaauacggcggggcgcuuguuagaaauccucugagccgcaacuccacccacgagauguacugggugucuaaugccacgggaaacaucgugagcuccgucaauaugauuucucggaugcucaucaacagauuuaccaugaagcacaaaaaggcuacauaugagcccgacguggaucugggcagcgggacccgcaacauuggaaucgaauccgagauuccuaaucuggacaucauuggcaagcggaucgagaaaaucaagcaagagcaugaaacaagcuggcacuacgaccaggaucaucccuauaaaaccugggccuaccacggcucuuaugagacaaagcagaccggguccgcuagcucuaugguuaacggaguggucagacuccuuacgaaaccgugggacgugguuccuauggugacacagauggccaugaccgauaccacacccuucggccaacagcgcgucuuuaaggagaagguggacacgcggacccaggaaccuaaagaggggacaaagaaacugaugaagauuaccgcugaauggcuguggaaagagcucggaaagaaaaagacacccagaauguguacccgcgaggaguucacaagaaaggugcgguccaaugccgcgcugggcgccaucuuuaccgaugagaacaaauggaaaagcgcucgcgaagccgucgaggacgggagauucugggaacuuguugaucgggagagaaaucugcaccucgagggaaaaugcgaaacguguguguacaacaugaugggcaagcgggagaaaaagcugggcgaauuugggaaggcuaaaggaucucgcgccauuugguauauguggcugggcgccagauuccucgaguuugaagcgcugggguuccuuaaugaggaccauugguuuucccggggaaacagccuguccggcguggagggggaaggccuccaccgccugggauacauccuuagagaugucggcaagaaagaagggggagcuauguacgccgacgauaccgccggcugggacacacggauuacccuggaagaccucaagaaugaggaaauggugacaaaccauaugaaaggggagcacaagaagcuggcugaggccaucuucaaacugaccuaucagaauaagguugugcgcguccaaagaccuacgccccggggaacagugauggauaucauuagccgcagagaccagcggggcucugggcagguuggcaccuacggacucaacacauuuaccaauauggaagcucaacugauccgccagauggagggcgaagggauuuucaaaagcauccagcaucuuacggccaccgaggagauugcggugcagaacuggcuggccagagucggacgggaacgccucuccagaauggcuaucucuggcgaugacugcgugguuaagccgaucgaugaccgguucgccagcgcucugacagcccuuaaugauauggggaaagugagaaaggacauucaacagugggagccuucccgcggauggaacgauuggacccagguccccuuuugcucucaccacuuccaugaacuggugaugaaggacggccggguccucgugguucccuguagaaaccaggaugagcugaucgggcgcgcgcggauuagccaaggcgccggauggucccugaaagaaacagcuugccucggcaagucuuaugcccagauguggacccugauguacuuucacagacgcgaccuucggcuggcugccaaugcuaucuguagcgccgugccuccgcauuggguccccacauccagaaccacguggagcauucacgcgaaacacgaguggaugacaaccgaggauaugcucgccguguggaaccgcguguggauccaggaaaauccuuggauggaggacaagacccccguugaaucuugggaggaagugccuuaucuggggaaacgggaggaccaguggugcggaucccuuauuggccugacaagcagagcuaccugggccaagaacauccaaacagccaucaaucagguccgcucucucauugggaacgaggaauacacggauuauaugcccuccaugaagcgguucagacgggaggaagaggaagcuggagugcugugguga

SEQ ID NO: 19734 - RNA, 9876 nt, Artificial Sequence
  derived and/or modified CDS sequence (opt5) from DENV-2__GU131955__SS-prME
accgccggagugaucgugaugcugauucccacaguuauggcuuuccaccucacgacccggaauggggagccucauaugaucgugggacggcaggaaaagggcaaaagccugcuuuuuaagacagaggacggggugaauaugugcacccugauggccauugaucucggagaacugugugaggacacaaucaccuacaaaugcccgcuucugcgccaaaaugaacccgaggauauugacuguuggugcaauuccacaucuaccugggucacguauggcaccuguagcacaaccggggagcacagacgggaaaagcgcuccguggcgcucguuccucaugugggaaugggccuggagacaagaaccgaaacguggaugucuagcgagggcgcuuggaaacacguccagcggaucgagacauggauccugcgccaucccggguucaccauuauggccgccauccucgcuuacacaauuggaaccacccacuuucagagagcccugaucuucauucuucugacagcuguggccccuuccaugacgaugcggugcaucggcauuucuaaccgcgauuuuguugaaggggugagcggaggcuccugggucgacaucgugcucgagcacgggagcugugugaccacaauggcgaagaauaagcccacccuggauuucgaacuuaucaaaacagaggccaagcagccugcuacccugagaaaauauugcauugaagccaagcucacgaacacaaccaccgagucucgguguccgacacaaggagagcccucccugaaugaagaacaggacaaacgcuuuaucugcaagcauagcauggucgauagaggcuggggcaacggguguggacuguucggcaaagggggaauuguuaccugcgcuauguuuacaugcaaaaagaauauggaaggcaaaguggugcagccugagaaccucgaauacacgaucgucauuacaccccacucuggggaggagcaugccgugggaaaugacacaggcaagcacggcaaagaaaucaagaucaccccucaguccagcauuacagaggcggaacugaccggguauggaacgguuaccauggaguguucuccccggacaggccuugauuucaacgaaauggugcugcuccaaauggaggacaaagccuggcugguccaccgccagugguuucuugaucugccgcucccuuggcugcccggggcugacacccagggauccaauuggauccagaaggagacacuggugaccuucaagaacccucaugccaaaaagcaagacguugugguccucggcagccaggaaggggcuaugcacacggcccugacaggcgccaccgagauucagauguccucuggaaaucuucuguuuacaggccaucucaaaugcagacugcggauggauaaacuucaacugaaagggaugagcuacuccauguguaccggaaaguucaagaucgugaaagaaauugcugagacccagcacggcacaaucgucaucagagugcaguaugagggggacggaagccccugcaagauucccuucgaaaucacggaucucgagaaacgccauguucugggccggcugauuaccgugaacccuaucgucacagaaaaggacucuccggugaacauugaggcggaacccccuuuuggggauuccuacaucauuaucggcguugagcccggacagcucaaacugaauugguucaagaagggcagcucuaucgggcaaauguuugagaccacaaugagaggagccaaacgcauggcuauucuuggcgacaccgccugggauuucgggagccugggaggcguguuuacguccaucgggaaggcccuccaccaggucuucggcgcuauuuacggagccgcguuuucuggcgugagcuggacaaugaaaauccugauuggggugaucaucaccuggauuggaaugaacucccggagcaccucucuguccguuagccuuguccucgugggcguggucacacuguaucugggggcuauggugcaggccgacucuggauguguuguguccuggaagaauaaagaacucaagugcggcagcgggaucuucauuaccgauaacguccacacauggacggagcaguacaaguuucaaccugaaucccccucuaaacuggccagcgcuauccagaaggcccaugaggaaggcauuuguggaaucagauccgugacccgccuugagaaucugauguggaaacagaucacaccggagcucaaccacauucugucugaaaaugagguuaagcugaccaucaugacaggcgacauuaaagggaucaugcaggcuggaaagcggagccuuagaccucaacccaccgaacucaaauauuccuggaagacguggggcaaggccaaaaugcugagcaccgagucucauaaccagacauuccugauugaugggccugaaaccgcggagugccccaauacaaaccgcgccuggaacucccucgagguggaagacuacggauuuggcgucuucaccacaaacaucuggcugaaacuucgggagaaacaggacguguuuugugauagcaagcugaugucugcugccaucaaagacaauagagcuguucacgccgauaugggcuauuggauugaauccgcgcucaacgacaccuggaagauggagaaggccagcuucaucgaggugaaaucuugccacuggccuaagagccauacgcugugguccaaugggguccuggaaagcgagaugauuauccccaaaaacuucgcuggaccggugucucagcacaacuaccgcccuggcuaucauacacaaaccgccgggcccuggcaccuuggaaagcucgaaauggauuuugaccugugugagggcaccacaguggucguuaccgaagauugcgggaaucggggacccucccugagaacgacaaccgcuagcggcaaacucauuacagaguggugcugucgguccugcacccugccuccgcuucgcuacagaggcgaggacggguguugguacggaauggaaauccggccccugaaggagaaggaagagaaccucgucaauucucuggugacagccggccaugggcagauugauaacuucagccugggaguccuuggcauggcccucuuucuggaagagaugcugagaacccgcaucgggacgaaacacgcuauccuccugguggcggccuccuucguuacccuuauuacaggaaauaugucuuuucgggaccugggcagagugauggucauggugggcgcuaccaugacagaugacaucgggaugggaguuaccuaucucgcccugcuggccgcuuucaaggugcgcccuacguuugccgcgggccuucugcucagaaaacugacaagcaaggagcucaugauggcuaccauugggaucgcccugcuuucccagucuacaauucccgaaaccauccuggagcucaccgaugcccuggcucugggaaugaugguccuuaaaaucgugcggaacauggaaaaguaccaacuggccguuacaauuauggcgaucagcugcgugccuaaugcugucauucuccagaacgccuggaagguguccuguacgauccuggccgcugugagcgucucuccccuccugcuuaccuccagccagcagaaagccgacuggauuccucuggcucucacaaucaagggccugaaucccaccgccaucuuccugacaacccuuucucgcacguccaaaaagagaagcuggccgcugaacgaggcgguuauggccguggggauggugucuauucucgcuuccagccugcucaaaaaugacaucccuaugacaggaccccuggucgccggcggccuucugaccgugugcuauguucugaccgggcgguccgcugaucucgaacuggagcgcgccgccgacgugaagugggaggaucaagcugaaauuagcggaucuagcccuauccuuuccauuacaaucucugaggacggcagcauguccauuaaaaacgaagaggaggaacagacccugacaauccucaucagaacggggcugcucgucauuucuggaguguuucccguuagcaucccgauuaccgcggccgcuugguaccugugggaggugaagaagcagcgggccggcguccuuugggaugugccuucucccccucccgucgaaaaagccgagcuggaagacggggcuuaucgcaucaagcagagaggcauucugggauacagccaaaucggcgccgggguguauaaagagggaacauuccacaccauguggcauguuacacggggcgcggugcucaugcaccgcgggaagagaaucgagcccagcugggcugaugucaaaaaggaccugauuuccuacggaggcggguggaaacuugaaggagaguggaaagaaggcgaggaagugcagguucuggcccucgagccuggcaagaauccgcgggccgugcagaccaaacccgggaucuuuaagacgaacaccggaacaauuggcgcugucagccuggauuucucuccugggaccuccggaagccccaucguggacagaaaaggcaaggugguugggcucuacggaaauggcgucgugacacgcucuggcgccuauguguccgcgauugcucagaccgaaaagagcaucgaggauaacccugagaucgaagacgauauuuuucggaaaaagagacugacaaucauggaccuucaucccggggccggaaaaacgaagcgcuaccugccugccauuguccgggaggcuaucaaaagaggccugcgcacccucauucuggccccgacacgggugguugcugccgaaauggaggaggcgcuuagagggcugcccauccgcuaucaaaccccugccauuaagaccgaacacacaggacgggagaucguggaccucaugugucaugcuacguucaccaugagacugcucucccccguccgggugccuaacuacaaucugaucauuauggaugaagcccacuucacagaccccgcuucuaucgccgcccgcggcuauauuagcaccagaguugagaugggggaggcugcgggcaucuuuaugacagccaccccgccuggaucccgggaucccuucccccagagcaacgcuccuauuauggacgaagagagagaaauccccgagagaucuuggaacuccggccacgaaugggugacggauuuuaaggggaaaacagucugguucgugccuagcaucaaggccggaaacgacauugccgcuugccuucggaaaaauggcaagaaaguuauccagcugucuagaaagaccuuugauagcgaguacgugaagacccgcgccaacgacugggauuucgucgugacaaccgacauuuccgagaugggggcgaauuuuaaagcugaacgggugaucgauccgagacgcuguaugaagcccgucauucugacagacggagaggaacggguuauccucgccggcccuaugcccgugacccauucuagcgccgcucaaagacgcgggcggaucggcagaaacccuaaaaaugagaacgaccaguauauuuacaugggagaaccccuggagaaugaugaggacugcgcccacuggaaggaagcgaaaaugcuucuggauaacaucaauacgccggagggcauuaucccuuccauguucgaacccgagcgcgaaaagguggacgccauugauggggaguacagacuccggggagaggcucgcaaaacauuugucgaccugaugagacggggcgaucugccuguguggcucgccuauaagguugcugccgaagggaucaacuacgcugaccgcaagugguguuucgauggaauuaaaaauaaccagauccuugaggaaaacauggagguggagaucuggaccaaggaaggcgagcgcaagaagcugaaaccccgguggcuggacgccagaauuuauucugauccucucgcgcugaaggaauuuaaggaguucgccgcugggcgcaaaagccuuacacugaaucucaucaccgaaaugggccggcugcccacguucaugacccagaaggccagaaacgcucuggacaaucucgccguccuucauacagccgaggcuggaggccgcgcguacaaccacgcccuguccgagcugccggaaacccucgagacacugcuucugcucacccugcuggcuacagugaccgggggaauuuuucucuuccuuaugagcggcaaagggaucggaaagaugacgcugggcaugugcugcauuaucacagccucuauccugcucugguaugcccaaauucagccucacuggaucgcugccuccauuauccuggaauuuuuccuuauuguucugcucauccccgagcccgaaaaacagcggaccccucaggauaaucaacugaccuacguggucaucgcgauucugacaguggucgccgcuaccauggccaacgagaugggcuuucucgagaagacaaagaaagaccuugggcugggaagcaucacgacccaggaauccgagucuaauauucuggacaucgaucucagaccggcuagcgccuggacacuguaugcgguggccaccacauucguuacccccaugcuucggcauuccauugaaaacucuagcgugaaugugucccugacggcuaucgccaaccaggcuaccguccucaugggccuggggaagggauggccucugagcaaaauggacauuggcguuccccuccuugccaucggguguuacucucaggugaauccuaucacacugaccgcugcccugcuccugcuuguggcgcacuacgccauuaucggacccggccugcaagcuaaggccacacgcgaggcucagaaaagagccgccgcgggcauuaugaagaacccuaccgucgaugggaucacggugauugaccucgaaccgauccccuaugauccuaaguuugagaaacagcugggacagguuaugcugcucauccuuugcgugacacaaguccugaugaugcggaccacaugggcucugugugaggcccucacccuggcuaccggccccauuuccacacuuugggaagggaauccuggacgcuucuggaacacgaccaucgccgugagcauggccaauauuuuuagaggcucuuaccuggcuggggccggacuccuguucuccaucaugaagaacacaaccaauacacggcgcggcaccggcaacauuggggagacgcugggagaaaaauggaaguccagacucaacgcgcuuggcaaaucugaguuucagaucuauaagaaaagcgggauccaggaggucgaccggacacuggccaaggaaggaauuaagcgcggcgagaccgaucaucacgcuguguccagagggucugccaaacugcggugguucguugaaagaaauauggugacccccgagggaaaggucguggaccucggcugcggccgcgggggauggagcuacuauuguggcgggcugaaagauguucgggaagugaagggacuuacaaaaggcgggccgggacaugaggagccuauccccauguccaccuacggcuggaaccuggucagacuccaaagcggcauugacguguuuuucacacccccugaaaagugcgauacgcugcugugugacaucggggaguccucucccaauccuaccauugaagcuggacgcacacuccgggugcuuaaccugguugagaauuggcugaacaauaacacccaguucugcaucaagguccucaauccguauaugcccagcgugaucgagaagauggagacacugcagagaaaguacggcggggcccuugugcgcaacccucuguccagaaauucuacccacgagauguacugggucagcaacgcgacgggaaauauuguuuccucugugaacaugaucagcagaaugcucauuaaucgcuuuaccaugaaacacaagaaagccacauaugaacccgauguggaccugggcuccgggacccggaacaucggaauugagagcgaaaucccuaaccuggacauuaucggcaagagaaucgagaagauuaaacaggaacaugagacaucuuggcacuacgaucaagaccaucccuauaagaccugggcuuaccacggcuccuaugagacaaaacagaccgggagcgccucuuccauggucaauggagugguucgccuccuuacgaagccgugggauguggucccuauggugacacagauggcuaugaccgacaccacacccuucggccagcaacggguuuuuaaagaaaagguggauacgagaacccaggagccuaaggaagggaccaagaagcugaugaaaaucaccgccgaguggcuguggaaggagcucggcaagaagaaaacaccccgcauguguaccagagaagaguucacacggaagguccgcagcaacgcugcccugggcgcgauuuuuaccgacgaaaauaaguggaaaucugccagagaggcuguggaagaugggcgguucugggagcuuguggacagagagcggaaccugcaccucgaaggaaagugcgagacgugugucuacaauaugaugggcaaacgcgaaaagaaacugggcgaguuugggaaggccaagggauccagagcuaucugguauauguggcugggcgcccgguuccucgaauuugaggcccugggguuccuuaacgaggaucauugguuuagccgcggaaauucccugagcggcguugaaggggagggccuccacagacugggauacauucuucgggacgugggcaaaaaggaagggggagcgauguacgcugaugacaccgccggcugggacacacgcaucacccuggaggaucucaaaaacgaagagauggugacaaaucauaugaagggggagcacaaaaagcuggccgaagcuaucuucaagcugaccuaucagaacaaagucgugagaguucagcggccuacgccccgcggaacagugauggacauuaucucuagacgggaucaacgcggcagcgggcaggucggcaccuacggacucaauacauuuaccaacauggaggcccagcugauuagacaaauggaaggcgaggggaucuucaaguccauucagcaucuuacggcuaccgaggaaaucgccgugcagaauuggcuggcgcggguuggacgcgagagacucucucggauggccaucagcggcgacgauugcguggucaaaccgauugacgauagauucgcuuccgcccugacagcucuuaacgacauggggaaggugcgcaaagauauccagcaaugggaaccuucucggggauggaaugacuggacccagguucccuuuugcagccaccacuuccaugagcuggugaugaaggauggcagaguccucgugguccccugucgcaaccaggacgaacugauugggcgggccagaaucucccagggcgcgggauggucucugaaggagacagccugccucggcaaaagcuaugcucaaauguggacccugauguacuuucaccgccgggaucuuagacuggccgcuaacgccauuuguuccgcugugccuagccauuggguuccgacaucucgcaccacgugguccauccacgccaagcacgaguggaugacaaccgaagacaugcucgcgguguggaaucgggucuggauucaggagaaccccuggauggaagacaaaaccccuguggagagcugggaagaggugcccuaucuggggaagagagaggaucaguggugcggaucucuuaucggccugacaucccgcgccaccugggcuaaaaauauccagacagccauuaaccaaguucggagccucaucgggaaugaagaguacacggacuauaugccuuccaugaagagauuccggaaggaagaggaagaggccggagugcugugguga

SEQ ID NO: 19735 - RNA, 9876 nt, Artificial Sequence
  derived and/or modified CDS sequence (opt5) from DENV-2__KJ189311__SS-prME
accgccggagugaucgucaugcugauucccaccguuauggcuuuccaccucacgaccagaaauggggagccucauaugaucgugggacggcaggaaaagggcaagucccugcuuuuuaagacagaggacggggugaauaugugcacccugauggccauugaucucggagaacugugugaggacaccaucaccuacaaaugcccgcuucugcgccaaaacgaacccgaggauauugacuguuggugcaauuccacaucuaccuggaucacguauggcaccuguagcacaaccggggagcacagacgggaaaagcgcuccgucgcgcucgugccucauguuggaaugggccuggagacaagaaccgaaacguggaugucuagcgagggcgcuuggaaacacgugcagcggaucgagacauggauucugcgccaucccggguucaccaucauggccgccauucucgcuuacacaaucggaaccacccacuuucagagagcccugauuuucauccuucugacagcugucgccccuuccaugacgaugcggugcauuggcaucucuaaccgcgauuuuguggaagggguuagcggaggcuccuggguggacaucguccucgagcacgggagcugugugaccacaauggcgaagaauaagcccacccuggauuucgaacuuauuaaaacagaggccaagcagccugcuacccugagaaaauauugcaucgaagccaagcucacgaacacaaccaccgagucucgguguccgacacaaggagagcccucccugaaugaagaacaggacaaacgcuuuauuugcaagcauagcaugguggauagaggcuggggcaacggguguggacuguucggcaaagggggaaucgugaccugcgcuauguuuacaugcaaaaagaauauggaaggcaaaguugugcagccugagaaccucgaauacacgauugugaucacaccccacucuggggaggagcaugccgucggaaaugacacaggcaagcacggcaaagaaaucaagauuaccccucaguccagcaucacagaggcggaacugaccggguauggaacggugaccauggaguguucuccccggacaggccuugauuucaacgaaaugguucugcuccaaauggaggacaaagccuggcuggugcaccgccagugguuucuugaucugccgcucccuuggcugcccggggcugacacccagggauccaauuggauucagaaggagacacuggucaccuucaagaacccucaugccaaaaagcaagacgugguugugcucggcagccaggaaggggcuaugcacacggcccugacaggcgccaccgagauccagauguccucuggaaaucuucuguuuacaggccaucucaaaugcagacugcggauggauaaacuucaacugaaagggaugagcuacuccauguguaccggaaaguucaagauugucaaagaaaucgcugagacccagcacggcacaaucgugauuagaguccaguaugagggggacggaagccccugcaagauccccuucgaaauuacggaucucgagaaacgccaugugcugggccggcugaucaccguuaacccuauugugacagaaaaggacucuccggucaacaucgaggcggaacccccuuuuggggauuccuacauuaucaucggcguggagcccggacagcucaaacugaauugguucaagaagggcagcucuauugggcaaauguuugagaccacaaugagaggagccaaacgcauggcuauccuuggcgacaccgccugggauuucgggagccugggaggcguuuuuacguccauugggaaggcccuccaccagguguucggcgcuaucuacggagccgcguuuucuggcgucagcuggacaaugaaaauucugaucggggugaucauuaccuggaucggaaugaacucccggagcaccucucuguccgugagccuuguucucgucggcguggugauucuguaucugggggcuaugguccaggccgacucuggaugugugguuuccuggaagaauaaagaacucaagugcggcagcgggaucuucauuacagauaacgugcacaccuggacagagcaguacaaguuucaaccugaaucccccucuaaacuggccagcgcuauccagaaggcccaugaggaaggcaucuguggaauuagauccgucacgcgccuugagaaucugauguggaaacagaucaccccggagcucaaccacauucugucugaaaaugaggugaagcugacaaucaugaccggcgacauuaaagggaucaugcaggcuggaaagcggagccuuagaccucaacccacagaacucaaauauuccuggaagaccuggggcaaggccaaaaugcugagcacggagucucauaaccagaccuuccugaucgaugggccugaaacagcggagugccccaauaccaaccgcgccuggaacucccucgagguugaagacuacggauuuggcguguucacaaccaacauuuggcugaaacuucgggagaaacaggacgucuuuugugauagcaagcugaugucugcugccaucaaagacaauagagcugugcacgccgauaugggcuauuggauugaauccgcgcucaacgacacauggaagauggagaaggccagcuucaucgagguuaaaucuugccacuggccuaagagccauacccugugguccaauggggugcuggaaagcgagaugauuauccccaaaaacuucgcuggaccggucucucagcacaacuaccgcccuggcuaucauacgcaaacagccgggcccuggcaccuuggaaagcucgaaauggauuuugaccugugugagggcaccaccgugguggucacagaagauugcgggaaucggggacccucccugagaaccacgacagcuagcggcaaacucauuaccgaguggugcugucgguccugcacacugccuccgcuucgcuacagaggcgaggacggguguugguacggaauggaaauccggccccugaaggagaaggaagagaaccucguuaauucucuggugaccgccggccaugggcagaucgauaacuucagccugggagugcuuggcauggcccucuuucuggaagagaugcugagaacacgcauugggaccaaacacgcuauccuccuggucgcggccuccuucgugacgcuuauuaccggaaauaugucuuuucgggaccugggcagaguuauggugauggucggcgcuacaaugaccgaugacaucgggaugggagugacauaucucgcccugcuggccgcuuucaagguucgcccuaccuuugccgcgggccuucugcucagaaaacugacgagcaaggagcucaugauggcuacaauugggaucgcccugcuuucccagucuaccauccccgaaagcauucuggagcucacagaugcccuggcucugggaaugauggugcuuaaaaucguccggaacauggaaaaguaccaacuggccgugaccauuauggcgaucuccugcguuccuaaugcugugauucuccagaacgccuggaaggucagcuguaccauccuggccgcugugucugugagcccccuccugcuuacaagcucucagcagaaagccgacuggaucccucuggcucucacgauuaagggccugaaucccaccgccaucuuccugacaacccuuucccgcacaagcaaaaagagaucuuggccgcugaacgaggcggucauggccguugggaugguguccauucucgcuagcucccugcucaaaaaugacaucccuaugaccggaccccugguggccggcggccuucugacggucugcuaugugcugacagggcggagcgcugaucucgaacuggagcgcgccgccgacguuaagugggaggaucaagcugaaauuucuggaagcuccccuauccuuucuauuaccaucagcgaggacggcuccaugucuaucaaaaacgaagaggaggaacagacccugacaauucucaucagaaccgggcugcucgugauuagcggagucuuucccguguccaucccgauuacagcggccgcuugguaccugugggagguuaagaagcagcgggccggcgugcuuugggaugucccuucucccccucccguggaaaaagccgagcuggaagacggggcuuaucgcaucaagcagagaggaauccugggcuacagccaaauuggcgccggggucuauaaagagggaacguuccacaccauguggcaugugacacggggcgcgguucucaugcaccgcgggaagagaaucgagcccuccugggcugaugugaaaaaggaccugauuagcuacggaggcggguggaaacuugaaggagaguggaaagaaggcgaggaaguccaggugcuggcccucgagccuggcaagaauccgcgggccguucagaccaaacccgggaucuuuaagacaaacaccggaacgauuggcgcugugucucuggauuucuccccugggaccagcggaucucccaucgucgacagaaaaggcaaggugguggggcucuacggaaauggcguugucacacgcuccggcgccuaugugagcgcgaucgcucagaccgagaaguccauugaagauaaccuggagaucgaagacgauauuuuucggaaaaagagacuuacaaucauggaccugcauccuggggccggaaaaaccaagcgcuaccugcccgccauugugcgggaggcuaucaaaagaggccuccgcacacugauucuugccccuacgcgggucguggcugccgaaauggaggaggcgcugagagggcucccgauccgcuaucaaacccccgccaucaagacagaacacaccggacgggagauuguugaccugaugugucaugcuaccuucacaaugagacuccugucuccugugcggguccccaacuacaaucuuaucauuauggaugaagcccacuucacggacccugcuagcaucgccgcccgcggcuauauuuccaccagaguggagaugggggaggcugcgggcaucuuuaugacagccacacccccgggaagccgggauccuuucccccagucuaacgcucccaucauggacgaagagagagaaauuccugagagauccuggaauagcggccacgaauggguuacagauuuuaaggggaaaaccgugugguucguccccucuaucaaggccggaaacgacauugccgcuugccugcggaaaaauggcaagaaagugauccagcugagcagaaagacguuugauuccgaguacguuaagacacgcgccaacgacugggauuucguggucaccaccgacauuucugagaugggggcgaauuuuaaagcugaacgggugaucgauccuagacgcuguaugaagccggugauccucacagacggagaggaacgggucauucuggccggccccaugccuguuacccauagcuccgccgcucaaagacgcgggcggaucggcagaaaccccaaaaaugagaacgaccaguauauuuacaugggagaaccucuugagaaugaugaggacugcgcccacuggaaggaagcgaaaaugcugcucgauaacaucaauacacccgagggcauuaucccgucuauguucgaaccugagcgcgaaaagguggacgccauugauggggaguacagacugcggggagaggcucgcaaaaccuuuguggaccugaugagacggggcgaucuccccgucuggcuugccuauaagguggcugccgaagggaucaacuacgcugaccgcaagugguguuucgauggaaucaaaaauaaccagauucuggaggaaaacauggagguugagaucuggacgaaggaaggcgagcgcaagaagcugaaaccucgguggcucgacgccagaauuuauagcgauccccuggcgcuuaaggaauuuaaggaguucgccgcugggcgcaaaucccugacacucaaucugaucaccgaaaugggccggcugccuacauucaugacccagaaggccagaaacgcucucgacaaucuugccgugcugcauacggccgaggcuggaggccgcgcguacaaccacgcccugagcgagcuccccgaaacccuggagacacuucugcuccugacccugcucgcuacagucaccgggggaauuuuucuuuuccugaugucuggcaaagggaucggaaagaugacacugggcaugugcugcaucauuaccgccuccauccuccugugguaugcccaaauucagccgcacuggaucgcugccagcauuauccuugaauuuuuccugaucgugcuccugauuccugagcccgaaaaacagcggacgccccaggauaaucaacugacauacguugugaucgcgauucucaccgucguggccgcuaccauggccaacgagaugggcuuucuugagaagacaaagaaagaccuggggcugggauccaucaccacacaggaaucugagagcaauauucucgacaucgaucugagaccugcuuccgccuggacgcuuuaugcggucgccaccacauucgugaccccgaugcugcggcauucuauugaaaacagcuccguuaaugugagccucacagcuaucgccaaccaggcuaccgugcugaugggccuggggaagggauggccccucucuaaaauggacaucggcgucccucuucuggccauuggguguuacucccagguuaaucccaucacgcugaccgcugcccuccugcuucugguggcgcacuacgccauuaucggaccuggccuccaagcuaaggccacacgcgaggcucagaaaagagccgccgcgggcauuaugaagaaccccaccguggaugggaucacagucaucgaccuggaaccuauuccguaugaucccaaguuugagaaacagcugggacaggugaugcuccuuauccugugcguuacccaagugcugaugaugcggacgacaugggcucucugugaggcccugacccuugcuacaggcccuauuagcacccugugggaagggaaucccggacgcuucuggaacaccacaaucgccgucucuauggccaauauuuuuagaggcuccuaccucgcuggggccggacugcuguucagcaucaugaagaacacgaccaauacacggcgcggcaccggcaacaucggggagacacucggagaaaaauggaagucuagacuuaacgcgcugggcaaaagcgaguuucagauuuauaagaaauccgggauccaggagguggaccggacccuggccaaggaaggaauuaagcgcggcgagacggaucaucacgcugucucuagagggagcgccaaacuccggugguucguggaaagaaauaugguuacaccugagggaaagguggucgaccugggcugcggccgcgggggaugguccuacuauuguggcgggcuuaaagaugugcgggaaguuaagggacugaccaaaggcgggcccggacaugaggagccgaucccuaugagcaccuacggcuggaaccucgugagacugcaauccggcauugacgucuuuuucacaccucccgaaaagugcgauacccugcucugugacaucggggagucuagccccaaucccacaaucgaagcuggacgcacgcuucgggugcugaaccugguggagaauuggcucaacaauaacacccaguucugcauuaagguucugaauccuuauaugccguccgucaucgagaagauggagacacuucagagaaaguacggcggggcccuggugcgcaacccccucucucggaauagcacccacgagauguacuggguguccaacgcgacaggaaauauugucucuagcguuaacaugaucuccagaaugcugauuaaucgcuuuaccaugaaacacaagaaagccacguaugaaccugauguggaccugggcagcgggacccggaacaucggaauugagucugaaauccccaaccucgacaucauuggcaagagaaucgagaagauuaaacaggaacaugagacauccuggcacuacgaucaagaccauccuuauaagaccugggcuuaccacggcagcuaugagacaaaacagaccgggucugccuccagcauggugaauggagucgugcgccuucugacaaagcccugggauguugugccgauggucacccagauggcuaugacggacacaaccccuuucggccagcaacggguguuuaaagaaaagguugauaccagaacacaggagcccaaggaagggacgaaaaagcugaugaaaaucaccgccgaguggcucuggaaggagcugggcaagaagaaaacaccucgcauguguaccagagaagaguucacacggaaggugcgcucuaacgcugcccuuggcgcgauuuuuaccgacgaaaauaaguggaaauccgccagagaggcugucgaagaugggcgguucugggagcugguggacagagagcggagccuccaccuggaaggaaagugcgagacauguguguacaacaugaugggcaaacgcgaaaagaaacugggcgaguuugggaaggccaagggauccagagcuaucugguauauguggcucggcgcccgguuccuggaauuugaggcccuuggguuccugaaugaggaucauugguuuagccgcggaaacucucucagcggcgucgaaggggagggccugcacagacuuggauacauccugcgggacguuggcaaaaaggaagggggagcgauguacgcugaugacaccgccggcugggacacgcgcauuacccucgaggaucugaaaaaugaagagauggugacaaaccauaugaagggggagcacaaaaagcuggccgaagcuaucuucaagcucaccuaucagaauaaaguggucagagugcagcggcccacaccucgcggaaccguuauggacauuaucuccagacgggaucaacgcggcucugggcaggucggcacguacggacugaacacauuuaccaauauggaggcccagcuuauuagacaaauggaaggcgaggggaucuucaagaacauccagcaucugacagcuaccgaggaaauugccguccagaauuggcucgcgcgggugggacgcgagagacugagccggauggccaucuccggcgacgauugcguugugaaacccauugacgauagauucgcuucugcccuuacggcucugaacgacauggggaagguccgcaaagauauccagcaaugggaaccgagccggggauggaaugacuggacccaggugccuuuuugcucccaccacuuccaugagcucguuaugaaggauggcagagugcuggucgugcccugucgcaaccaggacgaacugauugggcgggccagaaucucucagggcgcgggauggagccucaaggagacagccugccugggcaaauccuaugcucaaauguggacccuuauguacuuucaccgccgggaucugagacucgccgcuaacgccauuuguagcgcuguccccucucauugggugccuacaucccgcaccacauggagcauccacgccaagcacgaguggaugaccacggaagacaugcuggcgguuuggaaucggguguggauccaggagaacccguggauggaagacaaaacacccgucgagucuugggaagaggugccuuaucuugggaagagagaggaucaguggugcggaucccugauuggccucaccagccgcgccaccugggcuaaaaauauccagacagccauuaaccaagugcggucccugaucgggaaugaagaguacaccgacuauaugcccucuaugaagagauuccggaaggaagaggaagaggccggaguucugugguga

SEQ ID NO: 19736 - RNA, 9876 nt, Artificial Sequence
  derived and/or modified CDS sequence (opt5) from DENV-2__KJ189370__SS-prME
accgccggagugaucgucaugcugauucccacagcuauggccuuccaccugacgaccagaaauggggagccucauaugaucguuagccggcaggaaaagggaaaaucccugcuuuuuaagacagaggacggagugaauaugugcacccugauggcgauugaucucggggaacugugugaggacacaaucaccuacaaaugcccgcuucugcgccaaaaugaacccgaggauauugacuguuggugcaauucuacauccaccugggugacguauggaaccuguacaaccacaggcgagcacagacgggaaaagcgcuccgucgcucucgugccucauguugggaugggacuggagaccagaacggaaacauggaugucuagcgagggcgccuggaaacacgugcagcggaucgagaccuggauccugcgccaucccggcuucacaauuauggccgcuauccucgccuacaccauugggaccacacacuuucagagagcucugaucuucauucuucugacggccgucgcgccuuccaugaccaugcggugcaucggaauuucuaaccgcgauuuuguggaaggcguuagcgggggauccuggguggacaucguccucgagcacggcagcugugugacaaccauggccaagaauaagcccacacuggauuucgaacuuaucaaaaccgaggcuaagcagccugccacgcugagaaaauauugcauugaagcuaagcucacaaacaccaccacagagucucgguguccgacccaaggggagcccucccugaaugaagaacaggacaaacgcuuuaucugcaagcauagcaugguggauagaggauggggcaacggcugugggcuguucggaaagggcgggauugucacaugcgccauguuuacgugcaaaaagaauauggaaggaaaaguugugcagccugagaaccucgaauacaccaucgugauuacaccccacucuggcgaggagcaugcggucgggaaugacaccggaaagcacggcaaagaaaucaagaucacaccucaguccagcauuaccgaggccgaacugacgggcuaugggaccgugacaauggaguguucuccccggaccggacuugauuucaacgaaaugguucugcuccaaauggaggacaaggcuuggcuggugcaccgccagugguuucuugaucugccgcucccuuggcugcccggcgccgacacacagggguccaauuggauccagaaggagacccuggucacguucaagaacccucaugcuaaaaagcaagacgugguugugcucggaagccaggaaggcgccaugcacacagcccugaccggggcuacagagauucagauguccucuggcaaucuucuguuuaccggacaucucaaaugcagacugcggauggauaaacuucaacugaaaggcaugagcuacuccauguguaccgggaaguucaagaucgucaaagaaauugcggagacacagcacggaacgaucgugaucagaguccaguaugagggcgacgggagccccugcaagauucccuucgaaaucaccgaucucgagaaacgccaugugcugggacggcugauuacaguuaacccuaucgugaccgaaaaggacucuccggucaacauugaggccgaacccccuuuuggcgauuccuacaucauuaucgggguggagcccggccagcucaaacugaauugguucaagaagggaagcucuaucggccaaauguuugagacaaccaugagaggggcuaaacgcauggccauucuuggagacacggccugggauuucggcagccucggcgggguuuuuacauccaucgggaaggcucuccaccagguguucggggccauuuacggcgcggcuuuuucuggagucagcuggaccaugaaaauccugauuggcgugaucaucaccuggauugggaugaacucccggagcacaucucuguccgugagccuuguucucgucggaguggugacccuguaucugggcgccaugguccaggccgacucugggugugugguuuccuggaagaauaaagaacucaagugcggaagcggcaucuucauuacagauaacgugcacacguggaccgagcaguacaaguuucaaccugaaucccccucuaaacuggcuagcgccauccagaaggcucaugaggaagggauuuguggcaucagauccgucacacgccuugagaaucugauguggaaacagaucaccccggagcucaaccacauucugucugaaaaugaggugaagcugacaaucaugaccggagacauuaaaggcaucaugcaggccgggaagcggagccuuagaccucaacccacggaacucaaauauuccuggaagaccuggggaaaggcgaaaaugcugagcacagagucucauaaccagaccuuccugauugauggcccugaaacagccgagugccccaauaccaaccgcgcuuggaacucccucgagguugaagacuacggguuuggaguguucacaaccaacaucuggcugaaacuuaaagagaagcaggacgucuuuugugauagcaaacugaugucugccgcuaucaaggacaaucgggccgugcacgcggauaugggcuauuggauugaauccgcccucaacgacacguggaagauggagaaagcuagcuucaucgagguuaagucuugccacuggccuaaaagccauacacugugguccaauggcgugcuggaaagcgagaugauuauccccaagaacuucgccgggccggucucucagcacaacuacagaccuggauaucauacccaaaccgcuggccccuggcaccuugggaaacucgaaauggauuuugaccugugugagggaacaaccgugguggucacggaagauugcggcaaucgcgggcccucccugcggacaaccacagccagcggaaagcucauuaccgaguggugcuguagauccugcacacugccuccgcuucgguaccgcggcgaggacggcuguugguacgggauggaaaucagaccccugaaggagaaagaagagaaccucguuaauucucuggugaccgccggacauggccagauugauaacuucagccugggggugcuuggaauggcucucuuucuggaagagaugcugcggacgagaaucggcaccaagcacgcgauccuccuggucgccguguccuucguuacacuuauuaccgggaauaugucuuuucgcgaccugggacgggugauggucauggugggcgcuacaaugaccgaugacaucggcauggggguuacguaucucgcccugcuggccgcuuucaaagugagaccuacauuugccgcgggacuucugcuccgcaagcugaccagcaaagagcucaugauggcuacaauuggcaucgcccugcuuucccagucuaccauucccgaaaccauccuggagcucacagaugcccuggcucuggggaugaugguccuuaaggugguuagaaacauggaaaaguaccaacuggccgugacgaucauggcgauuagcugcgucccuaaugcugugauccuccagaacgccuggaaaguguccuguaccauucuggccgcugucagcguuucuccccuccugcuuacauccagccagcagaaggccgacuggaucccucuggcucucaccauuaaaggacugaaucccacagccaucuuccugaccacgcuuucucggacauccaagaaacgcagcuggccgcugaacgaggcgaucauggccgugggcauggugucuauucucgcuuccagccugcucaagaaugacaucccuaugaccgggccccuggucgccggaggccuucugaccgugugcuauguucugacaggcagauccgcugaucucgaacuggagcgggccgccgacgugaaaugggaggaucaagcugaaauuagcgggucuagcccuauccuuuccauuaccaucucugaggacggaagcauguccauuaagaacgaagaggaggaacagacacugacgauccucauccgcaccggccugcucgucauuucugggguguuucccguuagcaucccgauuacagcggccgcuugguaccugugggaggugaagaaacagagagccggaguccuuugggaugugccuucucccccucccgucgaaaaggccgagcuggaagacggcgcuuaucggaucaaacagcgcgggauucugggauacagccaaaucggcgccggcguguauaaggaggggaccuuccacacaauguggcauguuaccagaggagcggugcucaugcaccggggcaaacgcaucgagcccagcugggcugaugucaagaaggaccugauuuccuacgggggaggcuggaaacuugaaggggaguggaaggaaggagaggaagugcagguucuggcccucgagccuggcaaaaauccgagagccgugcagacgaagcccggcaucuuuaaaaccaacacagggaccauuggagcugucagccuggauuucucuccuggcacauccgggagccccaucguggaccggaagggaaaggugguuggccucuacgggaauggagucgugaccagaucuggcgccuauguguccgcgauugcucagacagagaaaagcaucgaagauaacccugagaucgaagacgauauuuuucgcaagaaacggcugacgaucauggaccuucaucccggcgccgggaagaccaaaagauaccugccugccauuguccgcgaggcuaucaagcggggacugagaacacucauucuggccccgacccgcgugguugcugccgaaauggaggaggcgcuucggggccugcccaucagauaucaaaccccugccauuaaggcugaauacacagggcgcgagaucguggaccucaugugucacgccacguucaccaugcggcugcucucccccgucagagugccuaacuauaaucugaucauuauggaugaagcucauuucacagaccccgccucuaucgccgcucggggauacauuagcacccgcguugagaugggcgaggcggccgggaucuuuaugacagcuaccccgccuggcuccagagaucccuucccccagagcaacgccccuauuauggacgaagaacgggaaauccccgagcgcucuuggaacuccggacacgaaugggugacggauuuuaaaggcaagacagucugguucgugccuagcaucaaagccgggaacgacauugcugccugccuuagaaagaauggcaagaagguuauccagcugucucggaagaccuuugauagcgaguaugugaaaaccagagcgaacgacugggauuucgucgugacaaccgacauuuccgagaugggcgcuaauuuuaaggccgaacgcgugaucgauccgcggagauguaugaaacccgucauucugacagacggggaggaacgcguuauccucgccggaccuaugcccgugacccacucuagcgcugcccaacggagaggccgcaucgggcggaacccuaagaaugagaacgaccaguacauuuacaugggcgaaccccuggagaaugaugaggacugcgcgcauuggaaagaagccaagaugcuucuggauaacaucaauacgccggagggaauuaucccuuccauguucgaacccgagagagaaaaaguggacgcuauugauggcgaguaucgccucagaggggaggcccggaagacauuugucgaccugaugcgcagaggagaucugccuguguggcucgcuuacaagguugccgcugaaggcaucaacuaugccgaccggaaaugguguuucgaugggauuaagaauaaccagauccuugaggaaaacauggagguggagaucuggaccaaagaaggagagcgcaagaaacugaagcccagauggcuggacgcgcggauuuacucugauccucucgcccugaaggaauuuaaagaguucgcugccggcagaaagagccuuacacugaaucucaucaccgaaauggggcgccugcccacguucaugacccagaaagcucggaacgcccuggacaaucucgccguccuucacacagcugaggcgggcggcagagccuauaaccaugcucuguccgagcugccggaaacccucgagacacugcuucugcucacccugcuggccacagugaccggcgggauuuuucucuuccuuaugagcggaaagggcaucgggaaaaugacgcugggaaugugcugcauuaucacagccucuauccugcucugguacgcucaaauucagccucacuggaucgccgcguccauuauccuggaauuuuuccuuauuguucugcucauccccgagcccgaaaagcagcgcaccccucaggauaaucaacugaccuauguggucaucgccauucugacaguggucgcugccaccauggcuaacgagaugggcuuucucgagaagaccaaaaaggaccuuggccuggggagcaucacgacccaggaauccgagucuaauauucuggacaucgaucuccggccggccagcgcguggacacuguacgccguggcuaccacauuccuuacccccaugcugagacacuccauugaaaacucuagcguuaaugugucccucacggccaucgcuaaccaggccaccgugcugaugggacugggcaaaggguggccucucagcaagauggacauuggagucccccuucuggcuaucggcuguuacucucagguuaauccuaucacacugaccgccgcgcuccugcuucugguggcccauuaugcuauuaucgggcccggacuccaagccaaagcuacacgggaggcccagaagcgcgccgcggcuggcauuaugaagaacccuaccguggauggcaucacggucauugaccuggauccgauccccuacgacccuaaauuugaaaagcagcugggacaggugaugcuccuuauccugugcguuacacaagugcugaugaugagaaccacaugggcccucugugaggcucugacccuugccaccggacccauuuccacacugugggagggcaauccugggcgguucuggaacacgaccaucgccgucagcauggcuaauauuuuucgcggaucuuaucucgccggcgcggggcugcuguucuccaucaugaaaaacacaaccagcacaagacggggaaccggcaauauuggcgaaacgcucggggagaaguggaaaucucgccuuaacgcccugggaaagagcgaauuucagaucuacaaaaaguccggcauccaggagguggauagaacacuggcuaaggaggggauuaaacggggagaaaccgaccaccaugccgucucucgcggcagcgcuaagcucagaugguucguggagcggaacaugguuacccccgaagggaaaguggucgaucugggaugcggcagaggcgggugguccuauuacuguggaggccuuaagaaugugcgcgagguuaaagggcugacaaagggaggcccggggcacgaggaaccuauccccaugagcaccuauggauggaaccucgugcggcugcaauccggcgucgacguguuuuucacacccccugagaagugcgauacgcugcucugugacauuggcgaaucuagccccaauccuaccaucgaggccgggagaacacuucgcgugcugaaccugguugaaaauuggcucaacaauaacacccaguucugcauuaaaguccugaauccguacaugcccuccgugaucgagaagauggaagcgcuucagcggaaauacggaggcgcccuggugagaaacccucucucucgcaauagcacacaugagauguauugggucuccaacgcuaccgggaauaucguuucuagcgugaacaugauuucccggaugcugaucaauagauuuacgaugaagcacaaaaaggccaccuacgagcccgauguggaccugggaagcggcacacgcaacauugggaucgaaucugaggucccuaaccucgacauuaucggaaagcggauugagaaaaucaagcaggagcacgaaaccuccuggcauuaugaucaagaccaccccuacaaaacaugggcuuaucauggcagcuacgagaccaagcagacaggcucugccuccagcauggugaaugggguugugagacuucugaccaaaccgugggaugucgugccuaugguuacgcagauggcuaugacagacaccacccccuucggacagcaacgcguguuuaaggagaaggucgauacacggacgcaggaaccuaaagagggcaccaagaaacugaugaagaucacagccgaauggcucuggaaagagcuggggaagaaaaagacccccagaauguguacacgcgaggaguucaccagaaaggugcggucuaacgcggcccuuggagcuauuuuuacagacgagaauaaauggaaguccgcccgcgaagcuguggaggauggcagauucugggaacuggucgaccgggagagaaaccuccaccuggaggggaaaugcgaaaccuguguuuauaauaugaugggaaagcgggagaaaaagcugggcgaauuuggcaaggccaaagggagccgcgccaucugguacauguggcucggagcgagauuccuggaguuugaagcucuuggcuuccugaacgaggaucacugguuuucccgggggaauagccucucuggaguggagggcgaagggcugcaucgccuuggcuacauucugagagaggugggaaagaaagaaggcggggccauguaugccgacgauacggcuggaugggacacccggaucacacucgaggaccugaagaacgaagagauggucaccaaucacaugaaaggcgagcauaagaagcuggccgaagcuauuuucaaacucacauaccagaacaaggugguucgcgugcagagaccuacaccccgggggacggucauggauaucaucagccgcagagaccaacggggauccggccagguggggacauauggccugaauaccuuuacaaacauggaggcccagcuuauucgccaaauggaaggagagggcaucuucaaaucuauucagcaccugaccgcgacggaggaaaucgccguucagaauuggcucgugagagucgggcgggagcgccugagcagaauggcuauuuccggagaugacugcgugguuaagccgaucgaugaccgguucgccucugcucuuaccgcccugaacgauaugggcaaagugagaaaggacauccagcaaugggaaccuagccgcggguggaaugauuggacacagguccccuuuugcucccaucacuuccacgagcucgugaugaaggacggacggguccuggugguucccuguagaaaccaggaugaacugauuggccgcgcgcggaucucucagggggccggcuggagccucaaagagaccgcuugccugggaaaguccuacgcccaaauguggacacuuauguauuuucauagacgcgaccugcggcucgcugccaacgcuauuuguagcgccgugccuucucacugggucccgaccuccagaacaaccuggagcauccaugcgaaacacgaguggaugacgacagaagauaugcuggccguguggaaucgcguguggauucaggagaaccccuggauggaagacaagaccccuguugagucuugggaagaggugcccuaccuuggcaaacgggaggaccaguggugcgggucccugaucggacucaccagcagagcuacaugggccaagaauauucagaccgccaucaaccaaguccgcucccugaucggcaaugaagaguauacagauuacaugccuucuaugaagcgguucagacgggaagaggaagaggcuggggugcugugguga

SEQ ID NO: 19737 - RNA, 9876 nt, Artificial Sequence
  derived and/or modified CDS sequence (opt5) from DENV-2__EU482620__SS-prME
accgccggcgugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaagacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggaucccuuuccccaguccaacgcuccuaucauggacgaagaaagagaaauccccgagagaagcuggaacucuggccacgaaugggugacagauuucaaggggaaaaccgucugguuugugccuuccauuaaggccggaaacgacaucgccgcuugccugcggaaaaauggcaagaaaguuauucagcuuagcagaaagaccuucgauucugaguacgugaagacacgcgccaacgacugggauuuugucgugaccacagacaucagcgagaugggggcgaauuucaaagcugaacgggugauugauccgagacgcuguaugaagcccgucauccugaccgacggagaggaacggguuauccuggccggcccuaugcccgugacgcauuccucugccgcucaaagacgcgggcggauuggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaacuacacagaccgcaagugguguuuugauggaaucaaaaauaaccagauccucgaggaaaacauggagguggagauuuggaccaaggaaggcgagcgcaagaaacuuaaaccccgguggcuggacgcuagaaucuauuccgauccucuggcccucaaggaguucaaggaguucgcggccgggcgcaaaucucugacgcuuaaucugauuaccgaaaugggccggcuccccacauuuaugacccagaaggcuagaaacgcccuggacaaucuggcuguccuccauacagccgaggccggaggccgcgcuuacaaccacgcgcuuagcgagcugccggaaacccuggagacacuccugcuucugacccuccuggccacggugacagggggaaucuuccuguuucucauguccggcaaagggauuggaaagaugacccuuggcaugugcugcaucaucaccgcuagcauucugcugugguaugcccaaauccagccucacuggauugccgcuucuaucauucucgaguucuuucugaucguucuucugauccccgagcccgaaaaacagcggacaccucaggauaaucaacucaccuacguggucauugccauccugacaguggucgcggccacgauggcuaacgagaugggcuuccuggagaagaccaagaaagaccucgggcuuggauccauuacaacccaggaaagcgaguccaauauccuggacauugaucugagaccggccucugcuuggacacucuaugccguggcgaccacguuuguuacccccaugcugcggcauagcaucgaaaacuccucugugaaugugagccuuacagccauugcuaaccaggccaccguccugaugggccucgggaagggauggccucuguccaaaauggacaucggcguuccccugcucgcuaucggguguuacagccaggugaauccuauuacacuuaccgccgcucugcugcuccugguggcccacuacgcgaucauuggacccggccuucaagccaaggcuacgcgcgaggcccagaaaagagcugccgccggcaucaugaagaacccuacagucgaugggauuaccgugaucgaccuggaaccgauccccuaugauccuaaguucgagaaacagcucggacagguuaugcugcugauucucugcgugacacaaguccuuaugaugcggaccaccugggcgcugugugaggcucugacacucgccacgggccccaucucuacccugugggaagggaauccuggacgcuuuuggaacacaaccauugcuguguccauggccaauaucuucagaggcagcuaccuugccggggcuggacugcucuuuucuauuaugaagaacacaaccuccacgcggcgcggcacaggcaauaucggggagacccugggagaaaaauggaaaagcagacugaacgcccucggcaaaucugaguuccagaucuauaagaaaagcgggauucaggaggucgaccggacccuugcgaaggaaggaaucaagcgcggcgagacagaucaucacgccguguccagagggucugcuaaacugcggugguuuguugaaagaaacauggugacccccgagggaaaggucguggaccugggcugcggccgcgggggauggagcuacuauuguggcgggcucaaaaauguucgggaagugaagggacugacaaaaggcgggccgggacaugaggagccuauucccauguccacguacggcuggaaccuugucagacugcaaagcggcguggauguguucuucacacccccugaaaagugcgacacccuccugugugauaucggggaguccucucccaauccuaccauugaagccggacgcacacugcggguucucaaccuugucgagaauuggcugaacaauaacacccaguuuugcaucaaggugcugaauccguauaugcccagcgugaucgagaagauggaggcucuccagagacaguacggcggggcccugguccgcaacccucuuuccagaaauucuacgcacgagauguacuggguuagcaacgcgaccggaaauauuguguccucugugaacaugaucagcagaaugcugauuaaucgcuucacaaugaagcacaaaaaggccaccuaugaacccgacgucgaucucggcuccgggacacggaacaucggaauugagagcgaaaucccuaaccuggacauuaucggcaaaagaaucgagaagauuaagcaagaacaugagaucucuuggcacuacgaccaggaucaucccuauaaaaccugggcuuaccacggcuccuaugagacaaagcagaccgggagcgccucuuccauggugaauggaguugugcgccugcucacgaaaccgugggacgucgugccuaugguuacacagauggcuaugaccgauaccacacccuuuggccaacagcggguguucaaggaaaaagucgacacgagaacccaggagccuaaggaagggacaaagaaacuuaugaagauuaccgccgaguggcuguggaaagagcugggaaagaaaaagacaccccgcauguguaccagagaagaguuuacacggaaagugcgcagcaacgcugcccucggcgcgaucuucaccgaugaaaauaaguggaagucugccagagaggcuguggaagacgggcgguuuugggagcuggucgauagagagcggaaccuucaccuggaaggaaaaugcgagacguguguuuacaauaugaugggcaagcgcgagaagaagcucggcgaguucgggaaagccaagggauccagagcuauuugguauauguggcugggcgcccgguuucuggaguucgaggcccucggguuucugaacgaggaccauugguucagccgcggaaauucccuuagcggcguggaaggggagggccugcacagacucggauacauccugcgggaugugggcaagaaagaagggggagcgauguacgcugacgauaccgccggcugggacacacgcaucacccuugaggaccugaagaacgaagagauggucacaaaucauaugaaaggggagcacaagaaacucgccgaagcuauuuuuaagcugaccuaucagaacaaggugguuagagugcaacggccuacgccccgcggaacagucauggauaucauuucuagacgggaccagcgcggcagcggacaggugggcaccuacggacugaauacauucaccaacauggaggcccaacucaucagacagauggaaggcgaggggauuuucaaauccauccagcaucugacggcuaccgaggaaaucgccguucagaauuggcuugcgcgggugggacgcgagagacugucucggauggccauuagcggcgaugacugcgucgugaagccgaucgaugacagauuugcuuccgcccucacagcucugaacgauauggggaaaguucgcaaggacauucaacagugggaaccuucucggggauggaaugauuggacccaggugcccuucugcagccaccacuuucaugagcuugucaugaaagacggcagagugcuggucgugcccugucgcaaccaggaugaacucaucgggcgggccagaauuucccaaggcgcgggauggucucugaaggagacagccugccugggcaagagcuaugcucagauguggacccucauguacuuccaccgccgggaccugagacuugccgcuaacgccaucuguuccgcuguuccuagccauugggugccgacaucucgcaccacgugguccauucacgccaaacacgaguggaugacaaccgaagauaugcuggcggucuggaaucggguguggauccaggagaaccccuggauggaagacaagaccccuguggagagcugggaagagguucccuaucucgggaaaagagaggaccaguggugcggaucucugaucggccuuacaucccgcgccaccugggcuaagaauauucaaacagccaucaaccaggugcggagccugauugggaaugaagaguacacggauuauaugccuuccaugaaaagauuucggagagaagaggaagaggccggaguccucugguga

SEQ ID NO: 19738 - RNA, 9876 nt, Artificial Sequence
  derived and/or modified CDS sequence (opt5) from DENV-2__FJ373300__SS-prME
acagccggcgugaucgucaugcugauucccacagcuauggccuuccaccucacgacacggaauggggaaccucauaugaucguuggacggcaggaaaagggcaagagccugcuuuuuaagacagaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggacgaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacgaacauuuggcugaaacuucgggagaaacaggacguguuuugugauuccaagcugaugagcgccgcuaucaaagacaauagagccguucacgcggauaugggcuauuggaucgaaucugcccucaacgacacauggaagauggagaaggcuuccuucauugaggugaaaagcugccacuggccuaagucucauacccuguggagcaaugggguccuggaauccgagaugaucauucccaaaaacuucgccggaccggugagccagcacaacuaccgcccuggcuaucauacccaaacagcugggcccuggcaccuuggaaagcucgaaauggauuuugacuucugugagggcaccacgguggucguuacagaagauugcgggaaucggggacccucucugagaaccacaaccgccuccggcaaacugaucacagaguggugcugucggagcugcacccucccuccgcugcgcuacagaggcgaggacggguguugguacggaauggaaauucggccccuuaaggagaaggaagagaaccuggugaauagccucgugacggccggccaugggcagaucgauaacuuuucucugggaguccugggcauggcucuuuuccucgaagagaugcugagaacccgcauugggacaaaacacgcgauccugcucguggccguuagcuuugugacccugaucacaggaaauauguccuuccgggaccuuggcagagucauggugaugguuggcgcuaccaugacggaugacauugggaugggagugacauaucuggcccuccuggccgcuuuuaagguccgcccuaccuucgccgcgggccugcuucugagaaaacucacaucuaaggagcugaugauggcuaccaucgggauugcccuccugagccaguccaccauccccgaaacaauucuugagcugacggaugcccucgcucugggaaugauggugcugaaaaucguucggaacauggaaaaguaccaacuugccgugaccaucauggcgauuucuugcgucccuaaugcugugauccugcagaacgccuggaaggugagcuguacaguccucgccgcuguuuccgugagcccccugcuccugaccucuucccagcagaaagccgacuggauuccucuugcucugacaaucaagggccucaaucccaccgccauuuuucugacgacacugagccgcaccucuaaaaagagauccuggccgcuuaacgaggcgaucauggccguggggauggucagcauccuggcuucuucccuccugaaaaaugacauuccuaugaccggaccccucguggccggcggccugcuuacaguuugcuaugugcugaccgggcggagcgcugaucuggaacucgagcgcgccgccgacgucaagugggaggaucaagcugaaaucuccggaagcucuccuauucugagcaucacaauuuccgaggacggcucuaugagcaucaaaaacgaagaggaggaacagacgcuuaccauucugaucagaacagggcuccuggugaucuccggaguuuuccccgugucuauuccgaucaccgcggccgcuugguaccucugggaggucaagaagcagcgggccggcgugcugugggaugucccuucucccccucccguggaaaaagccgagcuugaagacggggcuuaucgcauuaagcagagaggaauccugggcuacucccaaauuggcgccgggguuuauaaagagggaacauuucacaccauguggcaugugacgcggggcgcgguccugaugcaccgcgggaagagaaucgagcccuccugggcugaugugaaaaaggaccucaucagcuacggaggcggguggaagcuggaaggagaguggaaagaaggcgaggaaguucaggugcuugcccuggagccuggcaagaauccgcgggccguccagaccaaacccgggauuuucaagacaaacaccggaacaaucggcgcugugucccucgauuuuagcccugggaccucuggaucccccauuguggacagaaaaggcaagguugucgggcuguacggaaauggcguggugacacgcagcggcgccuaugucucugcgaucgcucagacggagaaguccauugaagauaacccugagaucgaagacgauaucuuccggaaaaagagacucaccauuauggaccugcaucccggggccggaaaaacaaagcgcuaccuuccugccaucgugcgggaggcuauuaaaagaggccugcgcacccugauccucgccccgacccggguuguggcugccgaaauggaggaggcgcugagagggcuucccauucgcuaucaaaccccugccaucaagacggaacacaccggacgggagauugucgaccugaugugucaugcuacauucaccaugagacuccugagccccgugcggguuccuaacuacaaucucaucaucauggaugaagcccacuuuacagaccccgcuuccauugccgcccgcggcuauaucucuaccagaguggagaugggggaggcugcgggcauuuucaugacggccacaccgccuggaagccgggaucccuuuccccaguccaacgcuccuaucauggacgaagaaagagaaauucccgagagaagcuggaacucuggccacgaaugggucaccgauuucaaggggaaaaccgugugguuuguuccuuccaucaaggccggaaacgacaucgccgcuugccugcggaaaaauggcaagaaagugauucagcuuagcagaaagacauucgauucugaguacgucaagacccgcgccaacgacugggauuuuguggugacaaccgacaucagcgagaugggggcgaauuucaaagcugaacgggucauugauccgagacgcuguaugaagcccguuauccugacggacggagaggaacgggugauucuggccggcccuaugcccgugacacauuccucugccgcucaaagacgcgggcggaucggcagaaacccuaaaaaugagaacgaccaguauaucuacaugggagaaccccucgagaaugaugaggacugcgcccacuggaaggaagcgaaaaugcugcuugauaacauuaauaccccggagggcaucauuccuagcauguuugaacccgagcgcgaaaaggucgacgccaucgauggggaguacagacugcggggagaggcucgcaaaacauucguggaccucaugagacggggcgaucugccuguuuggcuggccuauaagguggcugccgaagggauuaacuacgcugaccgcaagugguguuuugauggaaucaaaaauaaccagauucucgaggaaaacauggaggucgagaucuggaccaaggaaggcgagcgcaagaaacuuaaaccccgguggcuggacgccagaaucuauuccgauccucuggcgcucaaggaguucaaggaguucgccgcugggcgcaaaucucugacgcuuaaucugauuaccgaaaugggccggcuccccacauuuaugacccagaaggccagaaacgcucuggacaaucuggccgugcuccauacagccgaggcuggaggccgcgcguacaaccacgcccuuagcgagcugccggaaacccuggagacacuccugcuucugacccuccuggcuacgguuacagggggaaucuuccuguuucucauguccggcaaagggauuggaaagaugacccuuggcaugugcugcaucauuaccgccagcauccugcugugguaugcccaaauccagccucacuggauugcugccucuaucauucucgaguucuuucugaucgugcuucugauucccgagcccgaaaaacagcggacaccucaggauaaucaacucaccuacgucgugaucgcgauccugacagucguggccgcuacgauggccaacgagaugggcuuccuggagaagaccaagaaagaccucgggcuuggauccauuacaacccaggaaagcgaguccaauauccuggacauugaucugagaccggcuucugccuggacacucuaugcgguugccaccacguuugugacccccaugcugcggcauagcaucgaaaacuccucugugaaugucagccuuacagcuauugccaaccaggcuaccguucugaugggccucgggaagggauggccucuguccaaaauggacaucggcgugccccugcucgccauuggguguuacagccaggugaauccuaucacacuuaccgcugcccugcugcuccuggucgcgcacuacgccaucauuggacccggccuucaagcuaaggccacgcgcgaggcucagaaaagagccgccgcgggcaucaugaagaacccuacaguggaugggauuaccguuaucgaccuggaaccgauucccuaugauccuaaguucgagaaacagcucggacaggugaugcugcugauccucugcgucacacaagugcuuaugaugcggaccaccugggcucugugugaggcccugacacucgcuacgggccccaucucuacccugugggaagggaauccuggacgcuuuuggaacacaaccauugccgucuccauggccaauaucuucagaggcagcuaccuugcuggggccggacugcucuuuucuauuaugaagaacacaaccuccacgcggcgcggcacaggcaauaucggggagacccugggagaaaaauggaaaagcagacugaacgcgcucggcaaaucugaguuccagauuuauaagaaaagcgggauccaggagguggaccggacccuugccaaggaaggaaucaagcgcggcgagacagaucaucacgcuguuuccagagggucugccaaacugcggugguuuguggaaagaaacauggucacccccgagggaaaggugguugaccugggcugcggccgcgggggauggagcuacuauuguggcgggcucaaaaaugugcgggaagucaagggacugacaaaaggcgggccgggacaugaggagccuauucccauguccacguacggcuggaaccuugugagacugcaaagcggcguggauguuuucuucacacccccugaaaagugcgacacccuccugugugauaucggggaguccucucccaauccuaccauugaagcuggacgcacacugcggguccucaaccuuguggagaauuggcugaacaauaacacccaguuuugcaucaaggugcugaauccguauaugcccagcgucauugagaagauggaggcccuccagagacaguacggcggggcgcugguucgcaacccucuuuccagaaauucuacgcacgagauguacugggugagcaacgccaccggaaauaucguguccucugucaacaugaucagcagaaugcugauuaaucgcuucacaaugaagcacaaaaaggcuaccuaugaacccgacguggaucucggcuccgggacacggaacaucggaauugagagcgaaaucccuaaccuggacauuaucggcaaaagaauugagaagaucaagcaagaacaugagaucucuuggcacuacgaccaggaucaucccuauaaaaccugggccuaccacggcuccuaugagacaaagcagaccgggagcgcuucuuccaugguuaauggagugguccgccugcucacgaaaccgugggacgugguuccuauggugacacagauggccaugaccgauaccacacccuuuggccaacagcgggucuucaaggaaaaaguggacacgagaacccaggagccuaaggaagggacaaagaaacuuaugaagauuaccgcugaguggcuguggaaagagcugggaaagaaaaagacaccccgcauguguaccagagaagaguuuaccaagaaggugcggagcaacgccgcgcucggcgccaucuucaccgaugaaaauaaguggaaaucugcucgcgaggccgucgaagacgggagauuuugggagcugguugaucgggagagaaaccuucaccuggaaggaaagugcgagacguguguguacaauaugaugggcaaacgggaaaagaaacucggcgaguucgggaaggcuaagggaucccgcgccauuugguauauguggcugggcgccagauuucuggaguucgaggcgcucggguuucugaacgaggaccauugguucagccggggaaauucccuuagcggcguggaaggggagggccugcaccgccucggauacauccugagagaugucggcaaaaaggaagggggagcuauguacgccgacgauaccgccggcugggacacacggauuacccuugaggaccugaaaaacgaagagauggugacaaaucauaugaagggggagcacaaaaagcucgcugaagccaucuuuaagcugaccuaucagaacaaaguugugcgcguccaaagaccuacgccccggggaacagugauggauaucauuucucgcagagaccagcggggcagcgggcagguuggcaccuacggacugaauacauucaccaacauggaggcucaacucauccgccagauggaaggcgaggggauuuucaaguccauccagcaucugacggccaccgaggaaauugcggugcagaauuggcuugccagagucggacgggagcgccugucuagaauggcuaucagcggcgaugacugcgugguuaaaccgaucgaugaccgguuugccuccgcucucacagcccugaacgauauggggaaggugagaaaagacauucaacagugggaaccuucucgcggauggaaugauuggacccagguccccuucugcagccaccacuuucaugagcuugugaugaaggacggccggguccuggugguucccuguagaaaccaggaugaacucaucgggcgcgcgcggauuucccaaggcgccggauggucucugaaggagacagcuugccugggcaaaagcuaugcccagauguggacccucauguacuuccacagacgcgaccugcggcuugcugccaacgcuaucuguuccgccgugccuagccauugggucccgacaucuagaaccacgugguccauucacgcgaagcacgaguggaugacaaccgaagauaugcuggccguguggaaucgcguguggauccaggagaaccccuggauggaagacaaaaccccuguugagagcugggaagaggugcccuaucucgggaagcgggaggaccaguggugcggaucucugauuggccuuacauccagagcuaccugggccaaaaauauccaaacagccaucaaccagguccgcagccugauugggaaugaagaguacacggauuauaugccuuccaugaagcgguuuagacgggaagaggaagaggcuggagugcucugguga

SEQ ID NO: 19739 - RNA, 9876 nt, Artificial Sequence
  derived and/or modified CDS sequence (opt5) from DENV-2__EU596495__SS-prME
accgccggagugaucgucaugcugauucccaccgcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagacccggacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgggaaggacagcccggucaacauugaagccgagcccccuuuuggcgauucuuacaucauuaucggaguggaacccggccagcucaaacugaauugguucaagaagggguccagcaucggacaaauguuugagacaaccaugagaggcgcuaaacgcauggccauucuuggggacacggccugggauuucggaucucugggcgggguuuuuacaagcaucggcaaggcucuccaccagguguucggagccauuuacggcgcggcuuuuuccggggucucuuggaccaugaaaauccugauuggagugaucaucaccuggauuggcaugaacagccgguccacaagccugucugugucccuuguucucgucgggguggugacccuguaucugggagccgucgugcaggccgacagcggcuguguugugucuuggaagaauaaagagcucaagugcggguccggcaucuucauuacagauaacguccacacguggaccgaacaguacaaguuucaaccugagagccccuccaaacuggcuucugccauccagaaggcucaugaagagggaauuuguggcaucagaagcgugacacgccuugaaaaucugauguggaaacagaucaccccggagcucaaccacauucuguccgagaaugaaguuaagcugacaaucaugaccggggacauuaaaggaaucaugcaggccggcaagcggucucuuagaccucaacccacggagcucaaauauagcuggaagaccugggggaaggcgaaaaugcuguccacagaaagccauaaccagaccuuccugauugauggaccugagacagccgaaugccccaauaccaaccgcgcuuggaacucucucgagguggaggacuacggcuuuggcgucuucacaaccaacaucuggcugaaacuucgggaaaaacaggacguguuuugugauuccaagcugaugagcgccgcuaucaaagacaauagagccguucacgcggauaugggguauuggauugagucugcccucaacgacacguggaagauggaaaaggcuuccuucaucgaggugaaaagcugccacuggccuaagucucauacacuguggagcaauggaguccuggaguccgaaaugauuauccccaaaaacuucgccggcccggugagccagcacaacuaccgcccuggguaucauacccaaaccgcuggacccuggcaccuuggcaagcucgagauggauuuugacuucugugaagggacaaccguggucguuacggaggauugcggaaaucggggccccucucugagaacaaccacagccuccggcaaacugauuaccgaauggugcugucggagcugcacacucccuccgcugcgcuacagaggggaggacggauguugguacggcauggagauccggccccuuaaggaaaaggaggaaaaccuggugaauagccucgugaccgccgggcauggacagauugauaacuuuucucugggcguccuggggauggcucuuuuccucgaggaaaugcugagaacgcgcaucggaaccaaacacgcgauccugcucguggccguuagcuuugugacacugauuaccggcaauauguccuuccgggaccuuggcagagucauggugaugguuggggcuacaaugaccgaugacaucggaaugggcgugacguaucuggcccuccuggccgcuuuuaagguccgcccuacauucgccgcggggcugcuucugagaaaacucaccucuaaggagcugaugauggcuacaauuggaaucgcccuccugagccaguccaccauucccgagaccauccuugaacugacagaugcccucgcucugggcaugauggugcugaaaaucguucggaacauggagaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaaggggcucaaucccacagccaucuuucugaccacgcugagccgcacaucuaaaaagagauccuggccgcuuaacgaagcgauuauggccgugggaauggugagcauccuggcuucuucccuccugaaaaaugacauuccuaugaccggcccccucgucgccggcgggcugcuuaccgugugcuauguucugacaggacggagcgcugaucuggagcucgaacgcgccgccgacgugaagugggaggaucaagcugagaucuccggcagcucuccuauucugagcaucaccauuuccgaagacgggucuaugagcaucaaaaacgaggaagaggagcagacacuuacgauccugauuagaaccggacuccuggucaucuccggcguguuccccguuucuauuccgaucacagcggccgcuugguaccucugggaagugaagaagcagcgggccgggguccugugggaugugccuucucccccucccgucgagaaagccgaacuugaggacggagcuuaucgcauuaagcagagaggcauccugggcuacucccaaaucggggccggaguguauaaagaaggcaccuuucacacaauguggcauguuaccagaggggcggugcugaugcaccgcggaaagagaauugagcccuccugggcugaugucaaaaaggaccucaucagcuacggcgggggauggaagcuggagggcgaauggaaagagggcgaagaggugcagguucuugcccuggaaccugggaagaauccgcgggccgugcagacgaaacccggaauuuucaagaccaacacaggcaccaucggggcugucucccucgauuuuagcccuggaacaucuggcucccccauuguggacagaaaagggaaggugguuggacuguacggcaauggcgucgugacccgcagcggggccuaugugucugcgaucgcucagacagagaaguccaucgaggauaacccugaaauugaggacgauaucuuccggaaaaagagacucacgauuauggaccugcaucccggagccggcaaaaccaagcgcuaccuuccugccaucguccgggaagcuauuaaaagagggcugcgcacacugauccucgccccgacccgggugguugcugccgagauggaagaggcgcugagaggacuucccauucgcuaucaaaccccugccaucaagacagagcacacgggccgggaaaucguggaccugaugugucaugcuaccuucacaaugagacuccugagccccguccgggugccuaacuacaaucucauuaucauggaugaggcccacuuuaccgaccccgcuuccauugccgcccgcggguauaucucuacaagaguugaaaugggcgaggcugcgggaauuuucaugaccgccacgccgccuggcagccgggaucccuuuccccaguccaacgcuccuaucauggacgaggaacgcgagauccccgaaagaagcuggaacucugggcacgagugggugacagauuucaagggaaaaaccgucugguuugugccuuccauuaaggccggcaacgacaucgccgcuugccugcggaaaaaugggaagaaaguuauucagcuuagcagaaagaccuucgauucugaauacgugaagacacgcgccaacgacugggauuuugucgugaccacagacaucagcgagaugggagcgaauuucaaagcugagcgggugauugauccgagacgcuguaugaagcccgucauccugaccgacggcgaagaacggguuauccuggccgggccuaugcccgugacgcauuccucugccgcucaaagacgcggccggauuggaagaaacccuaaaaaugaaaacgaccaguauaucuacaugggcgagccccucgaaaaugaugaggacugcgcccacuggaaggaggcgaaaaugcugcuugauaacauuaauacaccggaagggaucauuccuagcauguuugagcccgaacgcgagaagguggacgccaucgauggagaauacagacugcggggcgaggcucgcaaaaccuucgucgaccucaugagaagaggggaucugccuguguggcuggccuauaagguugcugccgagggaauuaacuacgcugaccgcaagugguguuuugauggcaucaaaaauaaccagauccucgaagagaacauggaaguggagauuuggacaaaggagggggaacgcaagaaacuuaaaccccgguggcuggacgccagaaucuauuccgauccucuggcgcucaaggaguucaaggaguucgccgcuggccgcaaaucucugacccuuaaucugauuacggagaugggacggcuccccaccuuuaugacacagaaggccagaaacgcucuggacaaucuggccguccuccauaccgccgaagcuggcgggcgcgcguacaaccacgcccuuagcgagcugccggagacacuggaaacccuccugcuucugacacuccuggcuaccgugacgggaggcaucuuccuguuucucauguccgggaaaggaauuggcaagaugacacuuggcaugugcugcaucaucaccgccagcauucugcugugguaugcccaaauccagccucacuggauugcugccucuaucauucucgaguucuuucugaucguucuucugauccccgaacccgagaaacagcggaccccucaggauaaucaacucacauacguggucauugcgauccugaccguggucgccgcuacaauggccaacgaaaugggguuccuggagaagacgaagaaagaccucggacuuggcuccauuaccacacaggagagcgaauccaauauccuggacauugaucugagaccggcuucugccuggacccucuaugcgguggccacaaccuuuguuacgcccaugcugcggcauagcaucgagaacuccucugugaaugugagccuuaccgcuauugccaaccaggcuacaguccugauggggcucggaaagggcuggccucuguccaaaauggacaucgggguuccccugcucgccaucggauguuacagccaggugaauccuauuacccuuacagcugcccugcugcuccugguggcgcacuacgccaucauuggccccggccuucaagcuaaggccacccgcgaagcucagaaaagagccgccgcggggaucaugaagaacccuacggucgauggaauuacagugaucgaccuggagccgauccccuaugauccuaaguucgaaaaacagcucggccagguuaugcugcugauucucugcgugacccaaguccuuaugaugcggacaaccugggcucugugugaggcccugacccucgcuacagggcccaucucuacgcugugggagggaaauccuggccgcuuuuggaacaccacaauugccguguccauggccaauaucuucagagggagcuaccuugcuggagccggccugcucuuuucuauuaugaagaacaccacauccacccggcgcggcacggggaauaucggagaaacacugggcgagaaauggaaaagcagacugaacgcgcucgggaaaucugaguuccagaucuauaagaaaagcggcauucaggaggucgaccggacccuugccaaggagggcaucaagcgcggggaaaccgaucaucacgcuguguccagaggaucugccaaacugcggugguuuguugagagaaacauggugacacccgaaggcaaggucguggaccugggcugcgggcgcggaggcuggagcuacuauugugggggacucaaaaauguucgggaggugaagggccugaccaaagggggaccgggccaugaagaaccuauucccauguccacauacggcuggaaccuugucagacugcaaagcgggguggauguguucuucacgcccccugagaagugcgacacccuccugugugauaucggagaauccucucccaauccuacaauugaggcuggccgcacccugcggguucucaaccuugucgaaaauuggcugaacaauaacacacaguuuugcaucaaggugcugaauccguauaugcccagcgugaucgagaaaauggaagcccuccagagacaguacgggggagcgcugguccgcaacccucuuuccagaaauucuacccacgagauguacuggguuagcaacgccacgggcaauauuguguccucugugaacaugaucagcagaaugcugauuaaucgcuucaccaugaagcacaaaaaggcuacauaugagcccgacgucgaucucggguccggaacccggaacaucggcauugaaagcgagaucccuaaccuggacauuaucggcaaaagaaucgaaaagauuaagcaagagcaugaaaucucuuggcacuacgaccaggaucaucccuauaaaacaugggccuaccacggguccuaugagaccaagcagacaggaagcgcuucuuccauggugaauggcguugugcgccugcucaccaaaccgugggacgucgugccuaugguuacgcagauggccaugacagauaccacccccuuugggcaacagcggguguucaaggagaaagucgacacaagaacgcaggaaccuaaggagggaaccaagaaacuuaugaagauuacagcugaauggcuguggaaagagcugggcaagaaaaagacccccagaauguguacaagagaggaauuuaccaaaaaggugcggagcaacgccgcgcucggggccaucuucacagaugagaauaaguggaaaucugcucgcgaagccguggaggacggaagauuuugggaacuggucgaucgggagagaaaccuucaccuggagggcaagugcgaaaccuguguuuacaauaugaugggcaaacgggagaagaaacucggggaguucggaaaggcuaagggcucccgcgccauuugguauauguggcugggggccagauuucuggaguucgaagcgcucggauuucugaacgaggaccauugguucagccggggcaauucccuuagcgggguggagggcgaaggacugcaccgccucggcuacauccugagagauguggggaaaaaggagggaggcgcuauguacgccgacgauacggccgggugggacacccggaucacacuugaagaccugaaaaacgaggaaauggucaccaaucauaugaagggagagcacaaaaagcucgcugaggccauuuuuaagcugacauaucagaacaaagugguucgcgugcaaagaccuacaccccggggcacggucauggauaucauuucucgcagagaccagcgggggagcggccaggugggaacauacggccugaauaccuucacaaacauggaagcucaacucauccgccagauggagggggaaggaauuuucaaguccauccagcaucugaccgccacggaggagaucgcgguucagaauuggcuugccagagugggccgggaacgccugucuagaauggcuauuagcggggaugacugcgucgugaaaccgaucgaugaccgguuugccuccgcucucaccgcccugaacgauaugggaaagguuagaaaagacauucaacagugggagccuucucgcggcuggaaugauuggacacaggugcccuucugcagccaccacuuucaugaacuugucaugaaggacgggcgggugcuggucgugcccuguagaaaccaggaugagcucaucggccgcgcgcggauuucccaaggagccggcuggucucugaaggaaaccgcuugccuggggaaaagcuaugcccagauguggacacucauguacuuccacagacgcgaccugcggcuugcugccaacgcuaucuguuccgccguuccuagccauugggugccgaccucuagaacaaccugguccauucacgcgaagcacgaguggaugacgacagaggauaugcuggccgucuggaaucgcguguggauccaggaaaaccccuggauggaggacaaaaccccuguggaaagcugggaggaaguucccuaucucggaaagcgggaggaccaguggugcggcucucugaucgggcuuaccuccagagcuacaugggccaaaaauauucaaaccgccaucaaccaggugcgcagccugauuggaaaugaggaauacacagauuauaugccuuccaugaagcgguuuagacgggaggaagaggaagcuggcguccucugguga

SEQ ID NO: 19740 - RNA, 9876 nt, Artificial Sequence
  derived and/or modified CDS sequence (opt5) from DENV-2__EU596497__SS-prME
accgccggcgugaucgucaugcugauucccaccgcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaucaccgagagccgguguccgacacaaggagagcccucucugaaugaagaacaggacaaacgcuuuauuugcaagcauuccaugguggauagaggcuggggcaacggguguggacuguucggcaaaggcgggaucgucacaugcgccauguuuacaugcaaaaagaauauggaagggaaaguugugcagccugagaaccucgaauacacgauugugaucacaccccacagcggggaggagcaugcggucggaaaugacacaggcaagcacggcaaagaaaucaagauuaccccucagucuuccaucacagaggccgaacugaccggguauggaacggugaccauggaguguagcccccggacaggccuugauuucaacgaaaugguucugcuccaaauggaggacaaggcuuggcuggugcaccgccagugguuucuugaucugccgcucccuuggcugcccggggccgacacccagggaucuaauuggauucagaaggagacacuggucaccuucaagaacccucaugcuaaaaagcaagacgugguugugcucggcucccaggaaggggccaugcacacggcccugacaggcgcuaccgagauccagaugagcuccggaaaucuucuguuuacaggccaucucaaaugcagacugcggauggauaaacuucaacugaaagggaugucuuacagcauguguaccggaaaguucaagauugucaaagaaaucgcggagacccagcacggcacaaucgugauuagaguccaguaugagggggacggaucccccugcaagauccccuucgaaauuacggaucucgagaaacgccaugugcugggccggcugaucaccguuaacccuauugugacagaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucggggugaucauuaccuggaucggaaugaacagccgguccaccagccugucugugucccuuguucucgucggcguggugacacuguaucugggggccgucgugcaggccgacagcggauguguugugucuuggaagaauaaagaacucaagugcggcuccgggauuuucaucaccgauaacguccacacauggacggagcaguacaaguuucaaccugaaagccccuccaaacuggcuucugccauucagaaggcucaugaggaaggcaucuguggaaucagaagcgugacccgccuugagaaucugauguggaaacagauuacaccggagcucaaccacauccuguccgaaaaugagguuaagcugaccauuaugacaggcgacaucaaagggauuaugcaggccggaaagcggucucuuagaccucaacccaccgaacucaaauauagcuggaagacguggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacaaacaucuggcugaaacuucgggagaaacaggacguguuuugugauuccaagcugaugagcgccgcuauuaaagacaauagagccguucacgcggauaugggcuauuggaucgaaucugcccucaacgacaccuggaagauggagaaggcuuccuucauugaggugaaaagcugccacuggccuaagucuuacacgcuguggagcaaugggguccuggaauccgagaugaucauucccaaaaacuucgccggaccggugagccagcauaacuaucgcccuggcuaccacacacaaaccgcugggcccuggcaucuuggaaagcucgaaauggauuuugacuucugugagggcaccacaguggucguuaccgaagauugcgggaaucggggacccucucugagaacgacaaccgccuccggcaaacugaucacagaguggugcugucggagcugcacccucccuccgcugcgcuacagaggcgaggacggguguugguauggaauggaaauucggccccuuaaggagaaggaagagaaccuggugaauagccucgugacagccggccacgggcagaucgauaacuuuucucugggaguccugggcauggcucuuuuccucgaagagaugcugagaacccgcaucgggacgaaacaugcgauucugcucguggccguuagcuuugugacccugaucacaggaaauauguccuuccgggaccuuggcagagucauggugaugguuggcgcuaccaugacagaugacauugggaugggagugaccuaccuggcccuccuggccgcuuuuaagguccgcccuacguucgccgcgggccugcuucugagaaaacucacaucuaaggagcugaugauggcuaccaucgggauugcccuccugagccaguccacaauccccgaaaccauccuugagcugaccgaugcccucgcucugggaaugauggugcugaaaauuguucggaacauggaaaaguaucaacuugccgugacaaucauggcgauuucuugcgucccuaaugcugugauccugcagaacgccuggaaggugagcuguacgauucucgccgcugucuccguuagcccccugcuccugaccucuucccagcagaaagccgacuggaucccucuugcucugacaaucaagggccucaaucccaccgccauuuuucugacaacccugagccgcacgucuaaaaagagauccuggccgcuuaacgaggcgaucauggccguggggauggugagcauucuggcuucuucccuccugaaaaaugacaucccuaugacaggaccccucgucgccggcggccugcuuaccgugugcuacguucugaccgggcggagcgcugaucuggaacucgagcgcgccgccgacgugaagugggaggaucaagcugaaauuuccggaagcucuccuauccugagcauuacaaucuccgaggacggcucuaugagcaucaaaaacgaagaggaggaacagacccuuacaauucugaucagaacggggcuccuggucauuuccggaguguuccccguuucuaucccgauuaccgcggccgcuugguaucucugggaggugaagaagcagcgggccggcguccugugggaugugccuucucccccucccgucgaaaaagccgagcuugaagacggggcuuaccgcaucaagcagagaggaauccugggcuauucccaaauuggcgccgggguguacaaagagggaacauuucacaccauguggcacguuacacggggcgcggugcugaugcaucgcgggaagagaaucgagcccuccugggcugaugucaaaaaggaccucauuagcuacggaggcggguggaagcuggaaggagaguggaaagaaggcgaggaagugcagguucuugcccuggagccuggcaagaauccgcgggccgugcagaccaaacccgggaucuucaagacgaacaccggaacaauuggcgcugucucccucgauuuuagcccugggaccucuggaucccccaucguggacagaaaaggcaaggugguugggcuguauggaaauggcgucgugacacgcagcggcgccuacgugucugcgaucgcucagaccgagaaguccauugaagauaacccugagaucgaagacgauauuuuccggaaaaagagacucacaaucauggaccugcaccccggggccggaaaaacgaagcgcuaucuuccugccauuguccgggaggcuaucaaaagaggccugcgcacccugauucucgccccgacacgggugguugcugccgaaauggaggaggcgcugagagggcuucccauccgcuaccaaaccccugccaucaagaccgaacauacaggacgggagauuguggaccugaugugucacgcuacguucaccaugagacuccugagccccguccgggugccuaacuauaaucucaucauuauggaugaagcccauuuuacagaccccgcuuccaucgccgcccgcggcuacauuucuaccagaguugagaugggggaggcugcgggcaucuucaugacagccaccccgccuggaagccgggaucccuuuccccaguccaacgcuccuaucauggacgaagaaagagaaauucccgagagaagcuggaacucuggccacgaaugggugacggauuucaaggggaaaacagucugguuugugccuuccaucaaggccggaaacgacauugccgcuugccugcggaaaaauggcaagaaaguuauccagcuuagcagaaagaccuucgauucugaguaugugaagacccgcgccaacgacugggauuuugucgugacaaccgacauuagcgagaugggggcgaauuucaaagcugaacgggugaucgauccgagacgcuguaugaagcccgucauccugacagacggagaggaacggguuauucuggccggcccuaugcccgugacccacuccucugccgcucaaagacgcgggcggaucggcagaaacccuaaaaaugagaacgaccaguacauuuacaugggagaaccccucgagaaugaugaggacugcgcccauuggaaggaagcgaaaaugcugcuugauaacaucaauacgccggagggcauuaucccuagcauguuugaacccgagcgcgaaaagguggacgccauugauggggaguauagacugcggggagaggcucgcaaaacauucgucgaccucaugagacggggcgaucugccuguguggcuggccuacaagguugcugccgaagggaucaacuaugcugaccgcaagugguguuuugauggaaucaaaaauaaccagauucucgaggaaaacauggagguggagaucuggaccaaggaaggcgagcgcaagaaacuuaaaccccgguggcuggacgccagaauuuacuccgauccucuggcgcucaaggaguucaaggaguucgccgcugggcgcaaaucucugacacuuaaucugaucaccgaaaugggccggcuccccacguuuaugacccagaaggccagaaacgcucuggacaaucuggccguccuccacacagccgaggcuggaggccgcgcguauaaccaugcccuuagcgagcugccggaaacccuggagacacuccugcuucugacccuccuggcuacagugaccgggggaauuuuccuguuucucauguccggcaaagggaucggaaagaugacgcuuggcaugugcugcaucauuacagccagcauccugcugugguacgcccaaauucagccucacuggaucgcugccucuauuauccucgaguucuuucugaucguucuucugauucccgagcccgaaaaacagcggaccccucaggauaaucaacucaccuauguggucaucgcgauucugacaguggucgccgcuaccauggccaacgagaugggcuuccuggagaagacaaagaaagaccucgggcuuggauccaucacgacccaggaaagcgaguccaauauucuggacaucgaucugagaccggcuucugccuggacacucuacgcgguggccaccacauuuguuacccccaugcugcggcacagcauugaaaacuccucugugaaugugagccuuacggcuaucgccaaccaggcuaccguccugaugggccucgggaagggauggccucuguccaaaauggacaucggcguuccccugcucgccauuggguguuacagccaggugaauccuaucacacuuaccgcugcccugcugcuccugguggcgcauuaugccauuaucggacccggccuucaagcuaaggccacacgcgaggcucagaaaagagccgccgcgggcauuaugaagaacccuaccgucgaugggaucacggugaucgaccuggaaccgauucccuacgauccuaaguucgagaaacagcucggacagguuaugcugcugauccucugcgugacacaaguccuuaugaugcggaccacaugggcucugugugaggcccugacccucgcuaccggccccauuucuacacugugggaagggaauccuggacgcuuuuggaacacgaccaucgccguguccauggccaauauuuucagaggcagcuaucuugcuggggccggacugcucuuuucuaucaugaagaacacaaccuccacacggcgcggcaccggcaauaucggggagacgcugggagaaaaauggaaaagcagacugaacgcgcucggcaaaucugaguuccagauuuacaagaaaagcgggauccaggaggucgaccggacacuugccaaggaaggaauuaagcgcggcgagaccgaucaccaugcuguguccagagggucugccaaacugcggugguuuguugaaagaaacauggugacccccgagggaaaggucguggaccugggcugcggccgcgggggauggagcuauuacuguggcgggcucaaaaauguucgggaagugaagggacugacaaaaggcgggccgggacacgaggagccuauccccauguccaccuauggcuggaaccuugucagacugcaaagcggcguggauguguucuucacacccccugaaaagugcgacacgcuccugugugauauuggggaguccucucccaauccuaccaucgaagcuggacgcacacugcggguucucaaccuugucgagaauuggcugaacaauaacacccaguuuugcaucaaggugcugaauccguacaugcccagcgugauugagaagauggaggcccuccagagacaguacggcggggcgcugguccgcaacccucuuuccagaaauucuacacaugagauguauuggguuagcaacgccaccggaaauaucguguccucugugaacaugauuagcagaaugcugaucaaucgcuucacgaugaagcacaaaaaggcuaccuacgaacccgacgucgaucucggcuccgggacacggaacauuggaaucgagagcgaaauuccuaaccuggacaucaucggcaaaagaauugagaagaucaagcaagaacacgagauuucuuggcauuaugaccaggaucaccccuacaaaaccugggccuaucauggcuccuacgagacaaagcagaccgggagcgcuucuuccauggugaauggaguugugcgccugcucacaaaaccgugggacgucgugccuaugguuacccagauggccaugacggauacaacccccuuuggccaacagcggguguucaaggaaaaagucgacaccagaacacaggagccuaaggaagggacgaagaaacuuaugaagaucaccgcugaguggcuguggaaagagcugggaaagaaaaagacaccccgcauguguaccagagaagaguuuaccaagaaggugcggagcaacgccgcgcucggcgccauuuucaccgaugaaaauaaguggaaaucugcucgcgaggccguggaagacgggagauuuugggagcuggucgaucgggagagaaaccuucaccuggaaggaaagugcgagacauguguuuauaauaugaugggcaaacgggaaaagaaacucggcgaguucgggaaggcuaagggaucccgcgccaucugguacauguggcugggcgccagauuucuggaguucgaggcgcucggguuucugaacgaggaccacugguucagccggggaaauucccuuagcggcguggaaggggagggccugcaucgccucggauacauccugagagaugugggcaaaaaggaagggggagcuauguaugccgacgauaccgccggcugggacacgcggauuacccuugaggaccugaaaaacgaagagauggucacaaaucacaugaagggggagcauaaaaagcucgcugaagccaucuuuaagcugaccuaccagaacaaagugguucgcgugcaaagaccuacaccccggggaaccgucauggauauuaucucucgcagagaccagcggggcagcggacaggugggcacguauggacugaauacauucaccaacauggaggcucaacucauucgccagauggaaggcgaggggaucuucaaguccauccagcaccugacagccaccgaggaaauugcgguucagaauuggcuugccagagugggacgggagcgccugucuagaauggcuaucagcggcgaugacugcgucgugaaaccgauugaugaccgguuugccuccgcucucacggcccugaacgauauggggaagguuagaaaagacauccaacagugggaaccuucucgcggauggaaugauuggacccaggugcccuucugcagccaucacuuucacgagcuugucaugaaggacggccgggugcuggucgugcccuguagaaaccaggaugaacucauugggcgcgcgcggaucucccaaggcgccggauggucucugaaggagacagcuugccugggcaaaagcuacgcccagauguggacccucauguauuuccauagacgcgaccugcggcuugcugccaacgcuauuuguuccgccguuccuagccacugggugccgacaucuagaaccacaugguccauccaugcgaagcacgaguggaugaccacggaagauaugcuggccgucuggaaucgcguguggauccaggagaaccccuggauggaagacaaaacaccuguggagagcugggaagagguucccuaccucgggaagcgggaggaccaguggugcggaucucugauuggccuuaccuccagagcuaccugggccaaaaauauccaaacagccauuaaccaggugcgcagccugaucgggaaugaagaguauaccgauuacaugccuuccaugaagcgguuuagacgggaagaggaagaggcuggaguccucugguga

SEQ ID NO: 19741 - RNA, 9876 nt, Artificial Sequence
  derived and/or modified CDS sequence (opt5) from DENV-2__EU569695__SS-prME
accgccggcgugaucgucaugcugauucccaccgcuauggccuuccaccucacgacccggaauggggaaccucauaugaucguuggacggcaggaaaagggcaagagccugcuuuuuaagaccgaagacggggugaauaugugcacccugauggcgauugaucucggagaacugugugaggacacgaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggaucccuuuccccaguccaacgcuccuaucauggacgaagaaagagaaauccccgagagaagcuggaacucuggccacgaaugggugacagauuucaaggggaaaaccgucugguuugugccuuccauuaaggccggaaacgacaucgccgcuugccugcggaaaaauggcaagaaaguuauucagcuuagcagaaagaccuucgauucugaguacgugaagacacgcgccaacgacugggauuuugucgugaccacagacaucagcgagaugggggcgaauuucaaagcugaacgggugauugauccgagacgcuguaugaagcccgucauccugaccgacggagaggaacggguuauccuggccggcccuaugcccgugacgcauuccucugccgcucaaagacgcgggcggauuggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccccgguggcuggacgccagaaucuauuccgauccucuggcgcucaaggaguucaaggaguucgccgcugggcgcaaaucucugacccuuaaucugauuacggaaaugggccggcuccccaccuuuaugacacagaaggccagaaacgcucuggacaaucuggccguccuccauaccgccgaggcuggaggccgcgcguacaaccacgcccuuagcgagcugccggaaacacuggagacccuccugcuucugacacuccuggcuaccgugacagggggaaucuuccuguuucucauguccggcaaagggauuggaaagaugacacuuggcaugugcugcaucaucaccgccagcauucugcugugguaugcccaaauccagccucacuggauugcugccucuaucauucucgaguucuuucugaucguucuucugauccccgagcccgaaaaacagcggaccccucaggauaaucaacucacauacguggucauugcgauccugaccguggucgccgcuacaauggccaacgagaugggcuuccuggagaagacgaagaaagaccucgggcuuggauccauuaccacacaggaaagcgaguccaauauccuggacauugaucugagaccggcuucugccuggacccucuaugcgguggccacaaccuuuguuacgcccaugcugcggcauagcaucgaaaacuccucugugaaugugagccuuaccgcugucgccaaccaggcuacaguucugaugggccucgggaagggauggccucuguccaaaauggacauuggcgugccccugcucgccaucggguguuacagccaggugaauccuaucacccuuacagcugcccugcugcuccuggucgcgcacuacgccauuaucggacccggccuucaagcuaaggccacccgcgaggcucagaaaagagccgccgcgggcauuaugaagaacccuacgguggaugggaucacaguuauugaccuggaaccgauccccuaugauccuaaguucgagaaacagcucggacaggugaugcugcugauccucugcgucacccaagugcuuaugaugcggacaaccugggcucugugugaggcccugacccucgcuacaggccccauuucuacgcugugggaagggaauccuggacgcuuuuggaacaccacaaucgccgucuccauggccaauauuuucagaggcagcuaccuugcuggggccggacugcucuuuucuaucaugaagaacaccacauccacccggcgcggcacgggcaauauuggggagacacugggagaaaaauggaaaagcagacugaacgcgcucggcaaaucugaguuccagaucuauaagaaaagcgggauccaggagguggaccggacccuugccaaggaaggaauuaagcgcggcgagaccgaucaucacgcuguuuccagagggucugccaaacugcggugguuuguggaaagaaacauggucacacccgagggaaaggugguugaccugggcugcggccgcgggggauggagcuacuauuguggcgggcucaaaaaugugcgggaagucaagggacugaccaaaggcgggccgggacaugaggagccuauccccauguccacauacggcuggaaccuugugagacugcaaagcggcguggauguuuucuucacgcccccugaaaagugcgacacccuccugugugauauuggggaguccucucccaauccuacaaucgaagcuggacgcacccugcggguccucaaccuuguggagaauuggcugaacaauaacacacaguuuugcauuaaggugcugaauccguauaugcccagcgucaucgagaagauggaggcccuccagagacaguacggcggggcgcugguucgcaacccucuuuccagaaauucuacccacgagauguacugggugagcaacgccacgggaaauaucguguccucugucaacaugauuagcagaaugcugaucaaucgcuucaccaugaagcacaaaaaggcuacauaugaacccgacguggaucucggcuccgggacccggaacauuggaaucgagagcgaaauuccuaaccuggacaucauuggcaaaagaaucgagaagaucaagcaagaacaugagauuucuuggcacuacgaccaggaucaucccuauaaaacaugggccuaccacggcuccuaugagaccaagcagacagggagcgcuucuuccaugguuaauggagugguccgccugcucaccaaaccgugggacgugguuccuauggugacgcagauggccaugacagauaccacccccuuuggccaacagcgggucuucaaggaaaaaguggacacaagaacgcaggagccuaaggaagggaccaagaaacuuaugaagaucacagcugaguggcuguggaaagagcugggaaagaaaaagacaccccgcauguguacaagagaagaguuuaccaaaaaggugcggagcaacgccgcgcucggcgccauuuucacagaugaaaauaaguggaaaucugcucgcgaggccgucgaagacgggagauuuugggagcugguugaucgggagagaaaccuucaccuggaaggaaagugcgagaccuguguguacaauaugaugggcaaacgggaaaagaaacucggcgaguucgggaaggcuaagggaucccgcgccaucugguauauguggcugggcgccagauuucuggaguucgaggcgcucggguuucugaacgaggaccauugguucagccggggaaauucccuuagcggcguggaaggggagggccugcaccgccucggauacauucugagagaugucggcaaaaaggaagggggagcuauguacgccgacgauacggccggcugggacacccggaucacacuugaggaccugaaaaacgaagagauggugaccaaucauaugaagggggagcacaaaaagcucgcugaagccaucuuuaagcugacauaucagaacaaaguugugcgcguccaaagaccuacaccccggggaacggugauggauauuaucucucgcagagaccagcggggcagcgggcagguuggcacauacggacugaauaccuucacaaacauggaggcucaacucauucgccagauggaaggcgaggggaucuucaaguccauucagcaucugaccgccacggaggaaaucgcggugcagaauuggcuugccagagucggacgggagcgccugucuagaauggcuaucagcggcgaugacugcgugguuaaaccgauugaugaccgguuugccuccgcucucaccgcccugaacgauauggggaaggugagaaaagacauccaacagugggaaccuucucgcggauggaaugauuggacacagguccccuucugcagccaccacuuucaugagcuugugaugaaggacggccggguccuggugguucccuguagaaaccaggaugaacucauugggcgcgcgcggaucucccaaggcgccggauggucucugaaggagaccgcuugccugggcaaaagcuaugcccagauguggacacucauguacuuccacagacgcgaccugcggcuugcugccaacgcuauuuguuccgccgugccuagccauugggucccgaccucuagaacaaccugguccauccacgcgaagcacgaguggaugacgacagaagauaugcuggccguguggaaucgcguguggauucaggagaaccccuggauggaagacaaaaccccuguugagagcugggaagaggugcccuaucucgggaagcgggaggaccaguggugcggaucucugaucggccuuaccuccagagcuacaugggccaaaaauauccaaaccgccauuaaccagguccgcagccugaucgggaaugaagaguacacagauuauaugccuuccaugaagcgguuuagacgggaagaggaagaggcuggagugcucugguga

SEQ ID NO: 19742 - RNA, 9876 nt, Artificial Sequence
  derived and/or modified CDS sequence (opt5) from DENV-2__EU482623__SS-prME
acagccggagugaucgucaugcugauucccacagcuauggccuuccaccucacgacccggaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacaggagucuaauuggauccagaaggaaacccuggucacguucaagaacccucaugcuaaaaagcaagacgugguugugcucggaucccaggagggcgccaugcacacagcccugaccggggcuacagaaauucagaugagcuccggcaaucuucuguuuaccggacaucucaaaugcagacugcggauggauaaacuucaacugaaaggcaugucuuacagcauguguaccgggaaguucaagaucgucaaagagauugcggagacacagcacggaacgaucgugaucagaguccaguaugaaggcgacgggucccccugcaagauucccuucgagaucaccgaucucgaaaaacgccaugugcugggacggcugauuacaguuaacccuaucgugaccgagaaggacagcccggucaacauugaagccgagcccccuuuuggcgauucuuacaucauuaucgggguggagcccggccagcucaaacugaauugguucaagaagggauccagcaucggccaaauguuugaaacaaccaugagaggggcuaaacgcauggccauucuuggagacacggccugggauuucggcucucucgggggaguuuuuacaagcaucggcaaggcucuccaccagguguucggggccauuuacggcgcggcuuuuuccggagucucuuggaccaugaaaauccugauuggcgugaucaucaccuggauugggaugaacagccgguccacaagccugucugugucccuuguucucgucggaguggugacccuguaucugggcgccgucgugcaggccgacagcggguguguugugucuuggaagaauaaagagcucaagugcggauccggcaucuucauuacagauaacguccacacguggaccgaacaguacaaguuucaaccugagagccccuccaaacuggcuucugccauccagaaggcucaugaagaggggauuuguggcaucagaagcgugacacgccuugagaaucugauguggaaacagaucaccccggaacucaaccacauucuguccgagaaugaaguuaagcugacaaucaugaccggagacauuaaaggcaucaugcaggccgggaagcggucucuuagaccucaacccacggagcucaaauauagcuggaagaccuggggaaaggcgaaaaugcuguccacagaaagccauaaccagaccuuccugauugauggcccugagacagccgagugccccaauaccaaccgcgcuuggaacucucucgaaguggaggacuacggguuuggagucuucacaaccaacaucuggcugaaacuucgggaaaaacaggacguguuuugugauuccaagcugaugagcgccgcuaucaaagacaauagagccguucacgcggauaugggcuauuggauugagucugcccucaacgacacguggaagauggagaaggcuuccuucaucgaagugaaaagcugccacuggccuaagucucauacacuguggagcaauggcguccuggaguccgaaaugauuauccccaaaaacuucgccgggccggugagccagcacaacuaccgcccuggauaucauacccaaaccgcuggccccuggcaccuugggaagcucgagauggauuuugacuucugugaaggaacaaccguggucguuacggaggauugcggcaaucgggggcccucucugagaacaaccacagccuccggaaaacugauuaccgaguggugcugucggagcugcacacucccuccgcugcgcuacagaggcgaagacggcuguugguacgggauggagauccggccccuuaaggaaaaggaggaaaaccuggugaauagccucgugaccgccggacauggccagauugauaacuuuucucuggggguccugggaauggcgcuucugcuggaggagaugcugagaacgcgcaucggcaccaaacacgcuauccuccugguggccguuagcuucgugacacuuauuaccgggaauauguccuuucgggaccugggaagagucauggugaugguuggcgcuacaaugaccgaugacaucggcaugggggugacguaucucgcccugcuggccgcuuucaagguccgcccuacauuugccgcgggacuucugcucagaaaacugaccucuaaggaacucaugauggcuacaauuggcaucgcccugcuuagccaguccaccauucccgagaccauccuggaacucacagaugcccuggcucuggggaugauggugcuuaaaaucguucggaacauggagaaguaccaacuggccgugacgauuauggcgaucucuugcgucccuaaugcugugauucuccagaacgccuggaaggugagcuguaccauccuggccgcugucuccguuagcccccuccugcuuacaucuucccagcagaaagccgacuggauuccucuggcucucaccaucaagggacugaaucccacagccaucuuccugaccacgcuuagccgcacaucuaaaaagagauccuggccgcugaacgaagcgauuauggccgugggcauggugagcauccucgcuucuucccugcucaaaaaugacauuccuaugaccgggccccuggucgccggaggccuucugaccgugugcuauguucugacaggccggagcgcugaucucgagcuggagcgcgccgccgacgugaagugggaagaucaagcugagaucuccgggagcucuccuauucuuagcaucaccauuuccgaagacggaucuaugagcaucaaaaacgaggaggaagaacagacacugacgauccucauuagaaccggccugcucgucaucuccgggguguuucccguuucuauuccgaucacagcggccgcuugguaccugugggaagugaagaagcagcgggccggaguccuuugggaugugccuucucccccucccgucgagaaagccgaacuggaggacggcgcuuaucgcauuaagcagagagggauccugggauacucccaaaucggcgccggcguguauaaagaggggaccuuccacacaauguggcauguuacccggggagcggugcucaugcaccgcggcaagagaauugaacccuccugggcugaugucaaaaaggaccugaucagcuacgggggaggcuggaaacuugagggggaauggaaagagggagaagaggugcagguucuggcccucgagccuggcaagaauccgcgggccgugcagacgaaacccggcauuuuuaagaccaacuccgggacaaucggagcugucagccuggauuucucuccuggcaccuccgggagccccauuguggacagaaaaggaaaggugguuggccucuacgggaauggagucgugacacgcucuggcgccuauguguccgcgaucgcucagaccgaaaagagcaucgaggauaacccugaaauugaggacgauaucuuucggaaaaagagacugacaauuauggaccuucaucccggcgccgggaaaacgaagcgcuaccugccugccaucguccgggaagcuauuaaaagaggacugcgcacccucauccuggccccgacacgggugguugcugccgagauggaggaagcgcuuagaggccugcccauucgcuaucaaaccccugccaucaagaccgagcacacagggcgggaaaucguggaccucaugugucaugcuacguucaccaugagacugcucucccccguccgggugccuaacuacaaucugauuaucauggaugaggcccacuucacagaccccgcuucuauugccgcccgcggauauaucagcaccagaguugagaugggcgaagcugcggggauuuuuaugacagccaccccgccuggcucccgggaucccuucccccagagcaacgcuccuaucauggacgaggaacgcgagauccccgaaagaucuuggaacuccggacacgagugggugacggauuuuaagggcaaaacagucugguucgugccuagcauuaaggccgggaacgacaucgccgcuugccuucggaaaaauggaaagaaaguuauucagcugucuagaaagaccuuugauagcgaguacgugaagacccgcgccaucgacugggauuucgucgugacaaccgacauuuccgaaaugggcgcgaacuuuaaagcugagcgggugaucgauccgagacgcuguaugaagcccgucauccugacagacggggaggaacggguuauucucgccggaccuaugcccgugacccauucuagcgccgcucaaagacgcggccggaucgggagaaauccuaaaaacgaaaaugaccaguauauuuacaugggcgagccccuggagaacgaugaagacugcgcccacuggaaggaggcgaaaaugcuucuggauaauaucaacacgccggaaggaauuaucccuuccauguucgagcccgaacgcgagaagguggacgccauugauggcgaguacagacucagaggggaagcucgcaaaacauuugucgaccugaugagacggggagaucugccuguguggcucgccuauaagguugcugccgagggcaucaauuacgcugaccgcaagugguguuucgaugggaucaaaaacaaucagauucuugaagagaacauggagguggaaaucuggaccaaggagggagaacgcaagaagcugaaaccccgguggcuggacgccagaauuuauucugauccucucgcgcugaaggaguuuaaggaguucgccgcuggccgcaaaagccuuacacugaaccucaucaccgagauggggcggcugcccacguucaugacccagaaggccagaaaugcucuggacaaccucgccguccuucauacagccgaggcuggcggacgcgcguacaaucacgcccuguccgaacugccggagacccucgaaacacugcuucugcucacccugcuggcuacagugaccggcgggauuuuucucuuccuuaugagcggaaaaggcaucgggaagaugacgcugggaaugugcugcaucauuacagccucuauccugcucugguaugcccaaauucagccucacuggaucgcugccuccauuauccuggaguuuuuccuuaucguucugcucauucccgaacccgagaaacagcggaccccucaggauaaccaacugaccuacguggucaucgcgauucugacaguggucgccgcuaccauggccaaugagaugggcuuucucgaaaagacaaagaaagaccuuggccuggggagcaucacgacccaggaguccgaaucuaacauucuggacaucgaucucagaccggcuagcgccuggacacuguaugcgguggccaccacauucguuacccccaugcuucggcauuccauugaaaauucuagcgugaacgugucccugacggcuaucgccaaucaggcuaccguccucaugggacugggcaagggguggccucugagcaaaauggacaucggaguuccccuccuugccauuggcuguuacucucaggugaacccuaucacacugaccgcugcccugcuccugcuuguggcgcacuacgccauuaucgggcccggacugcaagcuaaggccacacgcgaagcucagaaaagagccgccgcgggcauuaugaagaauccuaccgucgauggcaucacggugaucgaccucgagccgauucccuaugauccuaaguuugagaaacagcuggggcagguuaugcugcucauccuuugcgugacacaaguccugaugaugcggaccacaugggcucugugugaagcccucacccuggcuaccggacccauuuccacacuuugggagggcaacccugggcgcuucuggaauacgaccaucgccgugagcauggccaacauuuuuagaggaucuuaccuggcuggcgccgggcuccuguucuccaucaugaagaauacaaccagcacacggcgcggaaccggcaacaucggcgaaacgcugggggagaaauggaagucuagacucaaugcgcuuggaaaaagcgaguuucagauuuauaagaaauccggcauccaggaagucgaccggacacuggccaaggaggggauuaagcgcggagaaaccgaucaucacgcugugucuagaggcagcgccaaacugcggugguucguugagagaaacauggugacccccgaagggaaggucguggaccucggaugcggccgcggcgggugguccuacuauuguggaggccugaaaaacguucgggaggugaaggggcuuacaaaaggaggcccggggcaugaggaaccuauccccaugagcaccuacggauggaaucuggucagacuccaauccggcguggauguguuuuucacacccccugagaagugcgacacgcugcugugugauauuggcgaaucuagccccaacccuaccaucgaggcugggcgcacacuccggguucuuaaucuggucgaaaacuggcugaauaacaauacccaguucugcaucaaggugcucaacccguauaugcccuccgugauugagaaaauggaggcccugcagagacaguacggaggcgcgcuuguccgcaauccucugucucggaacagcacacacgaaauguacuggguuuccaaugccaccgggaacaucgugucuagcgugaauaugauuuccagaaugcucaucaaccgcuuuacgaugaagcacaaaaaggcuaccuaugagcccgacgucgaucugggaagcggcacacggaauauugggaucgaaucugagauuccuaaccuggacaucaucggaaaaagaauugaaaagaucaagcaagagcaugagauuuccuggcacuacgaccaggaucaucccuauaaaaccugggccuaccacggcagcuaugaaacaaagcagaccggcucugcuuccagcauggugaacgggguugugcgccuccuuacaaaaccgugggacgucgugccuaugguuacccagauggccaugacggauacaacccccuucggacaacagcggguguuuaaggagaaagucgacaccagaacacaggaaccuaaggagggcacgaagaaacugaugaagaucaccgcugaguggcuguggaaagaacucgggaagaaaaagacaccccgcauguguaccagagaggaguucaccaagaaggugcggucuaaugccgcgcugggagccauuuuuaccgaugagaacaaguggaaauccgcucgcgaagccguggaggacggcagauucugggagcuugucgaucgggaaagaaaucugcaccucgaggggaagugcgaaacauguguuuacaacaugaugggaaaacgggagaagaaacugggcgaauuuggcaaggcuaaggggagccgcgccaucugguauauguggcugggagccagauuccucgaguuugaggcgcugggcuuccuuaaugaagaccauugguuuucccgggggaacagccugucuggaguggagggcgaagggcuccaccgccugggcuacauccuuagagaugugggcaagaaggagggcggggcuauguacgccgacgauaccgccggaugggacacgcggauuacccuggaagaccucaaaaaugaggagauggucacaaaccauaugaagggcgaacacaaaaagcuggcugaggccaucuucaagcugaccuaucagaauaaagugguucgcgugcaaagaccuacaccccgggggaccgucauggauauuaucagccgcagagaccagcggggauccggccagguggggacguacggccucaacacauuuaccaauauggaagcucaacugauucgccagauggagggagagggcaucuucaagucuauccagcaucuuacagccaccgaagagauugcgguucagaacuggcuggccagaguggggcgggaacgccucagcagaauggcuaucuccggagaugacugcgucgugaaaccgauugaugaccgguucgccucugcucugacggcccuuaaugauaugggcaagguuagaaaagacauccaacagugggagccuagccgcggguggaacgauuggacccaggugcccuuuugcucccaccacuuccaugaacuggucaugaaggacggacgggugcucgucgugcccuguagaaaucaggaugagcugauuggccgcgcgcggaucucucaaggggccggcuggagccugaaggagacagcuugccucggaaaauccuaugcccagauguggacccugauguacuuucacagacgcgaccuucggcuggcugccaacgcuauuuguagcgccguuccuucucauugggugccgacauccagaaccacauggagcauccacgcgaagcacgaauggaugaccacggaggauaugcucgccgucuggaaccgcguguggauccaggaaaaucccuggauggaggacaaaacaccuguggaaucuugggaggagguucccuaucugggcaagcgggaagaccaguggugcgggucccuuauuggacugaccagcagagcuaccugggccaaaaacauccaaacagccauuaaucaggugcgcucccucaucggcaacgaggaauacaccgauuauaugccuucuaugaagcgguucagacgggaggaagaggaggcugggguccugugguga

SEQ ID NO: 19743 - RNA, 9876 nt, Artificial Sequence
  derived and/or modified CDS sequence (opt5) from DENV-2__EU569698__SS-prME
accgccggcgugaucgucaugcugauucccaccgcuauggccuuccaccucacgaccagaaauggggaaccucauaugaucguuggacggcaggaaaagggcaagagccugcuuuuuaagacggaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggauuccuuuccccagagcaacgcucccaucauggacgaagaaagagaaaucccugagagaucuuggaacuccggccacgaaugggugacagauuucaaggggaaaaccgucugguuugugcccagcauuaaggccggaaacgacaucgccgcuugccugcggaaaaauggcaagaaaguuauucagcuuucuagaaagaccuucgauagcgaguacgugaagacacgcgccaacgacugggauuuugucgugaccacagacaucuccgagaugggggcgaauuucaaagcugaacgggugauugauccuagacgcuguaugaagccggucauccugaccgacggagaggaacggguuauccuggccggccccaugccugugacgcauucuagcgccgcucaaagacgcgggcggauuggcagaaaccccaaaaaugagaacgaccaguauaucuacaugggagaaccucucgagaaugaugaggacugcgcccacuggaaggaagcgaaaaugcugcuugauaacauuaauacacccgagggcaucauuccguccauguuugaaccugagcgcgaaaagguggacgccaucgauggggaguacagacugcggggagaggcucgcaaaaccuucgucgaccucaugagacggggcgaucugcccguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccucgguggcuggacgccagaaucuauucugauccccuggcgcucaaggaguucaaggaguucgccgcugggcgcaaaagccugacccuuaaucugauuacggaaaugggccggcucccuaccuuuaugacacagaaggccagaaacgcucuggacaaucuggccguccuccauaccgccgaggcuggaggccgcgcguacaaccacgcccuuuccgagcugcccgaaacacuggagacccuccugcuucugacacuccuggcuaccgugacagggggaaucuuccuguuucucaugagcggcaaagggauuggaaagaugacacuuggcaugugcugcaucaucaccgccucuauucugcugugguaugcccaaauccagccgcacuggauugcugccuccaucauucucgaguucuuucugaucguucuucugaucccugagcccgaaaaacagcggacaccccaggauaaucaacucacauacguggucauugcgauccugaccguggucgccgcuacaauggccaacgagaugggcuuccuggagaagacgaagaaagaccucgggcuuggaagcauuaccacacaggaauccgagucuaauauccuggacauugaucugagaccugcuagcgccuggacccucuaugcgguggccacaaccuuuguuacgccgaugcugcggcauuccaucgaaaacucuagcgugaaugugucccuuaccgcuauugccaaccaggcuacaguccugaugggccucgggaagggauggccccugagcaaaauggacaucggcguuccucugcucgccaucggguguuacucucaggugaaucccauuacccuuacagcugcccugcugcuccugguggcgcacuacgccaucauuggaccuggccuucaagcuaaggccacccgcgaggcucagaaaagagccgccgcgggcaucaugaagaaccccacggucgaugggauuacagugaucgaccuggaaccuaucccguaugaucccaaguucgagaaacagcucggacagguuaugcugcugauucucugcgugacccaaguccuuaugaugcggacaaccugggcucugugugaggcccugacccucgcuacaggcccuaucuccacgcugugggaagggaaucccggacgcuuuuggaacaccacaauugccgugagcauggccaauaucuucagaggcucuuaccuugcuggggccggacugcucuuuuccauuaugaagaacaccacaagcacccggcgcggcacgggcaauaucggggagacacugggagaaaaauggaagucuagacugaacgcgcucggcaaaagcgaguuccagaucuauaagaaauccgggauucaggaggucgaccggacccuugccaaggaaggaaucaagcgcggcgagaccgaucaucacgcugugucuagagggagcgccaaacugcggugguuuguugaaagaaacauggugacaccugagggaaaggucguggaccugggcugcggccgcgggggaugguccuacuauuguggcgggcucaaaaauguucgggaagugaagggacugaccaaaggcgggcccggacaugaggagccgauuccuaugagcacauacggcuggaaccuugucagacugcaauccggcguggauguguucuucacgccucccgaaaagugcgacacccuccugugugauaucggggagucuagccccaaucccacaauugaagcuggacgcacccugcggguucucaaccuugucgagaauuggcugaacaauaacacacaguuuugcaucaaggugcugaauccuuauaugccguccgugaucgagaagauggaggcccuccagagacaguacggcggggcgcugguccgcaacccccuuucucggaauagcacccacgagauguacuggguuuccaacgccacgggaaauauugugucuagcgugaacaugaucuccagaaugcugauuaaucgcuucaccaugaagcacaaaaaggcuacauaugaaccugacgucgaucucggcagcgggacccggaacaucggaauugagucugaaauccccaaccuggacauuaucggcaaaagaaucgagaagauuaagcaagaacaugagaucuccuggcacuacgaccaggaucauccuuauaaaacaugggccuaccacggcagcuaugagaccaagcagacagggucugcuuccagcauggugaauggaguugugcgccugcucaccaaacccugggacgucgugccgaugguuacgcagauggccaugacagauaccaccccuuuuggccaacagcggguguucaaggaaaaagucgacacaagaacgcaggagcccaaggaagggaccaagaaacuuaugaagauuacagcugaguggcuguggaaagagcugggaaagaaaaagaccccucgcauguguacaagagaagaguuuaccaaaaaggugcggucuaacgccgcgcucggcgccaucuucacagaugaaaauaaguggaaauccgcucgcgaggccguggaagacgggagauuuugggagcuggucgaucgggagagaaaccuucaccuggaaggaaagugcgagaccuguguuuacaauaugaugggcaaacgggaaaagaaacucggcgaguucgggaaggcuaagggaagccgcgccauuugguauauguggcugggcgccagauuucuggaguucgaggcgcucggguuucugaacgaggaccauugguucucccggggaaauagccuuucuggcguggaaggggagggccugcaccgccucggauacauccugagagaugugggcaaaaaggaagggggagcuauguacgccgacgauacggccggcugggacacccggaucacacuugaggaccugaaaaacgaagagauggucaccaaucauaugaagggggagcacaaaaagcucgcugaagccauuuuuaagcugacauaucagaacaaagugguucgcgugcaaagacccaccccucggggaacggucauggauaucauuagccgcagagaccagcggggcuccggacaggugggcacauacggacugaauaccuucacaaacauggaggcucaacucauccgccagauggaaggcgaggggauuuucaagucuauccagcaucugaccgccacggaggaaaucgcgguucagaauuggcuugccagagugggacgggagcgccugagcagaauggcuauuuccggcgaugacugcgucgugaaacccaucgaugaccgguuugccucugcucucaccgcccugaacgauauggggaagguuagaaaagacauucaacagugggaaccgagccgcggauggaaugauuggacacaggugccuuucugcucccaccacuuucaugagcuugucaugaaggacggccgggugcuggucgugcccuguagaaaccaggaugaacucaucgggcgcgcgcggauuucucaaggcgccggauggagccugaaggagaccgcuugccugggcaaauccuaugcccagauguggacacucauguacuuccacagacgcgaccugcggcuugcugccaacgcuaucuguagcgccguucccucucauugggugccuaccuccagaacaaccuggagcauucacgcgaagcacgaguggaugacgacagaagauaugcuggccgucuggaaucgcguguggauccaggagaacccguggauggaagacaaaacccccguggagucuugggaagagguuccuuaucucgggaagcgggaggaccaguggugcggaucccugaucggccuuaccagcagagcuacaugggccaaaaauauucaaaccgccaucaaccaggugcgcucccugauugggaaugaagaguacacagauuauaugcccucuaugaagcgguuuagacgggaagaggaagaggcuggaguccucugguga

SEQ ID NO: 19744 - RNA, 9876 nt, Artificial Sequence
  derived and/or modified CDS sequence (opt5) from DENV-2__EU569699__SS-prME
accgccggagugaucgucaugcugauucccacagcuauggccuuccaccucacgaccagaaauggggagccucauaugaucguuggacggcaggaaaagggaaaaagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauagcacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccaaauuuacgugcaagaaaaauauggaagggaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugcagacugcggauggauaaacuucaacugaaggggaugucuuacagcauguguaccggaaaguucaaaaucgucaaggaaauugcggagacacagcacggcacgaucgugaucagaguccaguaugagggggacggaucccccugcaaaauucccuucgaaaucaccgaucucgagaagcgccaugugcugggccggcugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugagaggagcuaagcgcauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgguccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaaucagaagcgucacacgccuugagaaucugauguggaagcagaucaccccggagcucaaccacauucuguccgaaaaugaggugaaacugacaaucaugaccggcgacauucgggggaucaugcaggccggaaagagaucucuucgcccucaacccacggaacucaaauauagcuggaagaccuggggcaaggcgaaaaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagacaaacaggaugucuuuugugacuccaagcugaugagcgccgcuaucaaagauaaucgcgccgugcacgcggacaugggcuauuggauugagucugcccucaacgauacguggaagauggaaaaggcuuccuucaucgagguuaaaagcugccacuggccuaagucucauacacuguggagcaauggggugcuggaguccgaaaugauuauccccaaaaacuucgccggaccggucagccagcacaacuaccggccuggcuaucauacccaaaccgcugggcccuggcaccuuggaaagcucgagauggacuuugaucugugugaaggcacaaccgugguggucacggaggacugcgggaauagaggacccucucugcggacaaccacagccuccggcaaacucauuaccgaauggugcugucgcagcugcacacugccuccgcuuagauaccggggcgaggauggguguugguacggaauggagaucagaccccugaaggaaaaggaggaaaaccucguuaauucccuggugaccgccggccaugggcagauugacaacuucucucugggagugcuuggcauggcucuccugcuggaggaaaugcuccgcacgcggaucgggaccaaacacgcgauccugcuugucgccgugagcuuuguuacacugauuaccggaaauauguccuucagagaucucggccgcgugauggucauggugggcgcuacaaugaccgacgauaucgggaugggaguuacguaucuggcccugcuugccgcuuuuaaggugagaccuacauucgccgcgggccugcuccugcggaaacucaccucuaaggagcugaugauggcuacaauugggaucgcccuucugagccaguccaccauucccgagaccauccucgaacugacagacgcccuggcucuuggaaugaugguccugaaaaucgugcgcaacauggagaaguaccaacucgccguuacggugauggcgauuucuugcgucccuaaugcugugauccugcagaacgccuggaaggugagcuguaccauucucgccgcugucuccguuagcccccugcuucugacaucuucccagcagaaagccgacuggaucccucucgcucugaccauuaagggccugaaucccacagccaucuuucuuaccacgcugagcagaacaucuaaaaagcgguccuggccgcucaacgaagcgaucauggccguggggauggugagcauucuggcuucuucccuccugaaaaaugauaucccuaugaccggaccccuugucgccggcggccugcugaccgugugcuauguucucacagggcgcagcgcugaccuggagcuugaaagagccgccgaugugaagugggaggaccaagcugagauuuccggaagcucuccuauccugagcauuaccaucuccgaagauggcucuaugagcauuaaaaacgaggaagaggagcagacacucacgauccugauccggaccgggcuccuggucauuuccggaguguuccccguuucuaucccgauuacagcggccgcuugguaccuuugggaagugaagaagcagcgcgccggcguccugugggacgugccuucucccccucccgucgagaaagccgaacuggaggauggggcuuauagaaucaagcagcggggcauucucggcuacucccaaaucggcgccgggguguauaaagaaggaaccuuucacacaauguggcauguuacccgcggcgcggugcugaugcacagagggaagcggaucgagcccuccugggcugacgucaaaaaggaucuuauuagcuacggaggcggguggaagcuggagggagaauggaaagagggcgaagaggugcagguucucgcccuggaaccuggcaagaauccgagagccgugcagacgaaacccgggaucuucaagaccaacacaggaaccauuggcgcugucucccucgacuuuagcccugggacaucuggaucccccaucguggaucgcaaaggcaaggugguugggcuguacggaaauggcgucgugacccggagcggcgccuaugugucugcgauugcucagacagagaaguccaucgaggacaacccugaaaucgaggaugacauuuuccgcaagaagcgccuuacgaucauggaccugcaucccggggccggaaaaaccaagcgguaccugccugccauugucagagaagcuaucaaacgcggccuccggacacugauucuugccccgaccagagugguugcugccgagauggaagaggcgcugcgcgggcuccccauccgguaucaaaccacagccauuaagacggagcacaccggaagagaaaucguggaucugaugugucaugcuacauuuaccaugcggcuccugagcccuguccgcgugcccaacuacaaucuuaucauuauggacgaggcccacuucacagauccugcuuccaucgccgccagaggcuauauuucuacccggguugaaaugggggaggcugcgggcaucuucaugacggccacacccccgggaagccgcgacccuuuuccccaguccaacgcucccauuauggaugaggaaagagagaucccugaacggagcuggaacucuggccacgagugggugaccgacuucaaggggaaaaccgucugguuugugcccuccaucaaggccggaaacgauauugccgcuugccugcgcaagaauggcaagaaaguuauccagcugagccgcaagacauucgacucugaauacgugaagacccgggccaacgauugggacuuugucgugacaaccgauauuagcgagaugggggcgaauuucaaagcugagagagugaucgacccucgccgguguaugaagccggucauucucacggacggagaagagagaguuauccuggccggccccaugccugugacacauuccucugccgcucaacgccgggggagaaucggccgcaaccccaaaaaugaaaacgaucaguauauuuacaugggagagccucuugaaaaugacgaggauugcgcccacuggaaggaggcgaaaaugcugcucgacaacaucaauacccccgaaggcauuaucccgagcauguuugagccugaaagagagaagguggaugccauugacggggaauaccggcugcgcggagaggcuagaaaaacauucgucgaucugaugcggcgcggcgaccuccccguguggcuugccuauaagguugcugccgaggggaucaacuacgcugauagaaagugguguuuugacggaauuaaaaauaaccagauccuggaagagaacauggaaguggagaucuggaccaaggagggcgaacggaaaaagcugaaaccuagauggcucgaugcccgcauuuauuccgacccccuggcgcuuaaggaguucaaggaauuugccgcugggcggaaaucucugacgcucaaucugaucaccgagaugggcagacugccuacauucaugacccagaaggcccgcaacgcucucgauaaucuugccguccugcauacagccgaagcuggaggccgggcguacaaccacgcccugagcgagcuccccgagacccuggaaacacuucugcuccugacccugcucgcuacggugacagggggaauuuuccuuuuucugauguccggcaaagggaucggaaagaugacccugggcaugugcugcauuaucaccgccagcauccuccugugguaugcccaaauucagccgcacuggaucgcugccucuauuauccuugaguucuuucugauuguucuccugaucccugaacccgagaaacagagaacaccccaggacaaucaacugaccuacguggucaucgcgauucucacaguggucgccgcuacgauggccaacgaaaugggcuuccuugagaagaccaagaaagaccuggggcugggauccaucacaacccaggagagcgaauccaauauucucgauaucgaccugcggccugcuucugccuggacacuuuaugcgguggccaccacguuuguuaccccgaugcugcgccauagcauugagaacuccucugugaaugugagccucacagcuaucgccaaccaggcuaccguccugaugggccuggggaagggauggccccucuccaaaauggauauuggcguuccucuucuggccaucggguguuacagccaggugaaucccaucacacugaccgcugcccuccugcuucugguggcgcacuacgccauuaucggaccuggccuccaagcuaaggccacgagagaagcucagaaacgggccgccgcgggcauuaugaagaaccccacagucgacgggaucaccgugauugaucuggagccuaucccguaugaccccaaguucgaaaaacagcugggacagguuaugcuccuuauccugugcgugacacaaguccugaugaugcgcaccaccugggcucucugugaggcccugacacuugcuacgggcccuauuucuacccugugggaggggaaucccggaagauuuuggaacacaaccaucgccguguccauggccaauauuuuccggggcagcuaccucgcuggggccggacugcuguuuucuaucaugaagaacacaaccaauacgcgcagaggcacaggcaacauuggggaaacccucggagagaaauggaagucccggcuuaacgcgcugggcaaaagcgaguuccagaucuauaagaaaucugggauccaggaggucgaucgcacccuggccaaggagggaauuaagagaggcgaaacagaccaucacgcugugagccggggguccgccaaacucagaugguuuguugagcgcaauauggugaccccugaaggaaaggucguggaucugggcugcggcagagggggauggucuuacuauuguggcgggcuuaaaaacguucgggaggugaagggacugacaaaaggcgggcccggacaugaagaaccgaucccuaugagcacguacggcuggaaucucguccgccugcaauccggcguggacguguucuuuaccccucccgagaagugcgauacacugcucugugacauuggggaaagcucccccaaccccaccaucgaggcuggacggacacuuagaguucugaaucuggucgaaaacuggcucaauaacaauacccaguucugcauuaaggugcugaacccuuauaugccgucugugaucgagaaaauggaagcccuucagcgcaaguacggcggggcgcugguccggaauccccucagcagaaacuccacgcacgagauguacuggguuucuaaugccaccggaaacaucgugagcuccgugaauaugauuucucgcaugcugaucaaccgguucacaaugaaacacaagaaagcuaccuaugagccugaugucgaccugggcagcgggacaagaaacauuggaaucgaauccgagauucccaaucucgacaucauuggcaagcgcaucgaaaagaucaaacaggagcaugaaaccagcuggcacuacgaucaagaccauccuuauaagacaugggccuaccacggcucuuaugagaccaaacagacgggguccgcuagcucuauggugaacggaguugugcggcuucugacaaagcccugggaugucgugccgaugguuacccagauggccaugaccgacacaacgccuuuuggccagcaaagaguguucaaagagaaggucgauacccgcacacaggaacccaaggaggggaccaaaaagcugaugaaaauuacagcugaauggcucuggaaggagcugggcaaaaagaaaaccccuagaauguguacacgggaggaauuuacccgcaaggugagauccaaugccgcgcuuggcgccaucuucacggacgagaacaaguggaaaagcgcucgggaagccguggaggaugggagauuuugggaacuggucgaccgggagcgcaaucuccaccuggagggaaagugcgaaaccuguguuuacaacaugaugggcaaaagagagaagaaacugggcgaguucgggaaggcuaagggaucucgggccauuugguauauguggcucggcgcccgcuuucuggaguucgaagcgcuuggguuucugaaugaggaucauugguucuccagaggaaacagccucuccggcguggagggggaaggccugcaccggcuuggauacauccugcgcgacgugggcaaaaaggaagggggagcuauguacgccgaugacacagccggcugggacaccagaauuacacucgaagaucugaaaaaugaggaaauggucaccaaccauaugaagggggagcacaaaaagcuggcugaggccaucuuuaagcucacguaucagaauaaagugguucgggugcagcgccccacaccuagaggaaccgucauggacaucauuagccggcgcgaucaaagaggcucuggacaggugggcacauacggacugaacaccuucacgaauauggaagcucagcuuauccggcaaauggagggcgaagggauuuuuaagagcauccagcaucugaccgccauugaggagaucgcgguucagaacuggcucgcccgcgugggaagagaacggcuguccagaauggcuaucucuggcgacgauugcgucauuaaacccaucgacgaucgcuucgccagcgcucuuacagcccugaaugacauggggaaggugcggaaagauauucagcaaugggagccguccagaggauggaacgacuggacccagguuccuuucugcucucaccacuuucaugaacucgugaugaaggauggccgcguccuggugguccccugucggaaccaggacgagcugaucgggagagcgcgcauuagccagggcgccggauggucccucaaggaaacagcuugccugggcaaaucuuaugcccaaauguggacccuuauguacuuccaccggagagaucugcgccucgcugccaaugcuaucuguagcgccgugcccucccauuggguuccuacaagccggaccacguggucuauucacgcgaagcacgaguggaugacaaccgaggacaugcuggccguguggaacagagucuggauccaggaaaauccguggauggaggacaaaacccccguggaauccugggaggaagugccuuaucuugggaagcgcgaggaucaguggugcggaagccugaucggccucacaucucgggcuaccugggccaaaaacauucagacagccaucaaucaaguuagaucccugauugggaacgaggaauacacggacuauaugcccagcaugaagcgguuuagacgcgaggaagaggaagcuggagugcugugguga

SEQ ID NO: 19745 - RNA, 9876 nt, Artificial Sequence
  derived and/or modified CDS sequence (opt5) from DENV-2__KF955366__SS-prME
accgccggcgugaucgucaugcugauucccaccgcuauggccuuccaccucacgaccagaaauggggaaccucauaugaucguuggacggcaggaaaagggcaagagccugcuuuuuaagacggaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgagcccgggaucccgggauccuuuuccccagagcaacgcucccaucauggacgaagaaagagaaaucccugagagaucuuggaacuccggccacgaaugggugacagauuucaaggggaaaaccgucugguuugugcccagcauuaaggccggaaacgacaucgccgcuugccugcggaaaaauggcaagaaaguuauucagcuuucuagaaagaccuucgauagcgaguacgugaagacacgcgccaacgacugggauuuugucgugaccacagacaucuccgagaugggggcgaauuucaaagcugaacgggugauugauccuagacgcuguaugaagccggucauccugaccgacggagaggaacggguuauccuggccggccccaugccugugacgcauucuagcgccgcucaaagacgcgggcggauuggcagaaaccccaaaaaugagaacgaccaguauaucuacaugggagaaccucucgagaaugaugaggacugcgcccacuggaaggaagcgaaaaugcugcuugauaacauuaauacacccgagggcaucauuccguccauguuugaaccugagcgcgaaaagguggacgccaucgauggggaguacagacugcggggagaggcucgcaaaaccuucgucgaccucaugagacggggcgaucugcccguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccucgguggcuggacgccagaaucuauucugauccccuggcgcucaaggaguucaaggaguucgccgcugggcgcaaaagccugacccuuaaucugauuacggaaaugggccggcucccuaccuuuaugacacagaaggccagaaacgcucuggacaaucuggccguccuccauaccgccgaggcuggaggccgcgcguacaaccacgcccuuuccgagcugcccgaaacacuggagacccuccugcuucugacacuccuggcuaccgugacagggggaaucuuccuguuucucaugagcggcaaagggauuggaaagaugacacuuggcaugugcugcaucaucaccgccucuauucugcugugguaugcccaaauccagccgcacuggauugcugccuccaucauucucgaguucuuucugaucguucuucugaucccugagcccgaaaaacagcggacaccccaggauaaucaacucacauacguggucauugcgauccugaccguggucgccgcuacaauggccaacgagaugggcuuccuggagaagacgaagaaagaccucgggcuuggaagcauuaccacacaggaauccgagucuaauauccuggacauugaucugagaccugcuagcgccuggacccucuaugcgguggccacaaccuuuguuacgccgaugcugcggcauuccaucgaaaacucuagcgugaaugugucccuuaccgcuauugccaaccaggcuacaguccugaugggccucgggaagggauggccccugagcaaaauggacaucggcguuccucugcucgccaucggguguuacucucaggugaaucccauuacccuuacagcugcccugcugcuccugguggcgcacuacgccaucauuggaccuggccuucaagcuaaggccacccgcgaggcucagaaaagagccgccgcgggcaucaugaagaaccccacggucgaugggauuacagugaucgaccuggaaccuaucccguaugaucccaaguucgagaaacagcucggacagguuaugcugcugauucucugcgugacccaaguccuuaugaugcggacaaccugggcucugugugaggcccugacccucgcuacaggcccuaucuccacgcugugggaagggaaucccggacgcuuuuggaacaccacaauugccgugagcauggccaauaucuucagaggcucuuaccuugcuggggccggacugcucuuuuccauuaugaagaacaccacaagcacccggcgcggcacgggcaauaucggggagacacugggagaaaaauggaagucuagacugaacgcgcucggcaaaagcgaguuccagaucuauaagaaauccgggauucaggaggucgaccggacccuugccaaggaaggaaucaagcgcggcgagaccgaucaucacgcugugucuagagggagcgccaaacugcggugguuuguugaaagaaacauggugacaccugagggaaaggucguggaccugggcugcggccgcgggggaugguccuacuauuguggcgggcucaaaaauguucgggaagugaagggacugaccaaaggcgggcccggacaugaggagccgauuccuaugagcacauacggcuggaaccuugucagacugcaauccggcguggauguguucuucacgccucccgaaaagugcgacacccuccugugugauaucggggagucuagccccaaucccacaauugaagcuggacgcacccugcggguucucaaccuugucgagaauuggcugaacaauaacacacaguuuugcaucaaggugcugaauccuuauaugccguccgugaucgagaagauggaggcccuccagagacaguacggcggggcgcugguccgcaacccccuuucucggaauagcacccacgagauguacuggguuuccaacgccacgggaaauauugugucuagcgugaacaugaucuccagaaugcugauuaaucgcuucaccaugaagcacaaaaaggcuacauaugaaccugacgucgaucucggcagcgggacccggaacaucggaauugagucugaaauccccaaccuggacauuaucggcaaaagaaucgagaagauuaagcaagaacaugagaucuccuggcacuacgaccaggaucauccuuauaaaacaugggccuaccacggcagcuaugagaccaagcagacagggucugcuuccagcauggugaauggaguugugcgccugcucaccaaacccugggacgucgugccgaugguuacgcagauggccaugacagauaccaccccuuuuggccaacagcggguguucaaggaaaaagucgacacaagaacgcaggagcccaaggaagggaccaagaaacuuaugaagauuacagcugaguggcuguggaaagagcugggaaagaaaaagaccccucgcauguguacaagagaagaguuuaccaaaaaggugcggucuaacgccgcgcucggcgccaucuucacagaugaaaauaaguggaaauccgcucgcgaggccguggaagacgggagauuuugggagcuggucgaucgggagagaaaccuucaccuggaaggaaagugcgagaccuguguuuacaauaugaugggcaaacgggaaaagaaacucggcgaguucgggaaggcuaagggaagccgcgccauuugguauauguggcugggcgccagauuucuggaguucgaggcgcucggguuucugaacgaggaccauugguucucccggggaaauagccuuucuggcguggaaggggagggccugcaccgccucggauacauccugagagaugugggcaaaaaggaagggggagcuauguacgccgacgauacggccggcugggacacccggaucacacuugaggaccugaaaaacgaagagauggucaccaaucauaugaagggggagcacaaaaagcucgcugaagccauuuuuaagcugacauaucagaacaaagugguucgcgugcaaagacccaccccucggggaacggucauggauaucauuagccgcagagaccagcggggcuccggacaggugggcacauacggacugaauaccuucacaaacauggaggcucaacucauccgccagauggaaggcgaggggauuuucaagucuauccagcaucugaccgccacggaggaaaucgcgguucagaauuggcuugccagagugggacgggagcgccugagcagaauggcuauuuccggcgaugacugcgucgugaaacccaucgaugaccgguuugccucugcucucaccgcccugaacgauauggggaagguuagaaaagacauucaacagugggaaccgagccgcggauggaaugauuggacacaggugccuuucugcucccaccacuuucaugagcuugucaugaaggacggccgggugcuggucgugcccuguagaaaccaggaugaacucaucgggcgcgcgcggauuucucaaggcgccggauggagccugaaggagaccgcuugccugggcaaauccuaugcccagauguggacacucauguacuuccacagacgcgaccugcggcuugcugccaacgcuaucuguagcgccguucccucucauugggugccuaccuccagaacaaccuggagcauucacgcgaagcacgaguggaugacgacagaagauaugcuggccgucuggaaucgcguguggauccaggagaacccguggauggaagacaaaacccccguggagucuugggaagagguuccuuaucucgggaagcgggaggaccaguggugcggaucccugaucggccuuaccagcagagcuacaugggccaaaaauauucaaaccgccaucaaccaggugcgcucccugauugggaaugaagaguacacagauuauaugcccucuaugaagcgguuuagacgggaagaggaagaggcuggaguccucugguga

SEQ ID NO: 19746 - RNA, 9876 nt, Artificial Sequence
  derived and/or modified CDS sequence (opt5) from DENV-2__EU569700__SS-prME
accgccggcgugaucgucaugcugauucccaccgcuauggccuuccaccucacgacccggaauggggaaccucauaugaucguuggacggcaggaaaagggcaagagccugcuuuuuaagaccgaagacggggugaauaugugcacccugauggcgauugaucucggagaacugugugaggacacgaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggaucccuuuccccaguccaacgcuccuaucauggacgaagaaagagaaauccccgagagaagcuggaacucuggccacgaaugggugacagauuucaaggggaaaaccgucugguuugugccuuccauuaaggccggaaacgacaucgccgcuugccugcggaaaaauggcaagaaaguuauucagcuuagcagaaagaccuucgauucugaguacgugaagacacgcgccaacgacugggauuuugucgugaccacagacaucagcgagaugggggcgaauuucaaagcugaacgggugauugauccgagacgcuguaugaagcccgucauccugaccgacggagaggaacggguuauccuggccggcccuaugcccgugacgcauuccucugccgcucaaagacgcgggcggauuggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccccgguggcuggacgccagaaucuauuccgauccucuggcgcucaaggaguucaaggaguucgccgcugggcgcaaaucucugacccuuaaucugauuacggaaaugggccggcuccccaccuuuaugacacagaaggccagaaacgcucuggacaaucuggccguccuccauaccgccgaggcuggaggccgcgcguacaaccacgcccuuagcgagcugccggaaacacuggagacccuccugcuucugacacuccuggcuaccgugacagggggaaucuuccuguuucucauguccggcaaagggauuggaaagaugacacuuggcaugugcugcaucaucaccgccagcauucugcugugguaugcccaaauccagccucacuggauugcugccucuaucauucucgaguucuuucugaucguucuucugauccccgagcccgaaaaacagcggaccccucaggauaaucaacucacauacguggucauugcgauccugaccguggucgccgcuacaauggccaacgagaugggcuuccuggagaagacgaagaaagaccucgggcuuggauccauuaccacacaggaaagcgaguccaauauccuggacauugaucugagaccggcuucugccuggacccucuaugcgguggccacaaccuuuguuacgcccaugcugcggcauagcaucgaaaacuccucugugaaugugagccuuaccgcuauugccaaccaggcuacaguccugaugggccucgggaagggauggccucuguccaaaauggacaucggcguuccccugcucgccaucggguguuacagccaggugaauccuauuacccuuacagcugcccugcugcuccugguggcgcacuacgccaucauuggacccggccuucaagcuaaggccacccgcgaggcucagaaaagagccgccgcgggcaucaugaagaacccuacggucgaugggauuacagugaucgaccuggaaccgauccccuaugauccuaaguucgagaaacagcucggacagguuaugcugcugauucucugcgugacccaaguccuuaugaugcggacaaccugggcucugugugaggcccugacccucgcuacaggccccaucucuacgcugugggaagggaauccuggacgcuuuuggaacaccacaauugccguguccauggccaauaucuucagaggcagcuaccuugcuggggccggacugcucuuuucuauuaugaagaacaccacauccacccggcgcggcacgggcaauaucggggagacacugggagaaaaauggaaaagcagacugaacgcgcucggcaaaucugaguuccagaucuauaagaaaagcgggauucaggaggucgaccggacccuugccaaggaaggaaucaagcgcggcgagaccgaucaucacgcuguguccagagggucugccaaacugcggugguuuguugaaagaaacauggugacacccgagggaaaggucguggaccugggcugcggccgcgggggauggagcuacuauuguggcgggcucaaaaauguucgggaagugaagggacugaccaaaggcgggccgggacaugaggagccuauucccauguccacauacggcuggaaccuugucagacugcaaagcggcguggauguguucuucacgcccccugaaaagugcgacacccuccugugugauaucggggaguccucucccaauccuacaauugaagcuggacgcacccugcggguucucaaccuugucgagaauuggcugaacaauaacacacaguuuugcaucaaggugcugaauccguauaugcccagcgugaucgagaagauggaggcccuccagagacaguacggcggggcgcugguccgcaacccucuuuccagaaauucuacccacgagauguacuggguuagcaacgccacgggaaauauuguguccucugugaacaugaucagcagaaugcugauuaaucgcuucaccaugaagcacaaaaaggcuacauaugaacccgacgucgaucucggcuccgggacccggaacaucggaauugagagcgaaaucccuaaccuggacauuaucggcaaaagaaucgagaagauuaagcaagaacaugagaucucuuggcacuacgaccaggaucaucccuauaaaacaugggccuaccacggcuccuaugagaccaagcagacagggagcgcuucuuccauggugaauggaguugugcgccugcucaccaaaccgugggacgucgugccuaugguuacgcagauggccaugacagauaccacccccuuuggccaacagcggguguucaaggaaaaagucgacacaagaacgcaggagccuaaggaagggaccaagaaacuuaugaagauuacagcugaguggcuguggaaagagcugggaaagaaaaagacaccccgcauguguacaagagaagaguuuaccaaaaaggugcggagcaacgccgcgcucggcgccaucuucacagaugaaaauaaguggaaaucugcucgcgaggccguggaagacgggagauuuugggagcuggucgaucgggagagaaaccuucaccuggaaggaaagugcgagaccuguguuuacaauaugaugggcaaacgggaaaagaaacucggcgaguucgggaaggcuaagggaucccgcgccauuugguauauguggcugggcgccagauuucuggaguucgaggcgcucggguuucugaacgaggaccauugguucagccggggaaauucccuuagcggcguggaaggggagggccugcaccgccucggauacauccugagagaugugggcaaaaaggaagggggagcuauguacgccgacgauacggccggcugggacacccggaucacacuugaggaccugaaaaacgaagagauggucaccaaucauaugaagggggagcacaaaaagcucgcugaagccauuuuuaagcugacauaucagaacaaagugguucgcgugcaaagaccuacaccccggggaacggucauggauaucauuucucgcagagaccagcggggcagcggacaggugggcacauacggacugaauaccuucacaaacauggaggcucaacucauccgccagauggaaggcgaggggauuuucaaguccauccagcaucugaccgccacggaggaaaucgcgguucagaauuggcuugccagagugggacgggagcgccugucuagaauggcuauuagcggcgaugacugcgucgugaaaccgaucgaugaccgguuugccuccgcucucaccgcccugaacgauauggggaagguuagaaaagacauucaacagugggaaccuucucgcggauggaaugauuggacacaggugcccuucugcagccaccacuuucaugagcuugucaugaaggacggccgggugcuggucgugcccuguagaaaccaggaugaacucaucgggcgcgcgcggauuucccaaggcgccggauggucucugaaggagaccgcuugccugggcaaaagcuaugcccagauguggacacucauguacuuccacagacgcgaccugcggcuugcugccaacgcuaucuguuccgccguuccuagccauugggugccgaccucuagaacaaccugguccauucacgcgaagcacgaguggaugacgacagaagauaugcuggccgucuggaaucgcguguggauccaggagaaccccuggauggaagacaaaaccccuguggagagcugggaagagguucccuaucucgggaagcgggaggaccaguggugcggaucucugaucggccuuaccuccagagcuacaugggccaaaaauauucaaaccgccaucaaccaggugcgcagccugauugggaaugaagaguacacagauuauaugccuuccaugaagcgguuuagacgggaagaggaagaggcuggaguccucugguga

SEQ ID NO: 19747 - RNA, 9876 nt, Artificial Sequence
  derived and/or modified CDS sequence (opt5) from DENV-2__KF955369__SS-prME
acagccggcgugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacgaccgucgccccuagcaugacaaugcggugcaucggcauuuccaaccgcgauuuuguggaagggguuucuggaggcagcuggguggacaucguccucgagcacggguccugugugaccacaauggcgaagaauaagcccacccuggauuucgaacuuaucaaaacggaggccaagcagccugcuacacugagaaaauauugcauugaagccaagcucaccaacaccacaaccgagagccgguguccgacacaaggagagcccucucugaaugaagaacaggacaaacgcuuuaucugcaagcauuccaugguggauagaggcuggggcaacggguguggacuguucggcaaaggcgggauugucacgugcgcuauguuuaccugcaaaaagaauauggaagggaaaguugugcagccugagaaccucgaauacacaaucgugauuacaccccacagcggggaggagcaugccgucggaaaugacacaggcaagcacggcaaagaaaucaagaucaccccucagucuuccauuacggaggcggaacugaccggguauggaacagugaccauggaguguagcccccggacaggccuugauuucaacgaaaugguucugcuccaaauggaggacaaagccuggcuggugcaccgccagugguuucuugaucugccgcucccuuggcugcccggggcugacacccagggaucuaauuggauccagaaggagacgcuggucacauucaagaacccucaugccaaaaagcaagacgugguugugcucggcucccaggaaggggcuaugcacaccgcccugacaggcgccaccgagauucagaugagcuccggaaaucuucuguuuaccggccaucucaaaugcagacugcggauggauaaacuucaacugaaagggaugucuuacagcauguguacaggaaaguucaagaucgucaaagaaauugcugagacgcagcacggcaccaucgugaucagaguccaguaugagggggacggaucccccugcaagauucccuucgaaaucacagaucucgagaaacgccaugugcugggccggcugauuaccguuaacccuaucgugacagaaaaggacagcccggucaacauugaggcggaacccccuuuuggggauucuuacaucauuaucggcguggagcccggacagcucaaacugaauugguucaagaagggcuccagcaucgggcaaauguuugagaccacgaugagaggagccaaacgcauggcuauucuuggcgacacagccugggauuucgggucucugggaggcguuuuuaccagcaucgggaaggcccuccaccagguguucggcgcuauuuacggagccgcguuuuccggcgucucuuggaccaugaaaauccugauuggggugaucaucacauggauuggaaugaacagccgguccaccagccugucugugucccuuguucucgucggcguggugacacuguaucugggggcugucgugcaggccgacagcggauguguugugucuuggaagaauaaagaacucaagugcggcuccgggaucuucauuacggauaacguccacaccuggacagagcaguacaaguuucaaccugaaagccccuccaaacuggccucugcuauccagaaggcccaugaggaaggcauuuguggaaucagaagcgugacccgccuugagaaucugauguggaaacagaucacaccggagcucaaccacauucuguccgaaaaugagguuaagcugaccaucaugacgggcgacauuaaagggaucaugcaggcuggaaagcggucucuuagaccucaacccaccgaacucaaauauagcuggaagacauggggcaaggccaaaaugcuguccaccgagagccauaaccagacauuccugauugaugggccugaaaccgcggagugccccaauacaaaccgcgccuggaacucucucgagguggaagacuacggauuuggcgucuucaccacgaacaucuggcugaaacuucgggagaaacaggacguguuuugugauuccaagcugaugagcgcugccaucaaagacaauagagcuguucacgccgauaugggcuauuggauugaaucugcgcucaacgacacauggaagauggagaaggccuccuucaucgaggugaaaagcugccacuggccuaagucucauacccuguggagcaaugggguccuggaauccgagaugauuauccccaaaaacuucgcuggaccggugagccagcacaacuaccgcccuggcuaucauacccaaacagccgggcccuggcaccuuggaaagcucgaaauggauuuugacuucugugagggcaccacgguggucguuacagaagauugcgggaaucggggacccucucugagaaccacaaccgcuuccggcaaacugauuacagaguggugcugucggagcugcacccucccuccgcugcgcuacagaggcgaggacggguguugguacggaauggaaauccggccccuuaaggagaaggaagagaaccuggugaauagccucgugacggccggccaugggcagauugauaacuuuucucugggaguccugggcauggcccuuuuccucgaagagaugcugagaacccgcaucgggacaaaacacgcuauccugcucguggcgguuagcuuugugacccugauuacaggaaauauguccuuccgggaccuuggcagagucauggugaugguuggcgccaccaugacggaugacaucgggaugggagugacauaucuggcucuccuggccgccuuuaagguccgcccuaccuucgcugccggccugcuucugagaaaacucacaucuaaggagcugaugauggcgaccauugggaucgcucuccugagccaguccaccauucccgaaacaauccuugagcugacggaugcccucgcccugggaaugauggugcugaaaaucguucggaacauggaaaaguaccaacuugcugugaccauuauggccaucucuugcgucccuaaugcggugauucugcagaacgcuuggaaggugagcuguacaauccucgccgccgucuccguuagcccccugcuccugaccucuucccagcagaaagcugacuggauuccucuugcccugacaaucaagggccucaaucccaccgcuaucuuucugacgacacugagccgcaccucuaaaaagagauccuggccgcuuaacgaggccauuauggcgguggggauggugagcauccuggccucuucccuccugaaaaaugacauuccuaugaccggaccccucgucgcuggcggccugcuuacagugugcuauguucugaccgggcggagcgccgaucuggaacucgagcgcgcugccgacgugaagugggaggaucaagccgaaaucuccggaagcucuccuauucugagcaucacaauuuccgaggacggcucuaugagcaucaaaaacgaagaggaggaacagacgcuuaccauccugauuagaacagggcuccuggucaucuccggaguguuccccguuucuauuccgaucaccgcugcggccugguaccucugggaggugaagaagcagcgggcuggcguccugugggaugugccuucucccccucccgucgaaaaagccgagcuugaagacggggccuaucgcauuaagcagagaggaauccugggcuacucccaaaucggcgcugggguguauaaagagggaacauuucacaccauguggcauguuacgcggggcgccgugcugaugcaccgcgggaagagaauugagcccuccugggcggaugucaaaaaggaccucaucagcuacggaggcggguggaagcuggaaggagaguggaaagaaggcgaggaagugcagguucuugcucuggagccuggcaagaauccgcgggccgugcagaccaaacccgggauuuucaagacaaacaccggaacaaucggcgccgucucccucgauuuuagcccugggaccucuggaucccccauuguggacagaaaaggcaaggugguugggcuguacggaaauggcgucgugacacgcagcggcgcuuaugugucugccaucgcgcagacggagaaguccaucgaagauaacccugagauugaagacgauaucuuccggaaaaagagacucaccauuauggaccugcaucccggggcuggaaaaacaaagcgcuaccuuccugccaucguccgggaggccauuaaaagaggccugcgcacccugauccucgcuccgacccgggugguugccgcugaaauggaggaggcccugagagggcuucccauucgcuaucaaaccccugcgaucaagacggaacacaccggacgggagaucguggaccugaugugucaugccacauucaccaugagacuccugagccccguccgggugccuaacuacaaucucauuaucauggaugaagcucacuuuacagaccccgccuccauugcugcccgcggcuauaucucuaccagaguugagaugggggaggccgcuggcauuuucaugacggcgacaccgccuggaagccgggaucccuuuccccaguccaacgccccuaucauggacgaagaaagagaaauccccgagagaagcuggaacucuggccacgaaugggugaccgauuucaaggggaaaaccgucugguuugugccuuccauuaaggcuggaaacgacaucgccgccugccugcggaaaaauggcaagaaaguuauucagcuuagcagaaagacauucgauucugaguacgugaagacccgcgcuaacgacugggauuuugucgugacaaccgacaucagcgagaugggggccaauuucaaagcggaacgggugauugauccgagacgcuguaugaagcccgucauccugacggacggagaggaacggguuauccuggcuggcccuaugcccgugacacauuccucugccgcccaaagacgcgggcggauuggcagaaacccuaaaaaugagaacgaccaguauaucuacaugggagaaccccucgagaaugaugaggacugcgcucacuggaaggaagccaaaaugcugcuugauaacauuaauaccccggagggcaucauuccuagcauguuugaacccgagcgcgaaaagguggacgcgaucgauggggaguacagacugcggggagaggcccgcaaaacauucgucgaccucaugagacggggcgaucugccuguguggcuggcuuauaagguugccgcugaagggauuaacuacgccgaccgcaagugguguuuugauggaaucaaaaauaaccagauccucgaggaaaacauggagguggagauuuggaccaaggaaggcgagcgcaagaaacuuaaaccccgguggcuggacgcuagaaucuauuccgauccucuggcccucaaggaguucaaggaguucgcggccgggcgcaaaucucugacgcuuaaucugauuaccgaaaugggccggcuccccacauuuaugacccagaaggcuagaaacgcccuggacaaucuggcuguccuccauacagccgaggccggaggccgcgcuuacaaccacgcgcuuagcgagcugccggaaacccuggagacacuccugcuucugacccuccuggccacggugacagggggaaucuuccuguuucucauguccggcaaagggauuggaaagaugacccuuggcaugugcugcaucaucaccgcuagcauucugcugugguaugcccaaauccagccucacuggauugccgcuucuaucauucucgaguucuuucugaucguucuucugauccccgagcccgaaaaacagcggacaccucaggauaaucaacucaccuacguggucauugccauccugacaguggucgcggccacgauggcuaacgagaugggcuuccuggagaagaccaagaaagaccucgggcuuggauccauuacaacccaggaaagcgaguccaauauccuggacauugaucugagaccggccucugcuuggacacucuaugccguggcgaccacguuuguuacccccaugcugcggcauagcaucgaaaacuccucugugaaugugagccuuacagccauugcuaaccaggccaccguccugaugggccucgggaagggauggccucuguccaaaauggacaucggcguuccccugcucgcuaucggguguuacagccaggugaauccuauuacacuuaccgccgcucugcugcuccugguggcccacuacgcgaucauuggacccggccuucaagccaaggcuacgcgcgaggcccagaaaagagcugccgccggcaucaugaagaacccuacagucgaugggauuaccgugaucgaccuggaaccgauccccuaugauccuaaguucgagaaacagcucggacagguuaugcugcugauucucugcgugacacaaguccuuaugaugcggaccaccugggcgcugugugaggcucugacacucgccacgggccccaucucuacccugugggaagggaauccuggacgcuuuuggaacacaaccauugcuguguccauggccaauaucuucagaggcagcuaccuugccggggcuggacugcucuuuucuauuaugaagaacacaaccuccacgcggcgcggcacaggcaauaucggggagacccugggagaaaaauggaaaagcagacugaacgcccucggcaaaucugaguuccagaucuauaagaaaagcgggauucaggaggucgaccggacccuugcgaaggaaggaaucaagcgcggcgagacagaucaucacgccguguccagagggucugcuaaacugcggugguuuguugaaagaaacauggugacccccgagggaaaggucguggaccugggcugcggccgcgggggauggagcuacuauuguggcgggcucaaaaauguucgggaagugaagggacugacaaaaggcgggccgggacaugaggagccuauucccauguccacguacggcuggaaccuugucagacugcaaagcggcguggauguguucuucacacccccugaaaagugcgacacccuccugugugauaucggggaguccucucccaauccuaccauugaagccggacgcacacugcggguucucaaccuugucgagaauuggcugaacaauaacacccaguuuugcaucaaggugcugaauccguauaugcccagcgugaucgagaagauggaggcucuccagagacaguacggcggggcccugguccgcaacccucuuuccagaaauucuacgcacgagauguacuggguuagcaacgcgaccggaaauauuguguccucugugaacaugaucagcagaaugcugauuaaucgcuucacaaugaagcacaaaaaggccaccuaugaacccgacgucgaucucggcuccgggacacggaacaucggaauugagagcgaaaucccuaaccuggacauuaucggcaaaagaaucgagaagauuaagcaagaacaugagaucucuuggcacuacgaccaggaucaucccuauaaaaccugggcuuaccacggcuccuaugagacaaagcagaccgggagcgccucuuccauggugaauggaguugugcgccugcucacgaaaccgugggacgucgugccuaugguuacacagauggcuaugaccgauaccacacccuuuggccaacagcggguguucaaggaaaaagucgacacgagaacccaggagccuaaggaagggacaaagaaacuuaugaagauuaccgccgaguggcuguggaaagagcugggaaagaaaaagacaccccgcauguguaccagagaagaguuuaccaagaaggugcggagcaacgcugcccucggcgcgaucuucaccgaugaaaauaaguggaaaucugcccgcgaggcuguggaagacgggagauuuugggagcuggucgaucgggagagaaaccuucaccuggaaggaaagugcgagacguguguuuacaauaugaugggcaaacgggaaaagaaacucggcgaguucgggaaggccaagggaucccgcgcuauuugguauauguggcugggcgccagauuucuggaguucgaggcccucggguuucugaacgaggaccauugguucagccggggaaauucccuuagcggcguggaaggggagggccugcaccgccucggauacauccugagagaugugggcaaaaaggaagggggagcgauguacgcugacgauaccgccggcugggacacacggaucacccuugaggaccugaaaaacgaagagauggucacaaaucauaugaagggggagcacaaaaagcucgccgaagcuauuuuuaagcugaccuaucagaacaaagugguucgcgugcaaagaccuacgccccggggaacagucauggauaucauuucucgcagagaccagcggggcagcggacaggugggcaccuacggacugaauacauucaccaacauggaggcccaacucauccgccagauggaaggcgaggggauuuucaaguccauccagcaucugacggcuaccgaggaaaucgccguucagaauuggcuugcgagagugggacgggagcgccugucuagaauggccauuagcggcgaugacugcgucgugaaaccgaucgaugaccgguuugcuuccgcccucacagcucugaacgauauggggaagguuagaaaagacauucaacagugggaaccuucucgcggauggaaugauuggacccaggugcccuucugcagccaccacuuucaugagcuugucaugaaggacggccgggugcuggucgugcccuguagaaaccaggaugaacucaucgggcgcgcccggauuucccaaggcgcgggauggucucugaaggagacagccugccugggcaaaagcuaugcucagauguggacccucauguacuuccacagacgcgaccugcggcuugccgcuaacgccaucuguuccgcuguuccuagccauugggugccgacaucuagaaccacgugguccauucacgccaagcacgaguggaugacaaccgaagauaugcuggcggucuggaaucgcguguggauccaggagaaccccuggauggaagacaaaaccccuguggagagcugggaagagguucccuaucucgggaagcgggaggaccaguggugcggaucucugaucggccuuacauccagagccaccugggcuaaaaauauucaaacagccaucaaccaggugcgcagccugauugggaaugaagaguacacggauuauaugccuuccaugaagcgguuuagacgggaagaggaagaggccggaguccucugguga

SEQ ID NO: 19748 - RNA, 9876 nt, Artificial Sequence
  derived and/or modified CDS sequence (opt5) from DENV-2__EU569702__SS-prME
accgccggcgugaucgugaugcugauucccaccgcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaagacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagcgcgcuuccuucaucgaggucaagagcugccacuggccuaaaucucauacacuguggagcaaugggguccuggaauccgagaugauuauccccaagaacuucgccggaccggugagccagcacaacuaccggccuggcuaucauacccaaaccgcugggcccuggcaccuuggaaaacucgaaauggauuuugacuucugugagggcacaaccguggucguuacggaagauugcgggaauagaggacccucucugcggacaaccacagccuccggcaagcugauuaccgaguggugcugucgcagcugcacacucccuccgcugagauaccggggcgaggacggguguugguacggaauggaaaucagaccccuuaaagagaaggaagagaaccuggugaauagccucgugaccgccggccaugggcagauugauaacuuuucucugggaguccugggcauggcucuuuuccucgaagagaugcugcgcacgcggaucgggaccaagcacgcgauccugcucguggccguuagcuuugugacacugauuaccggaaauauguccuucagagaccuuggccgcgucauggugaugguuggcgcuacaaugaccgaugacaucgggaugggagugacguaucuggcccuccuggccgcuuuuaaagucagaccuacauucgccgcgggccugcuucugcggaagcucaccucuaaagagcugaugauggcuacaauugggaucgcccuccugagccaguccaccauucccgaaaccauccuugagcugacagaugcccucgcucugggaaugauggugcugaagaucguucgcaacauggaaaaauaccaacuugccgugacgauuauggcgaucucuugcgucccuaaugcugugauucugcagaacgccuggaaggugagcuguaccauccucgccgcugucuccguuagcccccugcuccugacaucuucccagcagaaggccgacuggauuccucuugcucugaccaucaaaggccucaaucccacagccaucuuucugaccacgcugagcagaacaucuaagaaacgguccuggccgcuuaacgaggcgauuauggccguggggauggugagcauccuggcuucuucccuccugaagaaugacauuccuaugaccggaccccucgucgccggcggccugcuuaccgugugcuauguucugacagggcgcagcgcugaucuggaacucgagagagccgccgacgugaaaugggaggaucaagcugaaaucuccggaagcucuccuauucugagcaucaccauuuccgaggacggcucuaugagcaucaagaacgaagaggaggaacagacacuuacgauccugauucggaccgggcuccuggucaucuccggaguguuccccguuucuauuccgaucacagcggccgcuugguaccucugggaggugaaaaagcagcgcgccggcguccugugggaugugccuucucccccucccgucgaaaaggccgagcuugaagacggggcuuauagaauuaaacagcggggaauccugggcuacucccaaaucggcgccgggguguauaaggagggaaccuuucacacaauguggcauguuacccgcggcgcggugcugaugcacagagggaaacggauugagcccuccugggcugaugucaagaaagaccucaucagcuacggaggcggguggaagcuggaaggagaguggaaggaaggcgaggaagugcagguucuugcccuggagccuggcaaaaauccgagagccgugcagacgaagcccgggauuuucaaaaccaacacaggaaccaucggcgcugucucccucgauuuuagcccugggacaucuggaucccccauuguggaccgcaagggcaaagugguugggcuguacggaaauggcgucgugacccggagcggcgccuaugugucugcgaucgcucagacagagaaguccaucgaagauaacccugagauugaagacgauaucuucagaaagaaacgccucacgauuauggaccugcaucccggggccggaaagaccaaacgguaccuuccugccaucgucagagaggcuauuaagcgcggccugcggacacugauccucgccccgaccagagugguugcugccgaaauggaggaggcgcugcgcgggcuucccauucgguaucaaaccccugccaucaaaacagaacacacgggaagagagaucguggaccugaugugucaugcuaccuucacaaugcggcuccugagccccguccgcgugccuaacuacaaucucauuaucauggaugaagcccacuuuaccgaccccgcuuccauugccgccagaggcuauaucucuacacggguugagaugggggaggcugcgggcauuuucaugaccgccacgccgccuggaagccgcgaucccuuuccccaguccaacgcuccuaucauggacgaagagagagaaauccccgagcggagcuggaacucuggccacgaaugggugacagauuucaaggggaagaccgucugguuugugccuuccauuaaagccggaaacgacaucgccgcuugccugagaaagaauggcaaaaagguuauucagcuuagccgcaaaaccuucgauucugaguacgugaagacacgggccaacgacugggauuuugucgugaccacagacaucagcgagaugggggcgaauuucaaggcugaaagagugauugauccgcgccgguguaugaaacccgucauccugaccgacuccgaggaaagaguuauccuggccggaccuaugcccgugacgcauucuagcgccgcucaacgccggggcagaauugggcgcaacccuaagaaugagaacgaccaguauaucuacaugggcgaaccccucgagaaugaugaggacugcgcccacuggaaagaagcgaagaugcugcuugauaacauuaauacaccggagggaaucauuccuuccauguuugaacccgagagagaaaaaguggacgccaucgauggcgaguaccggcugcgcggggaggcuagaaagaccuucgucgaccucaugcggcgcggagaucugccuguguggcuggccuauaaaguugcugccgaaggcauuaacuacgcugacagaaagugguguuuugaugggaucaagaauaaccagauccucgaggaaaacauggagguggagauuuggacaaaagaaggagagcggaagaaacuuaagcccagauggcuggacgcccgcaucuauucugauccucuggcgcucaaagaguucaaggaguucgccgcuggcagaaagagccugacccuuaaucugauuacggaaauggggagacuccccaccuuuaugacacagaaagcccgcaacgcucuggacaaucuggccguccuccauaccgccgaggcuggcggacgggcguacaaccacgcccuuuccgagcugccggaaacacuggagacccuccugcuucugacacuccuggcuaccgugacgggcgggaucuuccuguuucucaugagcggaaagggcauugggaaaaugacacuuggaaugugcugcaucaucaccgccucuauucugcugugguaugcccaaauccagccucacuggauugcugccuccaucauucucgaguucuuucugaucguucuucugauccccgagcccgaaaagcagagaaccccucaggauaaucaacucacauacguggucauugcgauccugaccguggucgccgcuacaauggccaacgagaugggcuuccuggagaaaacgaagaaggaccucggccuugggagcauuaccacacaggaauccgagucuaauauccuggacauugaucugcggccggcuagcgccuggacccucuaugcgguggccacaaccuuuguuacgcccaugcugcgccauuccaucgaaaacucuagcgugaaugugucccuuaccgcuauugccaaccaggcuacaguccugaugggacucggcaaaggguggccucugagcaagauggacaucggaguuccccugcucgccaucggcuguuacucucaggugaauccuauuacccuuacagcugcccugcugcuccugguggcgcacuacgccaucauugggcccggacuucaagcuaaagccaccagagaggcucagaagcgggccgccgcgggcaucaugaaaaacccuacggucgauggcauuacagugaucgaccuggaaccgauccccuaugauccuaaguucgagaagcagcucgggcagguuaugcugcugauucucugcgugacccaaguccuuaugaugcgcacaaccugggcucugugugaggcccugacccucgcuacaggacccaucuccacgcugugggaaggcaauccugggagauuuuggaacaccacaauugccgugagcauggccaauaucuuccggggaucuuaccuugcuggcgccgggcugcucuuuuccauuaugaaaaacaccacaagcacccgcagaggaacgggcaauaucggcgagacacugggggaaaaguggaaaucucggcugaacgcgcucggaaagagcgaguuccagaucuauaaaaaguccggcauucaggaggucgaccgcacccuugccaaagaagggaucaagagaggagagaccgaucaucacgcugugucucggggcagcgccaagcugagaugguuuguugaacgcaacauggugacacccgaggggaaagucguggaccugggaugcggccggggcgggugguccuacuauuguggaggccucaagaauguuagagaagugaaagggcugaccaagggaggcccggggcaugaggagccuauucccaugagcacauacggauggaaccuuguccgccugcaauccggcguggauguguucuucacgcccccugaaaaaugcgacacccuccugugugauaucggcgagucuagccccaauccuacaauugaagcugggcggacccugagaguucucaaccuugucgagaauuggcugaacaauaacacacaguuuugcaucaaggugcugaauccguauaugcccuccgugaucgaaaagauggaggcccuccagcgccaguacggaggcgcgcugguccggaacccucuuucuagaaauagcacccacgagauguacuggguuuccaacgccacggggaauauugugucuagcgugaacaugaucucccgcaugcugauuaaucgguucaccaugaaacacaagaaagcuacauaugaacccgacgucgaucucggaagcggcaccagaaacaucgggauugagucugaaaucccuaaccuggacauuaucggaaagcgcaucgagaaaauuaagcaagaacaugagaucuccuggcacuacgaccaggaucaucccuauaagacaugggccuaccacggcagcuaugagaccaaacagacaggcucugcuuccagcauggugaaugggguugugcggcugcucaccaagccgugggacgucgugccuaugguuacgcagauggccaugacagauaccacccccuuuggacaacagagaguguucaaagaaaaggucgacacacgcacgcaggagccuaaagaaggcaccaagaaacuuaugaaaauuacagcugaguggcuguggaaggagcuggggaaaaagaaaacccccagaauguguacacgggaagaguuuaccaagaaagugcgcucuaacgccgcgcucggagccaucuucacagaugaaaauaaguggaaguccgcuagagaggccguggaagacggccgguuuugggagcuggucgauagagagcggaaccuucaccuggaagggaaaugcgagaccuguguuuacaauaugaugggaaagcgcgagaagaagcucggcgaguucggcaaagcuaaggggagcagagccauuugguauauguggcugggagcccgguuucuggaguucgaggcgcucggcuuucugaacgaggaccauugguucucccgcgggaauagccuuucuggaguggaaggcgaggggcugcacagacucggcuacauccugcgggaugugggaaagaaagaaggcggggcuauguacgccgacgauacggccggaugggacacccgcaucacacuugaggaccugaagaacgaagagauggucaccaaucauaugaaaggcgagcacaagaaacucgcugaagccauuuuuaagcugacauaucagaacaaggugguuagagugcaacggccuacaccccgcgggacggucauggauaucauuagcagacgggaccagcgcggauccggccagguggggacauacggccugaauaccuucacaaacauggaggcucaacucaucagacagauggaaggagagggcauuuucaaaucuauccagcaucugaccgccacggaggaaaucgcgguucagaauuggcuugcccggguggggcgcgagagacugagccggauggcuauuuccggagaugacugcgucgugaagccgaucgaugacagauuugccucugcucucaccgcccugaacgauaugggcaaaguucgcaaggacauucaacagugggaaccuagccggggguggaaugauuggacacaggugcccuucugcucccaccacuuucaugagcuugucaugaaagacggaagagugcuggucgugcccugucgcaaccaggaugaacucaucggccgggcgagaauuucucaaggggccggcuggagccugaaggagaccgcuugccugggaaaguccuaugcccagauguggacacucauguacuuccaccgccgggaccugagacuugcugccaacgcuaucuguagcgccguuccuucucauugggugccgaccucccgcacaaccuggagcauucacgcgaaacacgaguggaugacgacagaagauaugcuggccgucuggaaucggguguggauccaggagaaccccuggauggaagacaagaccccuguggagucuugggaagagguucccuaucucggcaaaagagaggaccaguggugcgggucccugaucggacuuaccagccgcgcuacaugggccaagaauauucaaaccgccaucaaccaggugcggucccugauuggcaaugaagaguacacagauuauaugccuucuaugaaaagauuucggagagaagaggaagaggcugggguccucugguga

SEQ ID NO: 19749 - RNA, 9876 nt, Artificial Sequence
  derived and/or modified CDS sequence (opt5) from DENV-2__EU482624__SS-prME
acagccggcgugaucgucaugcugauucccacagcuauggccuuccaccucacgaccagaaacggggaaccucauaugaucguuggacggcaggaaaagggcaagagccugcuuuuuaagacagaagacggggugaauaugugcacccugauggcgauugaucucggagaacugugugaggacacaaucaccuacaaaugcccgcuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccaacaccauuggaaccacacacuuucagagagcucugaucuucauucuucugacggccgucgcgccuagcaugaccaugcggugcaucggcauuuccaaucgcgauuuuguggaagggguuucuggaggcagcuggguggacaucguccucgagcacggguccugugugacaaccauggccaagaacaagcccacacuggauuucgaacuuaucaaaaccgaggcuaagcagccugccacgcugagaaaauacugcauugaagcuaagcucacaaauaccaccacagagagccgguguccgacccaaggagagcccucucugaacgaagaacaggacaaacgcuuuaucugcaagcauuccaugguggauagaggcuggggcaauggguguggacuguucggcaaaggcgggauugucacaugcgccauguuuacgugcaaaaagaacauggaagggaaaguugugcagccugagaaucucgaauauaccaucgugauuacaccccacagcggggaggagcaugcggucggaaacgacaccggcaagcacggcaaagaaaucaagaucacaccucagucuuccauuaccgaggccgaacugacgggguacggaaccgugacaauggaguguagcccccggaccggccuugauuucaaugaaaugguucugcuccaaauggaggacaaggcuuggcuggugcaccgccagugguuucuugaucugccgcucccuuggcugcccggggccgacauccagggaucuaacuggauucagaaggagacacuggucaccuucaagaauccucaugcuaaaaagcaagacgugguugugcucggcucccaggaaggggccaugcacacggcccugacaggcgcuaccgagauccagaugagcuccggaaaccuucuguuuacaggccaucucaaaugcagacugcggauggauaaacuucaacugaaagggaugucuuauagcauguguaccggaaaguucaagauugucaaagaaaucgcggagacccagcacggcacaaucgugauuagaguccaguacgagggggacggaucccccugcaagauccccuucgaaauuacggaucucgagaaacgccaugugcugggccggcugaucaccguuaacccuauugugacagaaaaggacagcccggucaauaucgaggccgaacccccuuuuggggauucuuauauuaucaucggcguggagcccggacagcucaaacugaacugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucggggugaucauuaccuggaucggaaugaauagccgguccaccagccugucugugucccuuguucucgucggcguggugacacuguaccugggggccgucgugcaggccgacagcggauguguugugucuuggaagaacaaagaacucaagugcggcuccgggauuuucaucaccgauaauguccacacauggacggagcaguauaaguuucaaccugaaagccccuccaaacuggcuucugccauucagaaggcucaugaggaaggcaucuguggaaucagaagcgugacccgccuugagaaccugauguggaaacagauuacaccggagcucaaucacauccuguccgaaaacgagguuaagcugaccauuaugacaggcgacaucaaagggauuaugcaggccggaaagcggucucuuagaccucaacccaccgaacucaaauacagcuggaagacguggggcaaggcgaaaaugcuguccaccgagagccauaaucagacauuccugaucgaugggccugaaaccgccgagugccccaacacaaaucgcgcuuggaacucucucgagguggaagacuauggauuuggcgucuucaccacaaauaucuggcugaaacuucgggagaaacaggacguguuuugugauuccaagcugaugagcgccgcuauuaaagacaacagagccguucacgcggauaugggcuacuggaucgaaucugcccucaaugacaccuggaagauggagaaggcuuccuucauugaggugaaaagcugccacuggccuaagucucauacgcuguggagcaacgggguccuggaauccgagaugaucauucccaaaaacuucgccggaccggugagccagcacaauuaucgcccuggcuaccauacacaaaccgcugggcccuggcaccuuggaaagcucgaaauggauuuugacuucugugagggcaccacaguggucguuaccgaagauugcgggaaccggggacccucucugagaacgacaaccgccuccggcaaacugaucacagaguggugcugucggagcugcacccucccuccgcugcgcuauagaggcgaggacggguguugguacggaauggaaauucggccccuuaaggagaaggaagagaaucuggugaacucccucgugacagccggccaugggcagaucgauaauuuuucucugggaguccugggcauggcucuuuuccucgaagagaugcugagaacccgcaucgggacgaaacacgcgauucugcucguggccguuagcuuugugacccugaucacaggaaacauguccuuccgggaccuuggcagagucauggugaugguuggcgcuaccaugacagaugacauugggaugggagugaccuaccuggcccuccuggccgcuuuuaagguccgcccuacguucgccgcgggccugcuucugagaaaacucacaucuaaggagcugaugauggcuaccaucgggauugcccuccugagccaguccacaauccccgaaaccauccuugagcugaccgaugcccucgcucugggaaugauggugcugaaaauuguucggaauauggaaaaguaucaacuugccgugacaaucauggcgauuucuugcgucccuaacgcugugauccugcagaaugccuggaaggugagcuguacgauucucgccgcugucuccguuagcccccugcuccugaccucuucccagcagaaagccgacuggaucccucuugcucugacaaucaagggccucaaccccaccgccauuuuucugacaacccugagccgcacgucuaaaaagagauccuggccgcuuaaugaggcgaucauggccguggggauggugagcauucuggcuucuucccuccugaaaaacgacaucccuaugacaggaccccucgucgccggcggccugcuuaccgugugcuacguucugaccgggcggagcgcugaucuggaacucgagcgcgccgccgacgugaagugggaggaucaagcugaaauuuccggaagcucuccuauccugagcauuacaaucuccgaggacggcucuaugagcaucaaaaaugaagaggaggaacagacccuuacaauucugaucagaacggggcuccuggucauuuccggaguguuccccguuucuaucccgauuaccgcggccgcuugguaucucugggaggugaagaagcagcgggccggcguccugugggaugugccuucucccccucccgucgaaaaagccgagcuugaagacggggcuuaccgcaucaagcagagaggaauccugggcuauucccaaauuggcgccgggguguacaaagagggaacauuucacaccauguggcauguuacacggggcgcggugcugaugcaccgcgggaagagaaucgagcccuccugggcugaugucaaaaaggaccucauuagcuauggaggcggguggaagcuggaaggagaguggaaagaaggcgaggaagugcagguucuugcccuggagccuggcaagaacccgcgggccgugcagaccaaacccgggaucuucaagacgaauaccggaacaauuggcgcugucucccucgauuuuagcccugggaccucuggaucccccaucguggacagaaaaggcaaggugguugggcuguacggaaacggcgucgugacacgcagcggcgccuacgugucugcgaucgcucagaccgagaaguccauugaagauaacccugagaucgaagacgauauuuuccggaaaaagagacucacaaucauggaccugcaucccggggccggaaaaacgaagcgcuaucuuccugccauuguccgggaggcuaucaaaagaggccugcgcacccugauucucgccccgacacgggugguugcugccgaaauggaggaggcgcugagagggcuucccauccgcuaccaaaccccugccaucaagaccgaacacacaggacgggagauuguggaccugaugugucaugcuacguucaccaugagacuccugagccccguccgggugccuaauuauaaccucaucauuauggaugaagcccacuuuacagaccccgcuuccaucgccgcccgcggcuacauuucuaccagaguugagaugggggaggcugcgggcaucuucaugacagccaccccgccuggaagccgggaucccuuuccccaguccaaugcuccuaucauggacgaagaaagagaaauucccgagagaagcuggaacucuggccacgaaugggugacggauuucaaggggaaaacagucugguuugugccuuccaucaaggccggaaaugacauugccgcuugccugcggaaaaacggcaagaaaguuauccagcuuagcagaaagaccuucgauucugaguaugugaagacccgcgccaaugacugggauuuugucgugacaaccgacauuagcgagaugggggcgaacuucaaagcugaacgggugaucgauccgagacgcuguaugaagcccgucauccugacagacggagaggaacggguuauucuggccggcccuaugcccgugacccauuccucugccgcucaaagacgcgggcggaucggcagaaauccuaaaaacgagaaugaccaguacauuuauaugggagaaccccucgagaacgaugaggacugcgcccacuggaaggaagcgaaaaugcugcuugauaauaucaacacgccggagggcauuaucccuagcauguuugaacccgagcgcgaaaagguggacgccauugauggggaguacagacugcggggagaggcucgcaaaacauucgucgaccucaugagacggggcgaucugccuguguggcuggccuacaagguugcugccgaagggaucaauuaugcugaccgcaagugguguuuugauggaaucaaaaacaaccagauucucgaggaaaauauggagguggagaucuggaccaaggaaggcgagcgcaagaaacuuaaaccccgguggcuggacgccagaauuuacuccgauccucuggcgcucaaggaguucaaggaguucgccgcugggcgcaaaucucugacacuuaaccugaucaccgaaaugggccggcuccccacguuuaugacccagaaggccagaaaugcucuggacaaccuggccguccuccauacagccgaggcuggaggccgcgcguauaaucacgcccuuagcgagcugccggaaacccuggagacacuccugcuucugacccuccuggcuacagugaccgggggaauuuuccuguuucucauguccggcaaagggaucggaaagaugacgcuuggcaugugcugcaucauuacagccagcauccugcugugguacgcccaaauucagccucacuggaucgcugccucuauuauccucgaguucuuucugaucguucuucugauucccgagcccgaaaaacagcggaccccucaggauaaccaacucaccuauguggucaucgcgauucugacaguggucgccgcuaccauggccaaugagaugggcuuccuggagaagacaaagaaagaccucgggcuuggauccaucacgacccaggaaagcgaguccaacauucuggacaucgaucugagaccggcuucugccuggacacucuacgcgguggccaccacauuuguuacccccaugcugcggcauagcauugaaaauuccucugugaacgugagccuuacggcuaucgccaaucaggcuaccguccugaugggccucgggaagggauggccucuguccaaaauggacaucggcguuccccugcucgccauuggguguuauagccaggugaacccuaucacacuuaccgcugcccugcugcuccugguggcgcacuacgccauuaucggacccggccuucaagcuaaggccacacgcgaggcucagaaaagagccgccgcgggcauuaugaagaauccuaccgucgaugggaucacggugaucgaccuggaaccgauucccuacgauccuaaguucgagaaacagcucggacagguuaugcugcugauccucugcgugacacaaguccuuaugaugcggaccacaugggcucugugugaggcccugacccucgcuaccggccccauuucuacacugugggaagggaacccuggacgcuuuuggaauacgaccaucgccguguccauggccaacauuuucagaggcagcuaucuugcuggggccggacugcucuuuucuaucaugaagaauacaaccuccacacggcgcggcaccggcaacaucggggagacgcugggagaaaaauggaaaagcagacugaacgcgcucggcaaaucugaguuccagauuuacaagaaaagcgggauccaggaggucgaccggacacuugccaaggaaggaauuaagcgcggcgagaccgaucaucacgcuguguccagagggucugccaaacugcggugguuuguugaaagaaauauggugacccccgagggaaaggucguggaccugggcugcggccgcgggggauggagcuauuacuguggcgggcucaaaaacguucgggaagugaagggacugacaaaaggcgggccgggacaugaggagccuauccccauguccaccuauggcuggaaucuugucagacugcaaagcggcguggauguguucuucacacccccugaaaagugcgacacgcuccugugugauauuggggaguccucucccaacccuaccaucgaagcuggacgcacacugcggguucucaaucuugucgagaacuggcugaauaacaauacccaguuuugcaucaaggugcugaacccguacaugcccagcgugauugagaagauggaggcccuccagagacaguauggcggggcgcugguccgcaauccucuuucccggaacucuacacacgagauguacuggguuagcaaugccaccggaaacaucguguccucugugaauaugauuagcagaaugcugaucaaccgcuucacgaugaagcacaaaaaggcuaccuacgaacccgacgucgaucucggcuccgggacacggaacauuggaaucgagagcgaaauuccuaaucuggacaucaucggcaaaagaauugagaagaucaagcaagaacaugagauuucuuggcacuaugaccaggaucaucccuacaaaaccugggccuaucacggcuccuacgagacaaagcagaccgggagcgcuucuuccauggugaacggaguugugcgccugcucacaaaaccgugggacgucgugccuaugguuacccagauggccaugacggauacaacccccuuuggccaacagcggguguucaaggaaaaagucgacaccagaacacaggagccuaaggaagggacgaagaaacuuaugaagaucaccgcugaguggcuguggaaagagcugggaaagaaaaagacaccccgcauguguaccagagaagaguuuaccaagaaggugcggagcaaugccgcgcucggcgccauuuucaccgaugaaaacaaguggaaaucugcucgcgaggccguggaagacgggagauuuugggagcuggucgaucgggagagaaaucuucaccuggaaggaaagugcgagacauguguuuauaacaugaugggcaaacgggaaaagaaacucggcgaguucgggaaggcuaagggaucccgcgccaucugguacauguggcugggcgccagauuucuggaguucgaggcgcucggguuucugaaugaggaccauugguucagccggggaaacucccuuagcggcguggaaggggagggccugcaccgccucggauauauccugagagaugugggcaaaaaggaagggggagcuauguacgccgacgauaccgccggcugggacacgcggauuacccuugaggaccugaaaaaugaagagauggucacaaaccauaugaagggggagcacaaaaagcucgcugaagccaucuuuaagcugaccuaccagaauaaagugguucgcgugcaaagaccuacaccccggggaaccgucauggauauuaucucucgcagagaccagcggggcagcggacaggugggcacguauggacugaacacauucaccaauauggaggcucaacucauucgccagauggaaggcgaggggaucuucaaguccauccagcaucugacagccaccgaggaaauugcgguucagaacuggcuugccagagugggacgggagcgccugucuagaauggcuaucagcggcgaugacugcgucgugaaaccgauugaugaccgguuugccuccgcucucacggcccugaaugauauggggaagguuagaaaagacauccaacagugggaaccuucucgcggauggaacgauuggacccaggugcccuucugcagccaccacuuucaugagcuugucaugaaggacggccgggugcuggucgugcccuguagaaaccaggaugaacucauugggcgcgcgcggaucucccaaggcgccggauggucucugaaggagacagcuugccugggcaaaagcuacgcccagauguggacccucauguauuuccacagacgcgaccugcggcuugcugccaaugcuauuuguuccgccguuccuagccauugggugccgacaucuagaaccacaugguccauccacgcgaagcacgaguggaugaccacggaagauaugcuggccgucuggaaccgcguguggauccaggagaaucccuggauggaagacaaaacaccuguggagagcugggaagagguucccuaccucgggaagcgggaggaccaguggugcggaucucugauuggccuuaccuccagagcuaccugggccaaaaacauccaaacagccauuaaucaggugcgcagccugaucgggaacgaagaguauaccgauuacaugccuuccaugaagcgguuuagacgggaagaggaagaggcuggaguccucugguga

SEQ ID NO: 19750 - RNA, 9876 nt, Artificial Sequence
  derived and/or modified CDS sequence (opt5) from DENV-2__EU596500__SS-prME
accgccggcgugaucgucaugcugauucccacggcuauggccuuccaccucacgaccagaaauggggaaccucauaugaucguuggacggcaggaaaagggcaagagccugcuuuuuaagacagaagacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagauggugauucccaaaaacuucgccggaccggugagccagcacaacuaccgcccuggcuaucauacccaaaccgcugggcccuggcaccuuggaaagcucgaaauggauuuugacuucugugagggcacaaccgucguugugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgucaccgccggccaugggcagaucgauaacuuuucucugggagugcugggcauggcucuuuuccucgaagagaugcugagaacgcgcauugggaccaaacacgcgauccugcucguugccgugagcuuugucacacugaucaccggaaauauguccuuccgggaccuuggcagagugaugguuauggugggcgcuacaaugaccgaugacauugggaugggagucacguaucuggcccuccuggccgcuuuuaaggugcgcccuacauucgccgcgggccugcuucugagaaaacucaccucuaaggagcugaugauggcuacaaucgggauugcccuccugagccaguccaccauccccgaaaccauucuugagcugacagaugcccucgcucugggaaugaugguucugaaaaucgugcggaacauggaaaaguaccaacuugccgucacgaucauggcgauuucuugcgugccuaaugcugugauccugcagaacgccuggaaggucagcuguaccauucucgccgcuguuuccgugagcccccugcuccugacaucuucccagcagaaagccgacuggaucccucuugcucugaccauuaagggccucaaucccacagccaucuuucugaccacgcugagccgcacaucuaaaaagagauccuggccgcuuaacgaggcgaucauggccguggggauggucagcauucuggcuucuucccuccugaaaaaugacaucccuaugaccggaccccucguggccggcggccugcuuaccguuugcuaugugcugacagggcggagcgcugaucuggaacucgagcgcgccgccgacgucaagugggaggaucaagcugaaauuuccggaagcucuccuauccugagcauuaccaucuccgaggacggcucuaugagcauuaaaaacgaagaggaggaacagacacuuacgauccugaucagaaccgggcuccuggugauuuccggaguuuuccccgugucuaucccgauuacagcggccgcuugguaccucugggaggucaagaagcagcgggccggcgugcugugggaugucccuucucccccucccguggaaaaagccgagcuugaagacggggcuuaucgcaucaagcagagaggcauucugggauacucccaaaucggcgccgggguuuauaaagagggaaccuuucacacaauguggcaugugacccggggcgcgguccugaugcaccgcgggaagagaaucgagcccuccugggcugaugugaaaaaggaccucauuagcuacggaggcggguggaagcuggaaggagaguggaaagaaggcgaggaaguucaggugcuugcccuggagccuggcaagaauccgcgggccguccagacgaaacccgggaucuucaagaccaacacaggaaccauuggcgcugugucccucgauuuuagcccugggacaucuggaucccccaucguggacagaaaaggcaagguugucgggcuguacggaaauggcguggugacccgcagcggcgccuaugucucugcgauugcucagacagagaaguccaucgaagauaacccugagaucgaagacgauauuuuccggaaaaagagacucacgaucauggaccugcaucccggggccggaaaaaccaagcgcuaccuuccugccauugugcgggaggcuaucaaaagaggccugcgcacacugauucucgccccgacccggguuguggcugccgaaauggaggaggcgcugagagggcuucccauccgcuaucaaaccccugccauuaagacagaacacacgggacgggagaucgucgaccugaugugucaugcuaccuucacaaugagacuccugagccccgugcggguuccuaacuacaaucucaucauuauggaugaagcccacuuuaccgaccccgcuuccaucgccgcccgcggcuauauuucuacaagaguggagaugggggaggcugcgggcaucuucaugaccgccacgccgccuggaagccgggaucccuuuccccaguccaacgcuccuauuauggacgaagaaagagaaauccccgagagaagcuggaacucuggccacgaaugggucacagauuucaaggggaaaaccgugugguuuguuccuuccaucaaggccggaaacgacauugccgcuugccugcggaaaaauggcaagaaagugauccagcuuagcagaaagaccuucgauucugaguacgucaagacacgcgccaacgacugggauuuuguggugaccacagacauuagcgagaugggggcgaauuucaaagcugaacgggucaucgauccgagacgcuguaugaagcccguuauucugaccgacggagaggaacgggugauccuggccggcccuaugcccgugacgcauuccucugccgcucaaagacgcgggcggaucggcagaaacccuaaaaaugagaacgaccaguauauuuacaugggagaaccccucgagaaugaugaggacugcgcccacuggaaggaagcgaaaaugcugcuugauaacaucaauacaccggagggcauuaucccuagcauguuugaacccgagcgcgaaaaggucgacgccauugauggggaguacagacugcggggagaggcucgcaaaaccuucguggaccucaugagacggggcgaucugccuguuuggcuggccuauaagguggcugccgaagggaucaacuacgcugaccgcaagugguguuuugauggaauuaaaaauaaccagauccucgaggaaaacauggaggucgagaucuggacaaaggaaggcgagcgcaagaaacuuaaaccccgguggcuggacgccagaauuuauuccgauccucuggcgcucaaggaguucaaggaguucgccgcugggcgcaaaucucugacccuuaaucugaucacggaaaugggccggcuccccaccuuuaugacacagaaggccagaaacgcucuggacaaucuggccgugcuccauaccgccgaggcuggaggccgcgcguacaaccacgcccuuagcgagcugccggaaacacuggagacccuccugcuucugacacuccuggcuaccguuacagggggaauuuuccuguuucucauguccggcaaaagcaucgggaagaugacacuuggaaugugcugcauuaucaccgccucuauccugcuguggcacgcccaaauucagccucauuggaucgcugccuccauuauccucgaguucuuucugauugugcuucugauccccgagcccgaaaaacagcggaccccucaggauaaucaacucacauaugucgugaucgcgauucugaccgucguggccgcuacaauggccaacgagaugggcuuccuggagaagacgaagaaagaccucggccuugggagcaucaccacacaggaauccgagucuaauauucuggacaucgaucugagaccggcuagcgccuggacccucuacgcgguugccacaaccuuugugacgcccaugcugcggcacuccauugaaaacucuagcgugaaugucucccuuaccgcuaucgccaaccaggcuacaguucugaugggacucggcaagggguggccucugagcaaaauggacauuggagugccccuguucgccaucggcuguuauuaccaggugaauccuaucacccucacagcugcccuucugcugcucgucgcgcauaacgccauuaucgggcaaggacugcaggcuaaggccacccgcgaggcucagaaaagagccgccgcgggcauuaugaagaaucccacgguggauggcaucacaguuauugaccuugaaccuaucccguacgaucccaaguuugagaaacagcuggggcaagugaugcuccugauccugugcgucacccaggugcucaugaugcggacaaccugggcucuuugugaggcccugacccuggcuacaggaccuauuucuacgcucugggaaggcaaccccgggcgcuucuggaauaccacaaucgccgucuccauggccaacauuuuuagaggaagcuaucuggcuggcgccgggcuucuguucucuaucaugaagaauaccacauccacccggcgcggaacgggcaacauuggcgagacacucggggaaaaauggaaaagcagacugaacgcgcugggaaaaucugaguuucagaucuacaagaaaagcggcauccaagagguggaccggacccucgccaaggaagggauuaagcgcggagagaccgaucaccaugcuguuuccagaggcucugccaaacuucggugguucguggaaagaaauauggucacaccugaggggaaggugguugaccugggaugcggccgcggcggguggagcuauuacuguggaggccugaaaaacgugcgggaagucaaggggcucaccaaaggaggccccgggcacgaggagccgaucccuauguccacauauggauggaaucuggugagacuucagagcggcguggauguuuucuuuacgccucccgaaaagugcgacacccugcucugugauauuggcgaguccucucccaaccccacaaucgaagcugggcgcacccugcggguccugaaucucguggagaacuggcuuaauaacaauacacaguucugcauuaaggugcugaacccuuacaugccgagcgucaucgagaagauggaggcccugcagagacaauauggaggcgcgcucguucgcaauccccugucccggaacucuacccacgagauguacugggugagcaaugccacggggaacaucguguccucugucaauaugauuagcagaaugcuuaucaaccgcuuuaccaugaagcauaaaaaggcuacauacgaaccugacguggaucugggauccggcacccggaacauugggaucgagaaugaaauucccaaccucgacaucauuggaaaaagaaucgagaagaucaagcaggaacacgagauuagcuggcauuaugaccaggaucacccuuacaaaacaugggccuaucacggcucuuacgagaccaagcagacaggcuccgcuagcucuaugguuaauggggugguccgccugcugaccaaacccugggacgugguuccgauggugacgcaaauggccaugacagauaccaccccuuucggacagcagcgggucuuuaaggaaaaaguggacacaagaacgcaggagcccaaggaaggcaccaagaaacucaugaagaucacagcugaguggcuuuggaaagagcuggggaagaaaaagaccccucgcauguguacaagagaagaguucacccggaaagugcgcuccaacgccgcgcugggagccauuuuuacagaugaaaauaaguggaaaagcgcuagagaggccgucgaagacggccgguucugggagcucguugauagagagcggaaccugcaucuugaagggaaaugcgagaccuguguguauaauaugaugggaaagcgcgagaagaagcugggcgaguuuggcaaagcuaaggggucuagagccaucugguacauguggcucggagcccgguuccuggaauuugaggcgcugggcuuccucaacgaggaccacugguuuucccgcgggaauagccuguccggaguggaaggcgaggggcuucauagacugggcuauauucuccgggaugucggaaagaaagaaggcggggcuauguacgccgacgauacggccggaugggacacccgcaucacacuggaggaccuuaagaacgaagagauggugaccaaucacaugaaaggcgagcauaagaaacuggcugaagccaucuucaagcucacauaccaaaacaagguugugagaguccagcggcccaccccucgcgggacggugauggauauuaucagcagacgggaccagcgcggaucuggccaaguugggacauauggccugaauaccuucacaaacauggaggcucagcugauuagacagauggaaggagagggcaucuuuaaaagcauucagcaccucaccgccacggaggaaaucgcggugcaaaauuggcuggcccgggucgggcgcgagagacuuucccggauggcuaucucuggagaugacugcgugguuaagcccauugaugacagauucgccagcgcucugaccgcccucaacgauaugggcaaagugcgcaaggacauccagcagugggaaccgucccggggguggaacgauuggacacaggucccuuuuugcucucaccauuuccacgagcuggugaugaaagacggaagaguccuugugguucccugucgcaaucaagaugaacugauuggccgggcgagaaucagccagggggccggcuggucccucaaggagaccgcuugccugggaaagucuuacgcccagauguggacacugauguauuuucaucgccgggaccucagacuggcugccaacgcuauuuguagcgccgugcccucccacugggucccuaccagccgcacaaccuggucuauccacgcgaaacaugaguggaugacgacagaagauaugcuugccguguggaaucggguguggauucaggagaacccguggauggaagacaagacccccguugaguccugggaagaggugccuuaccugggcaaaagagaggaccaauggugcgggagccucaucggacugaccucucgcgcuacaugggccaagaauauccagaccgccauuaaccagguccggucccuuaucggcaaugaagaguauacagauuacaugcccagcaugaaaagauuccggagagaagaggaagaggcuggggugcugugguga

SEQ ID NO: 19751 - RNA, 9876 nt, Artificial Sequence
  derived and/or modified CDS sequence (opt5) from DENV-2__EU482626__SS-prME
acagccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugagacaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacauccagggaucuaauuggauucagaaggagacacuggucaccuucaagaacccucaugcuaaaaagcaagacgugguugugcucggcucccaggaaggggccaugcacacggcccugacaggcgcuaccgagauccagaugagcuccggaaaucuucuguuuacaggccaucucaaaugcagacugcggauggauaaacuucaacugaaagggaugucuuacagcauguguaccggaaaguucaagauugucaaagaaaucgcggagacccagcacggcacaaucgugauuagaguccaguaugagggggacggaucccccugcaagauccccuucgaaauuacggaucucgagaaacgccaugugcugggccggcugaucaccguuaacccuauugugacagaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucggggugaucauuaccuggaucggaaugaacagccgguccaccagccugucugugucccuuguucucgucggcguggugacacuguaucugggggccgucgugcaggccgacagcggauguguugugucuuggaagaauaaagaacucaagugcggcuccgggauuuucaucaccgauaacguccacacauggacggagcaguacaaguuucaaccugaaagccccuccaaacuggcuucugccauucagaaggcucaugaggaaggcaucuguggaaucagaagcgugacccgccuugagaaucugauguggaaacagauuacaccggagcucaaccacauccuguccgaaaaugagguuaagcugaccauuaugacaggcgacaucaaagggauuaugcaggccggaaagcggucucuuagaccucaacccacccagcucaaauauagcuggaagacguggggcaaggcgaaaaugcuguccaccgaaagccauaaccagacauuccugaucgaugggccugagaccgccgaaugccccaauacaaaccgcgcuuggaacucucucgagguggaggacuacggauuuggcgucuucaccacaaacaucuggcugaaacuucgggaaaaacaggacguguuuugugauuccaagcugaugagcgccgcuauuaaagacaauagagccguucacgcggauaugggcuauuggaucgagucugcccucaacgacaccuggaagauggaaaaggcuuccuucauugaggugaaaagcugccacuggccuaagucucauacgcuguggagcaaugggguccuggaguccgaaaugaucauucccaaaaacuucgccggaccggugagccaacacaacuaccgcccuggcuaucauacacagaccgcugggcccuggcaccuuggaaagcucgagauggauuuugacuucugugaaggcaccacaguggucguuaccgaggauugcgggaaucggggacccucucugagaacgacaaccgccuccggcaaacugaucacagaauggugcugucggagcugcacccucccuccgcugcgcuacagaggcgaggacggguguugguacggaauggagauucggccccuuaaggaaaaggaggaaaaccuggugaauagccucgugacagccggccaugggcagaucgauaacuuuucucugggaguccugggcauggcucuuuuccucgaggaaaugcugagaacccgcaucgggacgaaacacgcgauucugcucguggccguuagcuuugugacccugaucacaggaaauauguccuuccgggaccuuggcagagucauggugaugguuggcgcuaccaugacagaugacauugggaugggagugaccuaucuggcccuccuggccgcuuuuaagguccgcccuacguucgccgcgggccugcuucugagaaaacucacaucuaaggagcugaugauggcuaccaucgggauugcccuccugagccaauccacaauccccgagaccauccuugaacugaccgaugcccucgcucugggaaugauggugcugaaaauuguucggaacauggagaaguaccagcuugccgugacaaucauggcgauuucuugcgucccuaaugcugugauccugcagaacgccuggaaggugagcuguacgauucucgccgcugucuccguuagcccccugcuccugaccucuucccagcaaaaagccgacuggaucccucuugcucugacaaucaagggccucaaucccaccgccauuuuucugacaacccugagccgcacgucuaaaaagagauccuggccgcuuaacgaagcgaucauggccguggggauggugagcauucuggcuucuucccuccugaaaaaugacaucccuaugacaggaccccucgucgccggcggccugcuuaccgugugcuauguucugaccgggcggagcgcugaucuggagcucgaacgcgccgccgacgugaagugggaggaucaggcugagauuuccggaagcucuccuauccugagcauuacaaucuccgaagacggcucuaugagcaucaaaaacgaggaagaggagcagacccuuacaauucugaucagaacggggcuccuggucauuuccggaguguuccccguuucuaucccgauuaccgcggccgcuugguaccucugggaagugaagaagcagcgggccggcguccugugggaugugccuucucccccucccgucgagaaagccgaacuugaggacggggcuuaucgcaucaagcaaagaggaauccugggcuacucccagauuggcgccgggguguauaaagaaggaacauuucacaccauguggcauguuacacggggcgcggugcugaugcaccgcgggaagagaaucgagcccuccugggcugaugucaaaaaggaccucauuagcuacggaggcggguggaagcuggagggagaauggaaagagggcgaagaggugcagguucuugcccuggaaccuggcaagaauccgcgggccgugcagaccaaacccgggaucuucaagacgaacaccggaacaauuggcgcugucucccucgauuuuagcccugggaccucuggaucccccaucguggacagaaaaggcaaggugguugggcuguacggaaauggcgucgugacacgcagcggcgccuaugugucugcgaucgcucaaaccgagaaguccauugaggauaacccugaaaucgaggacgauauuuuccggaaaaagagacucacaaucauggaccugcaucccggggccggaaaaacgaagcgcuaccuuccugccauuguccgggaagcuaucaaaagaggccugcgcacccugauucucgccccgacacgggugguugcugccgagauggaagaggcgcugagagggcuucccauccgcuaucagaccccugccaucaagaccgagcacacaggacgggaaauuguggaccugaugugucaugcuacguucaccaugagacuccugagccccguccgggugccuaacuacaaucucaucauuauggaugaggcccacuuuacagaccccgcuuccaucgccgcccgcggcuauauuucuaccagaguugaaaugggggaggcugcgggcaucuucaugacagccaccccgccuggaagccgggaucccuuuccccaguccaacgcuccuaucauggacgaggaacgcgagauucccgaaagaagcuggaacucuggccacgagugggugacggauuucaaggggaaaacagucugguuugugccuuccaucaaggccggaaacgacauugccgcuugccugcggaaaaauggcaagaaaguuauccaacuuagcagaaagaccuucgauucugaauacgugaagacccgcgccaacgacugggauuuugucgugacaaccgacauuagcgagaugggggcgaauuucaaagcugagcgggugaucgauccgagacgcuguaugaagcccgucauccugacagacggagaagaacggguuauucuggccggcccuaugcccgugacccauuccucugccgcucagagacgcgggcggaucggcagaaacccuaaaaaugaaaacgaccaguauauuuacaugggagagccccucgaaaaugaugaggacugcgcccacuggaaggaggcgaaaaugcugcuugauaacaucaauacgccggaaggcauuaucccuagcauguuugagcccgaacgcgagaagguggacgccauugauggggaauacagacugcggggagaggcucgcaaaacauucgucgaccucaugagacggggcgaucugccuguguggcuggccuauaagguugcugccgaggggaucaacuacgcugaccgcaagugguguuuugauggaaucaaaaauaaccagauucucgaagagaacauggaaguggagaucuggaccaaggagggcgaacgcaagaaacuuaaaccccgguggcuggacgccagaauuuauuccgauccucuggcgcucaaggaguucaaggaguucgccgcugggcgcaaaucucugacacuuaaucugaucaccgagaugggccggcuccccacguuuaugacccaaaaggccagaaacgcucuggacaaucuggccguccuccauacagccgaagcuggaggccgcgcguacaaccacgcccuuagcgagcugccggagacccuggaaacacuccugcuucugacccuccuggcuacagugaccgggggaauuuuccuguuucucauguccggcaaagggaucggaaagaugacgcuuggcaugugcugcaucauuacagccagcauccugcugugguaugcccagauucagccucacuggaucgcugccucuauuauccucgaguucuuucugaucguucuucugauucccgaacccgagaaacagcggaccccucaagauaaucagcucaccuacguggucaucgcgauucugacaguggucgccgcuaccauggccaacgaaaugggcuuccuggagaagacaaagaaagaccucgggcuuggauccaucacgacccaggagagcgaauccaauauucuggacaucgaucugagaccggcuucugccuggacacucuaugcgguggccaccacauuuguuacccccaugcugcggcauagcauugagaacuccucugugaaugugagccuuacggcuaucgccaaccaggcuaccguccugaugggccucgggaagggauggccucuguccaaaauggacaucggcguuccccugcucgccauuggguguuacagccaagugaauccuaucacacuuaccgcugcccugcugcuccugguggcgcacuacgccauuaucggacccggccuucaggcuaaggccacacgcgaagcucagaaaagagccgccgcgggcauuaugaagaacccuaccgucgaugggaucacggugaucgaccuggagccgauucccuaugauccuaaguucgaaaaacagcucggacaaguuaugcugcugauccucugcgugacacagguccuuaugaugcggaccacaugggcucugugugaggcccugacccucgcuaccggccccauuucuacacugugggaggggaauccuggacgcuuuuggaacacgaccaucgccguguccauggccaauauuuucagaggcagcuaccuugcuggggccggacugcucuuuucuaucaugaagaacacaaccuccacacggcgcggcaccggcaauaucggggaaacgcugggagagaaauggaaaagcagacugaacgcgcucggcaaaucugaguuccagauuuauaagaaaagcgggauccaagaggucgaccggacacuugccaaggagggaauuaagcgcggcgaaaccgaucaucacgcuguguccagagggucugccaaacugcggugguuuguugagagaaacauggugacccccgaaggaaaggucguggaccugggcugcggccgcgggggauggagcuacuauuguggcgggcucaaaaauguucgggaggugaagggacugacaaaaggcgggccgggacaugaagaaccuauccccauguccaccuacggcuggaaccuugucagacugcagagcggcguggauguguucuucacacccccugagaagugcgacacgcuccugugugauauuggggaauccucucccaauccuaccaucgaggcuggacgcacacugcggguucucaaccuugucgaaaauuggcugaacaauaacacccaguuuugcaucaaggugcugaauccguauaugcccagcgugauugagaaaauggaagcccuccagagacaauacggcggggcgcugguccgcaacccucuuuccagaaauucuacacacgagauguacuggguuagcaacgccaccggaaauaucguguccucugugaacaugauuagcagaaugcugaucaaucgcuucacgaugaagcacaaaaaggcuaccuaugagcccgacgucgaucucggcuccgggacacggaacauuggaaucgaaagcgagauuccuaaccuggacaucaucggcaaaagaauugaaaagaucaagcaggagcaugaaauuucuuggcacuacgaccaggaucaucccuauaaaaccugggccuaccacggcuccuaugagacaaagcagaccgggagcgcuucuuccauggugaauggaguugugcgccugcucacaaaaccgugggacgucgugccuaugguuacccaaauggccaugacggauacaacccccuuuggccagcagcggguguucaaggagaaagucgacaccagaacacaggaaccuaaggaggggacgaagaaacuuaugaagaucaccgcugaauggcuguggaaagagcugggaaagaaaaagacaccccgcauguguaccagagaggaauuuaccaagaaggugcggagcaacgccgcgcucggcgccauuuucaccgaugagaauaaguggaaaucugcucgcgaagccguggaggacgggagauuuugggaacuggucgaucgggagagaaaccuucaccuggagggaaagugcgaaacauguguuuacaauaugaugggcaaacgggagaagaaacucggcgaguucgggaaggcuaagggaucccgcgccaucugguauauguggcugggcgccagauuucuggaguucgaagcgcucggguuucugaacgaggaccauugguucagccggggaaauucccuuagcggcguggagggggaaggccugcaccgccucggauacauccugagagaugugggcaaaaaggaagggggagcuauguacgccgacgauaccgccggcugggacacgcggauuacccuugaagaccugaaaaacgaggaaauggucacaaaucauaugaagggggagcacaaaaagcucgcugaggccaucuuuaagcugaccuaucaaaacaaagugguucgcgugcagagaccuacaccccggggaaccgucauggauauuaucucucgcagagaccagcggggcagcgggcaagugggcacguacggacugaauacauucaccaacauggaagcucagcucauucgccagauggagggcgaagggaucuucaaguccauccagcaucugacagccaccgaggagauugcgguucaaaauuggcuugccagagugggacgggaacgccugucuagaauggcuaucagcggcgaugacugcgucgugaaaccgauugaugaccgguuugccuccgcucucacggcccugaacgauauggggaagguuagaaaagacauccagcagugggagccuucucgcggauggaaugauuggacccaggugcccuucugcagccaccacuuucaugaacuugucaugaaggacggccgggugcuggucgugcccuguagaaaccaagaugagcucauugggcgcgcgcggaucucccagggcgccggauggucucugaaggaaacagcuugccugggcaaaagcuaugcccagauguggacccucauguacuuccacagacgcgaccugcggcuugcugccaacgcuauuuguuccgccguuccuagccauugggugccgacaucuagaaccacaugguccauccacgcgaagcacgaguggaugaccacggaggauaugcuggccgucuggaaucgcguguggauccaggaaaaccccuggauggaggacaaaacaccuguggaaagcugggaggaaguucccuaucucgggaagcgggaggaccaauggugcggaucucugauuggccuuaccuccagagcuaccugggccaaaaauauccagacagccauuaaccaggugcgcagccugaucgggaaugaggaauacaccgauuauaugccuuccaugaagcgguuuagacgggaggaagaggaagcuggaguccucugguga

SEQ ID NO: 19752 - RNA, 9876 nt, Artificial Sequence
  derived and/or modified CDS sequence (opt5) from DENV-2__EU482629__SS-prME
accgccggagugaucgugaugcugauucccacagcuauggccuuccaccucacgaccagaaauggggagccucauaugaucguuggacggcaggaaaagggcaaaagccugcuuuuuaagaccgaggacggggugaauaugugcacccugauggcgauugaucucggagaacugugugaggacacaaucaccuacaaaugcccccuucugcgccaaaaugaacccgaggauauugacuguuggugcaauagcacaucuaccugggugacguauggcaccuguacaaccacaggggagcacagacgggaaaagcgcagcguugcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucaucggcgucgagcccggacagcucaaacugaauugguucaagaagggcuccagcauugggcaaauguuugagacaaccaugagaggagcuaaacgcauggccauccuuggcgacacggccugggauuucgggucucugggaggcguguuuacaagcauugggaaggcucuccaccagguuuucggcgccaucuacggagcggcuuuuuccggcgugucuuggaccaugaaaauucugaucggggucaucauuaccuggaucggaaugaacagccgguccacaagccugucugugucccuugugcucguuggcgucgugacccuguaucugggggccauggugcaggccgacagcggaugugucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguggaagacuacggauuuggcguuuucacaaccaacaucuggcugaaacuuagagagaagcaggacguguuuugugauuccaaacugaugagcgccgcuauuaaggacaaucgcgccguccacgcggauaugggcuauuggaucgaaucugcccucaacgacacguggaaaauggagaaggcuuccuucauugaggucaagagcugccacuggccuaaaucucauacacuguggagcaaugggguucuggaauccgagaugaucauucccaagaacuucgccggaccggugagccagcacaacuaccggccuggcuaucauacccaaaccgcugggcccuggcaccuuggaaaacucgaaauggauuuugaccugugugagggcacaaccgucguggugacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucgucaauucccugguuaccgccggccaugggcagaucgauaacuucucucugggagugcuuggcauggcucucuuucuggaagagaugcugcgcacgcggaucgggaccaagcacgcgauucuccugguggccgucagcuucgugacacuuaucaccggaaauauguccuuuaaagaccugggcagaguuauggugaugaugggcgcuacaaugaccgaugacauugggaugggagucacguaucucgcccugcuggccgcuuucaaggugcgcccuacauuugccgcgggccuucugcucagaaaacugaccucuaaggagcucaugauggcuacaaucgggauugcccugcuuagccaguccaccauccccgaaaccauccuggagcucacagaugcccuggcucugggaaugaugguucuuaaaauugugcggaacauggaaaaguaccaacuggccgucacgaucauggcgauuucuugcgugccuaaugcuguuauccuccagaacgccuggaaggugagcuguaccauucuggccgcugucuccgugagcccccuccugcuuacaucuucccagcagaaagccgacuggaucccucuggcucucaccaucaagggccugaaucccacagccauuuuccugaccacgcuuagccgcacaucuaaaaagagauccuggccgcugaacgaggcgaucauggccguggggauggucagcauucucgcuucuucccugcucaaaaaugacaucccuaugaccggaccccugguugccggcggccuucugaccgugugcuaugugcugacagggcggagcgcugaucucgaacuggagcgcgccgccgacgucaagugggaggaucaagcugaaauuuccggaagcucuccuauccuuagcauuaccaucuccgaggacggcucuaugagcaucaaaaacgaagaggaggaacagacacugacgauucucaucagaaccgggcugcucgugauuuccggaguuuuucccgugucuaucccgauuacagcggccgcuugguaccugugggaggucaagaagcagcgggccggcgugcuuugggauguuccuucucccccucccguggaaaaagccgagcuggaagacggggcuuaucgcaucaagcagagaggaauccugggcuacucccaaauuggcgccggggucuauaaagagggaaccuuccacacaauguggcaugugacccggggcgcgguccucaugcaccgcgggaagagaaucgagcccuccugggcugaugugaaaaaggaccugauuagcuacggaggcggguggaaacuugaaggagaguggaaagaaggcgaggaaguucaggugcuggcccucgagccuggcaagaauccgcgggccguccagacgaaacccgggaucuuuaagaccaacacaggaaccauuggcgcugugucccuggauuucagcccugggacaucuggaucccccaucguugacagaaaaggcaagguggucgggcucuacggaaauggcguggugacccgcagcggcgccuauguuucugcgaucgcucagacagagaaguccauugaagauaacccugagaucgaagacgauauuuuucggaaaaagagacugacgaucauggaccuucaucccggggccggaaaaaccaagcgcuaccugccugccauuguccgggaggcuaucaaaagaggccugcgcacacucauucuggccccgacccgggugguggcugccgaaauggaggaggcgcuuagagggcugcccauccgcuaucaaaccacagccaucaagacggaacacaccggacgggagauugucgaccucaugugucaugcuacauucaccaugagacugcucagcccugugcggguucccaacuacaaucugaucauuauggaugaagcccacuucacagacccugcuuccaucgccgcccgcggcuauauuucuaccagaguggagaugggggaggcugcgggcaucuuuaugacggccacacccccgggaagccgggauccuuucccccaguccaacgcucccaucauggacgaagagagagaaauuccugagagaagcuggaacucuggccacgaaugggucaccgauuuuaaggggaaaaccgugugguucguucccuccaucaaggccggaaacgacauugccgcuugccuucggaaaaauggcaagaaagugauccagcugagcagaaagacauuugauucugaguacgucaagacccgcgccaacgacugggauuucgugguuacaaccgacauuagcgagaugggggcgaauuuuaaagcugaacgggugaucgauccuagacgcuguaugaagccggucauccugacggacggagaggaacgggugauucucgccggccccaugccugugacacauuccucugccgcucaaagacgcgggcggaucggcagaaaccccaaaaaugagaacgaccaguauauuuacaugggagaaccucuggagaaugaugaggacugcgcccacuggaaggaagcgaaaaugcuucuggauaacaucaauacccccgagggcauuaucccgagcauguucgaaccugagcgcgaaaaggucgacgccauugauggggaguacagacuccggggagaggcucgcaaaacauuuguugaccugaugagacggggcgaucugcccguguggcucgccuauaagguggcugccgaagggaucaacuacgcugaccgcaagugguguuucgauggaaucaaaaauaaccagauucuugaggaaaacauggaggucgagaucuggaccaaggaaggcgagcgcaagaagcugaaaccucgguggcuggacgccagaauuuauuccgauccccucgcgcugaaggaauuuaaggaguucgccgcugggcgcaaaucucuuacgcugaaucucaucaccgaaaugggccggcugccuacauucaugacccagaaggccagaaacgcucuggacaaucucgccgugcuucauacagccgaggcuggaggccgcgcguacaaccacgcccugagcgagcugcccgaaacccucgagacacugcuucugcucacccugcuggcuacgguuacagggggaauuuuucucuuccuuauguccggcaaagggaucggaaagaugacccugggcaugugcugcaucauuaccgccagcauccugcucugguaugcccaaauucagccgcacuggaucgcugccucuauuauccuggaauuuuuccuuaucgugcugcucauuccugagcccgaaaaacagcggacaccccaggauaaucaacugaccuacgucgugaucgcgauucugacaguuguggccgcuacgauggccaacgagaugggcuuucucgagaagaccaagaaagaccuugggcugggauccaucacaacccaggaaagcgaguccaauauucuggacaucgaucucagaccugcuucugccuggacacuguaugcggucgccaccacguucauuaccccgaugcuucggcauagcaucgaaaacuccucugugaaugucagccugacagcuaucgccaaccaggcuaccgugcucaugggccuggggaagggauggccccuguccaaaauggacauuggcguuccucuccuugccaucggguguuacagccaggugaaucccauuacacugaccgcugcccugcuccugcuuguggcgcacuacgccaucauuggaccuggccugcaagcuaaggccacgcgcgaggcucagaaaagagccgccgcgggcaucaugaagaaccccacagucgaugggaucaccguuauugaccucgaaccuaucccguaugaucccaaguuugagaaacagcugggacaggugaugcugcucauucuuugcgugacacaaguccugaugaugcggaccaccugggcucugugugaggcccucacacuggcuacgggcccuaucucuacccuuugggaagggaaucccggacgcuucuggaacacaaccauugccguguccauggccaauaucuuuagaggcagcuaccuggcuggggccggacuccuguucucuaucaugaagaacacaaccaauacgcggcgcggcacaggcaacauuggggagacccugggagaaaaauggaaguccagacucaacgcgcuuggcaaaagcgaguuucagaucuauaagaaaucugggauucaggagguugaccggacccuggccaaggaaggaaucaagcgcggcgagacagaucaucacgcugugagcagaggguccgccaaacugcggugguucgucgaaagaaauauggugaccccugagggaaaggucguggaccucggcugcggccgcgggggauggucuuacuauuguggcgggcugaaaaacguucgggaagugaagggacuuacaaaaggcgggcccggacaugaggagccgauuccuaugagcacguacggcuggaaucuggucagacuccaauccggcguggaugucuuuuucacaccgcccgaaaagugcgacacacugcugugugauaucggggagagcuccccuaaccccaccaucgaagcuggacgcacacuccgggugcuuaaucuggucgagaacuggcugaauaacaauacccaguucugcauuaaggugcucaacccuuauaugccgucugugaucgagaagauggaggcccugcagagaaaguacggcggggcgcuuguucgcaauccccugagccggaacuccacgcacgagauguacugggucucuaaugccaccggaaacauugugagcuccgugaauaugaucucuagaaugcucauuaaccgcuuuacaaugaaacacaagaaagcuaccuaugaaccugacgucgaucugggcagcgggacacggaacaucggaauugaguccgaaauccccaaucuggacaucauuggcaagagaaucgagaagauuaaacaggaacaugagaccagcuggcacuacgaccaagaucauccuuauaagacaugggccuaccacggcucuuaugagaccaaacagacgggguccgcuagcucuaugguuaacggaguggugcgccuccuuacaaagcccugggacgucgugccgaugguuacccagauggccaugaccgauacaacgccuuucggccagcaacggguguuuaaagaaaaggucgacaccagaacacaggagcccaaggaagggaccaaaaagcugaugaaaaucacagcugaguggcuguggaaggagcucggcaaaaagaaaaccccucgcauguguacaagagaagaguucacccggaaggugcgcuccaaugccgcgcugggcgccauuuuuacggaugaaaacaaguggaaaagcgcuagagaggccguugaagacgggcgguucugggagcuuguggauagagagcggaaucugcaccucgaaggaaagugcgagaccugugucuacaacaugaugggcaaacgcgaaaagaaacugggcgaguuugggaaggcuaagggaucuagagccaucugguauauguggcugggcgcccgguuccucgaauuugaggcgcugggguuccuuaaugaggaccauugguuuucccgcggaaacagccuguccggcguggaaggggagggccuccacagacugggauacauccuucgggaugugggcaaaaaggaagggggagcuauguacgccgacgauacagccggcugggacacccgcauuacacuggaggaccucaaaaaugaagagauggucaccaaccauaugaagggggagcacaaaaagcuggcugaagccaucuucaagcugacguaucagaauaaaguugugagagugcagcggcccacaccucgcggaaccgucauggauauuaucagcagacgggaccaacgcggcucuggacaggugggcacauacggacucaacaccuuuacgaauauggaggcucagcugauuagacaaauggaaggcgaggggaucuucaagagcauccagcaucuuaccgccacagaggaaauugcgguucagaacuggcuggcccgggugggacgcgagagacucucccggauggcuaucucuggcgaugacugcgucgugaaacccauugaugacagauucgccagcgcucugaccgcccuuaaugauauggggaagauccgcaaagacauucagcaaugggaaccgucccggggauggaacgauuggacacagguuccuuuuugcucucaccacuuccaugagcuggugaugaaggacggcagaguccucgugguucccugucgcaaccaggaugaacugaucgggcgggcgagaauuagccagggcgccggauggucccugaaggagaccgcuugccucggcaaaucuuaugcccaaauguggacacugauguacuuucaccgccgggaccuuagacuggcugccaaugcuaucuguagcgccgugcccucccauugggucccuaccagccgcacgacauggucuauccacgcgaagcacgaguggaugaccaccgaagauaugcucgccguguggaaccgggucuggauucaggagaauccguggauggaagacaaaacacccguggaguccugggaagagguuccuuaucuggggaagagagaggaccaguggugcggaagccuuaucggccugaccucucgcgcuacaugggccaaaaacauucagacggccaucaaucaagugcggucccucauugggaacgaagaguacaccgauuauaugcccagcaugaagagauuccggagagaagaggaagaggcuggaguccugugguga

SEQ ID NO: 19753 - RNA, 9876 nt, Artificial Sequence
  derived and/or modified CDS sequence (opt5) from DENV-2__FJ390390__SS-prME
accgccggagugaucgucaugcugauucccacagcuauggccuuccaccucacgaccagaaauggggagccucauaugaucguuggacggcaggaaaagggaaaaagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauagcacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccaaauuuacgugcaagaaaaauauggaagggaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugcagacugcggauggauaaacuucaacugaaggggaugucuuacagcauguguaccggaaaguucaaaaucgucaaggaaauugcggagacacagcacggcacgaucgugaucagaguccaguaugagggggacggaucccccugcaaaauucccuucgaaaucaccgaucucgagaagcgccaugugcugggccggcugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugagaggagcuaagcgcauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgguccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaaucagaagcgucacacgccuugagaaucugauguggaagcagaucaccccggagcucaaccacauucuguccgaaaaugaggugaaacugacaaucaugaccggcgacauucgggggaucaugcaggccggaaagagaucucuucgcccucaacccacggaacucaaauauagcuggaagaccuggggcaaggcgaaaaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagacaaacaggaugucuuuugugacuccaagcugaugagcgccgcuaucaaagauaaucgcgccgugcacgcggacaugggcuauuggauugagucugcccucaacgauacguggaagauggaaaaggcuuccuucaucgagguuaaaagcugccacuggccuaagucucauacacuguggagcaauggggugcuggaguccgaaaugauuauccccaaaaacuucgccggaccggucagccagcacaacuaccggccuggcuaucauacccaaaccgcugggcccuggcaccuuggaaagcucgagauggacuuugaucugugugaaggcacaaccgugguggucacggaggacugcgggaauagaggacccucucugcggacaaccacagccuccggcaaacucauuaccgaauggugcugucgcagcugcacacugccuccgcuuagauaccggggcgaggauggguguugguacggaauggagaucagaccccugaaggaaaaggaggaaaaccucguuaauucccuggugaccgccggccaugggcagauugacaacuucucucugggagugcuuggcauggcucuccugcuggaggaaaugcuccgcacgcggaucgggaccaaacacgcgauccugcuugucgccgugagcuuuguuacacugauuaccggaaauauguccuucagagaucucggccgcgugauggucauggugggcgcuacaaugaccgacgauaucgggaugggaguuacguaucuggcccugcuugccgcuuuuaaggugagaccuacauucgccgcgggccugcuccugcggaaacucaccucuaaggagcugaugauggcuacaauugggaucgcccuucugagccaguccaccauucccgagaccauccucgaacugacagacgcccuggcucuuggaaugaugguccugaaaaucgugcgcaacauggagaaguaccaacucgccguuacggugauggcgauuucuugcgucccuaaugcugugauccugcagaacgccuggaaggugagcuguaccauucucgccgcugucuccguuagcccccugcuucugacaucuucccagcagaaagccgacuggaucccucucgcucugaccauuaagggccugaaucccacagccaucuuucuuaccacgcugagcagaacaucuaaaaagcgguccuggccgcucaacgaagcgaucauggccguggggauggugagcauucuggcuucuucccuccugaaaaaugauaucccuaugaccggaccccuugucgccggcggccugcugaccgugugcuauguucucacagggcgcagcgcugaccuggagcuugaaagagccgccgaugugaagugggaggaccaagcugagauuuccggaagcucuccuauccugagcauuaccaucuccgaagauggcucuaugagcauuaaaaacgaggaagaggagcagacacucacgauccugauccggaccgggcuccuggucauuuccggaguguuccccguuucuaucccgauuacagcggccgcuugguaccuuugggaagugaagaagcagcgcgccggcguccugugggacgugccuucucccccucccgucgagaaagccgaacuggaggauggggcuuauagaaucaagcagcggggcauucucggcuacucccaaaucggcgccgggguguauaaagaaggaaccuuucacacaauguggcauguuacccgcggcgcggugcugaugcacagagggaagcggaucgagcccuccugggcugacgucaaaaaggaucuuauuagcuacggaggcggguggaagcuggagggagaauggaaagagggcgaagaggugcagguucucgcccuggaaccuggcaagaauccgagagccgugcagacgaaacccgggaucuucaagaccaacacaggaaccauuggcgcugucucccucgacuuuagcccugggacaucuggaucccccaucguggaucgcaaaggcaaggugguugggcuguacggaaauggcgucgugacccggagcggcgccuaugugucugcgauugcucagacagagaaguccaucgaggacaacccugaaaucgaggaugacauuuuccgcaagaagcgccuuacgaucauggaccugcaucccggggccggaaaaaccaagcgguaccugccugccauugucagagaagcuaucaaacgcggccuccggacacugauucuugccccgaccagagugguugcugccgagauggaagaggcgcugcgcgggcuccccauccgguaucaaaccacagccauuaagacggagcacaccggaagagaaaucguggaucugaugugucaugcuacauuuaccaugcggcuccugagcccuguccgcgugcccaacuacaaucuuaucauuauggacgaggcccacuucacagauccugcuuccaucgccgccagaggcuauauuucuacccggguugaaaugggggaggcugcgggcaucuucaugacggccacacccccgggaagccgcgacccuuuuccccaguccaacgcucccauuauggaugaggaaagagagaucccugaacggagcuggaacucuggccacgagugggugaccgacuucaaggggaaaaccgucugguuugugcccuccaucaaggccggaaacgauauugccgcuugccugcgcaagaauggcaagaaaguuauccagcugagccgcaagacauucgacucugaauacgugaagacccgggccaacgauugggacuuugucgugacaaccgauauuagcgagaugggggcgaauuucaaagcugagagagugaucgacccucgccgguguaugaagccggucauucucacggacggagaagagagaguuauccuggccggccccaugccugugacacauuccucugccgcucaacgccgggggagaaucggccgcaaccccaaaaaugaaaacgaucaguauauuuacaugggagagccucuugaaaaugacgaggauugcgcccacuggaaggaggcgaaaaugcugcucgacaacaucaauacccccgaaggcauuaucccgagcauguuugagccugaaagagagaagguggaugccauugacggggaauaccggcugcgcggagaggcuagaaaaacauucgucgaucugaugcggcgcggcgaccuccccguguggcuugccuauaagguugcugccgaggggaucaacuacgcugauagaaagugguguuuugacggaauuaaaaauaaccagauccuggaagagaacauggaaguggagaucuggaccaaggagggcgaacggaaaaagcugaaaccuagauggcucgaugcccgcauuuauuccgacccccuggcgcuuaaggaguucaaggaauuugccgcugggcggaaaucucugacgcucaaucugaucaccgagaugggcagacugccuacauucaugacccagaaggcccgcaacgcucucgauaaucuugccguccugcauacagccgaagcuggaggccgggcguacaaccacgcccugagcgagcuccccgagacccuggaaacacuucugcuccugacccugcucgcuacggugacagggggaauuuuccuuuuucugauguccggcaaagggaucggaaagaugacccugggcaugugcugcauuaucaccgccagcauccuccugugguaugcccaaauucagccgcacuggaucgcugccucuauuauccuugaguucuuucugauuguucuccugaucccugaacccgagaaacagagaacaccccaggacaaucaacugaccuacguggucaucgcgauucucacaguggucgccgcuacgauggccaacgaaaugggcuuccuugagaagaccaagaaagaccuggggcugggauccaucacaacccaggagagcgaauccaauauucucgauaucgaccugcggccugcuucugccuggacacuuuaugcgguggccaccacguuuguuaccccgaugcugcgccauagcauugagaacuccucugugaaugugagccucacagcuaucgccaaccaggcuaccguccugaugggccuggggaagggauggccccucuccaaaauggauauuggcguuccucuucuggccaucggguguuacagccaggugaaucccaucacacugaccgcugcccuccugcuucugguggcgcacuacgccauuaucggaccuggccuccaagcuaaggccacgagagaagcucagaaacgggccgccgcgggcauuaugaagaaccccacagucgacgggaucaccgugauugaucuggagccuaucccguaugaccccaaguucgaaaaacagcugggacagguuaugcuccuuauccugugcgugacacaaguccugaugaugcgcaccaccugggcucucugugaggcccugacacuugcuacgggcccuauuucuacccugugggaggggaaucccggaagauuuuggaacacaaccaucgccguguccauggccaauauuuuccggggcagcuaccucgcuggggccggacugcuguuuucuaucaugaagaacacaaccaauacgcgcagaggcacaggcaacauuggggaaacccucggagagaaauggaagucccggcuuaacgcgcugggcaaaagcgaguuccagaucuauaagaaaucugggauccaggaggucgaucgcacccuggccaaggagggaauuaagagaggcgaaacagaccaucacgcugugagccggggguccgccaaacucagaugguuuguugagcgcaauauggugaccccugaaggaaaggucguggaucugggcugcggcagagggggauggucuuacuauuguggcgggcuuaaaaacguucgggaggugaagggacugacaaaaggcgggcccggacaugaagaaccgaucccuaugagcacguacggcuggaaucucguccgccugcaauccggcguggacguguucuuuaccccucccgagaagugcgauacacugcucugugacauuggggaaagcucccccaaccccaccaucgaggcuggacggacacuuagaguucugaaucuggucgaaaacuggcucaauaacaauacccaguucugcauuaaggugcugaacccuuauaugccgucugugaucgagaaaauggaagcccuucagcgcaaguacggcggggcgcugguccggaauccccucagcagaaacuccacgcacgagauguacuggguuucuaaugccaccggaaacaucgugagcuccgugaauaugauuucucgcaugcugaucaaccgguucacaaugaaacacaagaaagcuaccuaugagccugaugucgaccugggcagcgggacaagaaacauuggaaucgaauccgagauucccaaucucgacaucauuggcaagcgcaucgaaaagaucaaacaggagcaugaaaccagcuggcacuacgaucaagaccauccuuauaagacaugggccuaccacggcucuuaugagaccaaacagacgggguccgcuagcucuauggugaacggaguugugcggcuucugacaaagcccugggaugucgugccgaugguuacccagauggccaugaccgacacaacgccuuuuggccagcaaagaguguucaaagagaaggucgauacccgcacacaggaacccaaggaggggaccaaaaagcugaugaaaauuacagcugaauggcucuggaaggagcugggcaaaaagaaaaccccuagaauguguacacgggaggaauuuacccgcaaggugagauccaaugccgcgcuuggcgccaucuucacggacgagaacaaguggaaaagcgcucgggaagccguggaggaugggagauuuugggaacuggucgaccgggagcgcaaucuccaccuggagggaaagugcgaaaccuguguuuacaacaugaugggcaaaagagagaagaaacugggcgaguucgggaaggcuaagggaucucgggccauuugguauauguggcucggcgcccgcuuucuggaguucgaagcgcuuggguuucugaaugaggaucauugguucuccagaggaaacagccucuccggcguggagggggaaggccugcaccggcuuggauacauccugcgcgacgugggcaaaaaggaagggggagcuauguacgccgaugacacagccggcugggacaccagaauuacacucgaagaucugaaaaaugaggaaauggucaccaaccauaugaagggggagcacaaaaagcuggcugaggccaucuuuaagcucacguaucagaauaaagugguucgggugcagcgccccacaccuagaggaaccgucauggacaucauuagccggcgcgaucaaagaggcucuggacaggugggcacauacggacugaacaccuucacgaauauggaagcucagcuuauccggcaaauggagggcgaagggauuuuuaagagcauccagcaucugaccgccacagaggagauugcgguucagaacuggcucgcccgcgugggaagagaacggcuguccagaauggcuaucucuggcgacgauugcgucgugaaacccaucgacgaucgcuucgccagcgcucuuaccgcccugaaugacauggggaagguucggaaagauauucagcaaugggagccguccagaggauggaacgacuggacacaggugccuuucugcucucaccacuuucaugaacucgucaugaaggauggccgcgugcuggucgugcccugucggaaccaggacgagcugaucgggagagcgcgcauuagccagggcgccggauggucccucaaggaaaccgcuugccugggcaaaucuuaugcccaaauguggacacuuauguacuuccaccggagagaucugcgccucgcugccaaugcuaucuguagcgccguucccucccauugggugccuaccagccggacgacauggucuauucacgcgaagcacgaguggaugaccaccgaggacaugcuggccgucuggaacagaguguggauccaggaaaauccguggauggaggacaaaacacccguggaauccugggaggaaguuccuuaucuugggaagcgcgaggaucaguggugcggaagccugauuggccucaccucucgggcuacaugggccaaaaacauccagacggccaucaaucaagugagaucccugauugggaacgaggaauacaccgacuauaugcccagcaugaagcgguuuagacgcgaggaagaggaagcuggaguccugugguga

SEQ ID NO: 19754 - RNA, 9876 nt, Artificial Sequence
  derived and/or modified CDS sequence (opt5) from DENV-2__FJ390391__SS-prME
accgccggcgugaucgucaugcugauucccaccgcuauggccuuccaccucacgacccggaauggggagccucauaugaucguuggacggcaggaaaagggcaagagccugcuuuuuaagaccgaggacggggugaauaugugcacccugauggcgauugaucucggagaacugugugaggacacgaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccaucuuugagcuuacagaugcccuggcucucggaaugauggugcugaaaaucguucggaacauggaaaaguaccaacuggccgugacgauuauggcgaucucuugcgucccuaaugcugugauucuucagaacgccuggaaggugagcuguaccauccuggccgcugucuccguuagcccccuccugcucacaucuucccagcagaaagccgacuggauuccucuggcucuuaccaucaagggccugaaucccacagccaucuuccucaccacgcugagccgcacaucuaaaaagagauccuggccgcugaacgaggcgauuauggccguggggauggugagcauccuugcuucuucccugcucaaaaaugacauuccuaugaccggaccccuggucgccggcggccuccugaccgugugcuauguucuuacagggcggagcgcugaucuggaacuggagcgcgccgccgacgugaagugggaggaucaagcugaaaucuccggaagcucuccuauucucagcaucaccauuuccgaggacggcucuaugagcaucaaaaacgaagaggaggaacagacacugacgauccuuauuagaaccgggcugcucgucaucuccggaguguuucccguuucuauuccgaucacagcggccgcuugguaccugugggaggugaagaagcagcgggccggcguccucugggaugugccuucucccccucccgucgaaaaagccgagcuggaagacggggcuuaucgcauuaagcagagaggaauccuuggcuacucccaaaucggcgccgggguguauaaagagggaaccuuccacacaauguggcauguuacccggggcgcggugcugaugcaccgcgggaagagaauugagcccuccugggcugaugucaaaaaggaccugaucagcuacggaggcggguggaagcucgaaggagaguggaaagaaggcgaggaagugcagguucuggcccuugagccuggcaagaauccgcgggccgugcagacgaaacccgggauuuuuaagaccaacacaggaaccaucggcgcugucucccuggauuucagcccugggacaucuggaucccccauuguggacagaaaaggcaaggugguugggcucuacggaaauggcgucgugacccgcagcggcgccuaugugucugcgaucgcucagacagagaaguccaucgaagauaacccugagauugaagacgauaucuuccggaaaaagagacugacgauuauggaccuccaucccggggccggaaaaaccaagcgcuaccugccugccaucguccgggaggcuauuaaaagaggccuucgcacacugauccuggccccgacccgggugguugcugccgaaauggaggaggcgcucagagggcugcccauucgcuaucaaaccccugccaucaagacagaacacacgggacgggagaucguggaccuuaugugucaugcuaccuuuacaaugagacugcucagccccguccgggugccuaacuacaaucugauuaucauggaugaagcccacuucaccgaccccgcuuccauugccgcccgcggcuauaucucuacaagaguugagaugggggaggcugcgggcauuuuuaugaccgccacgccgccuggaagccgggaucccuucccccaguccaacgcuccuaucauggacgaagaaagagaaauccccgagagaagcuggaacucuggccacgaaugggugacagauuuuaaggggaaaaccgucugguucgugccuuccauuaaggccggaaacgacaucgccgcuugccuccggaaaaauggcaagaaaguuauucagcugagcagaaagaccuuugauucugaguacgugaagacacgcgccaacgacugggauuucgucgugaccacagacaucagcgagaugggggcgaauuuuaaagcugaacgggugauugauccgagacgcuguaugaagcccgucauccuuaccgacggagaggaacggguuauccuggccggcccuaugcccgugacgcauuccucugccgcucaaagacgcgggcggauuggcagaaacccuaaaaaugagaacgaccaguauaucuacaugggagaaccccuggagaaugaugaggacugcgcccacuggaaggaagcgaaaaugcuccuggauaacauuaauacaccggagggcaucauuccuagcauguucgaacccgagcgcgaaaagguggacgccaucgauggggaguacagacuucggggagaggcucgcaaaaccuuugucgaccugaugagacggggcgaucucccuguguggcuggccuauaagguugcugccgaagggauuaacuacgcugaccgcaagugguguuucgauggaaucaaaaauaaccagauccuggaggaaaacauggagguggagauuuggacaaaggaaggcgagcgcaagaagcucaaaccccgguggcuugacgccagaaucuauuccgauccucuggcgcugaaggaguucaaggaguuugccgcugggcgcaaaucucucacccugaaucuuauuacggaaaugggccggcugcccaccuucaugacacagaaggccagaaacgcucucgacaaucuggccguccugcauaccgccgaggcuggaggccgcgcguacaaccacgcccucagcgagcuuccggaaacacuggagacccugcuccugcuuacacugcucgcuaccgugacagggggaaucuuucuguuccugauguccggcaaagggauuggaaagaugacacucggcaugugcugcaucaucaccgccagcauucuucugugguaugcccaaauccagccucacuggauugcugccucuaucauucuggaauuuuuccucaucguucugcuuauccccgagcccgaaaaacagcggaccccucaggauaaucaacugacauacguggucauugcgauccucaccguggucgccgcuacaauggccaacgagaugggcuuucuggagaagacgaagaaagaccuggggcucggauccauuaccacacaggaaagcgaguccaauauccuugacauugaucugagaccggcuucugccuggacccuguaugcgguggccacaaccuucguuacgcccaugcuccggcauagcaucgaaaacuccucugugaaugugagccugaccgcuauugccaaccaggcuacaguccuuaugggccuggggaagggauggccucucuccaaaauggacaucggcguuccccugcuggccaucggguguuacagccaggugaauccuauuacccucacagcugcccuucugcugcucguggcgcacuacgccaucauuggacccggccugcaagcuaaggccacccgcgaggcucagaaaagagccgccgcgggcaucaugaagaacccuacggucgaugggauuacagugaucgaccuugaaccgauccccuaugauccuaaguuugagaaacagcugggacagguuaugcuccugauucugugcgugacccaaguccucaugaugcggacaaccugggcucuuugugaggcccugacccuggcuacaggccccaucucuacgcucugggaagggaauccuggacgcuucuggaacaccacaauugccguguccauggccaauaucuuuagaggcagcuaccuggcuggggccggacuucuguucucuauuaugaagaacaccacauccacccggcgcggcacgggcaauaucggggagacacucggagaaaaauggaaaagcagacugaacgcgcugggcaaaucugaguuucagaucuauaagaaaagcgggauucaggaggucgaccggacccucgccaaggaaggaaucaagcgcggcgagaccgaucaucacgcuguguccagagggucugccaaacuucggugguucguugaaagaaacauggugacacccgagggaaaggucguggaccugggcugcggccgcgggggauggagcuacuauuguggcgggcugaaaaauguucgggaagugaagggacucaccaaaggcgggccgggacaugaggagccuauucccauguccacauacggcuggaaccuggucagacuucaaagcggcguggauguguucuuuacgcccccugaaaagugcgacacccugcucugugauaucggggaguccucucccaauccuacaauugaagcuggacgcacccugcggguucugaaccucgucgagaauuggcuuaacaauaacacacaguucugcaucaaggugcugaauccguauaugcccagcgugaucgagaagauggaggcccugcagagacaguacggcggggcgcucguccgcaacccucuguccagaaauucuacccacgagauguacuggguuagcaacgccacgggaaauauuguguccucugugaacaugaucagcagaaugcuuauuaaucgcuuuaccaugaagcacaaaaaggcuacauaugaacccgacgucgaucugggcuccgggacccggaacaucggaauugagaacgaaaucccuaaucucgacauuaucggcaaaagaaucgagaagauuaagcaagaacaugagaucagcuggcacuacgaccaggaucaucccuauaaaacaugggccuaccacggcucuuaugagaccaagcagacaggguccgcuagcucuauggugaacggaguugugcgccugcugaccaaaccgugggacgucgugccuaugguuacgcagauggccaugacagauaccacccccuucggccaacagcggguguuuaaggaaaaagucgacacaagaacgcaggagccuaaggaagggaccaagaaacucaugaagauuacagcugaguggcuuuggaaagagcugggaaagaaaaagacaccccgcauguguacaagagaagaguucaccaaaaaggugcgguccaaugccgcgcugggcgccaucuuuacagaugaaaacaaguggaaaagcgcucgcgaggccguggaagacgggagauucugggagcucgucgaucgggagagaaaucugcaccuugaaggaaagugcgagaccuguguuuacaacaugaugggcaaacgggaaaagaaacugggcgaguuugggaaggcuaagggaucucgcgccauuugguauauguggcucggcgccagauuccuggaauuugaggcgcugggguuccucaaugaggaccauugguuuucccggggaaacagccuguccggcguggaaggggagggccuucaccgccugggauacauccucagagaugugggcaaaaaggaagggggagcuauguacgccgacgauacggccggcugggacacccggaucacacuggaggaccuuaaaaaugaagagauggucaccaaccauaugaagggggagcacaaaaagcuggcugaagccauuuucaagcucacauaucagaauaaagugguucgcgugcaaagaccuacaccccggggaacggucauggauaucauuagccgcagagaccagcggggcucuggacaggugggcacauacggacugaacaccuucacaaauauggaggcucaacugauccgccagauggaaggcgaggggauuuuuaagagcauccagcaucucaccgccacggaggaaaucgcgguucagaacuggcuggccagagugggacgggagcgccuuuccagaauggcuauuucuggcgaugacugcgucgugaaaccgaucgaugaccgguucgccagcgcucugaccgcccucaaugauauggggaagguuagaaaagacauucaacagugggaaccuucccgcggauggaacgauuggacacaggugcccuuuugcucucaccacuuccaugagcuggucaugaaggacggccgggugcuugucgugcccuguagaaaccaggaugaacugaucgggcgcgcgcggauuagccaaggcgccggauggucccucaaggagaccgcuugccugggcaaaucuuaugcccagauguggacacugauguacuuucacagacgcgaccuccggcuggcugccaaugcuaucuguagcgccguuccuucccauugggugccgaccagcagaacaaccuggucuauucacgcgaagcacgaguggaugacgacagaagauaugcuugccgucuggaaccgcguguggauccaggagaaucccuggauggaagacaaaaccccuguggaguccugggaagagguucccuaucuggggaagcgggaggaccaguggugcggaagccucaucggccugaccucuagagcuacaugggccaaaaacauucaaaccgccaucaaucaggugcgcucccuuauugggaacgaagaguacacagauuauaugccuagcaugaagcgguucagacgggaagaggaagaggcuggaguccugugguga

SEQ ID NO: 19755 - RNA, 9876 nt, Artificial Sequence
  derived and/or modified CDS sequence (opt5) from DENV-2__FJ882593__SS-prME
accgccggagugaucgucaugcugauucccaccgcuauggccuuccaccugacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacaggagucuaauuggauccagaaggaaacccuggucacguucaagaacccucaugcuaaaaagcaagacgugguugugcucggaucccaggagggcgccaugcacacagcccugaccggggcuacagaaauucagaugagcuccggcaaucuucuguuuaccggacaucucaaaugcagacugcggauggauaaacuucaacugaaaggcaugucuuacagcauguguaccgggaaguucaagaucgucaaagagauugcggagacacagcacggaacgaucgugaucagaguccaguaugaaggcgacgggucccccugcaagauucccuucgagaucaccgaucucgaaaaacgccaugugcugggacggcugauuacaguuaacccuaucgugaccgagaaggacagcccggucaacauugaagccgagcccccuuuuggcgauucuuacaucauuaucgggguggagcccggccagcucaaacugaauugguucaagaagggauccagcaucggccaaauguuugaaacaaccaugagaggggcuaaacgcauggccauucuuggagacacggccugggauuucggcucucucgggggaguuuuuacaagcaucggcaaggcucuccaccagguguucggggccauuuacggcgcggcuuuuuccggagucucuuggaccaugaaaauccugauuggcgugaucaucaccuggauugggaugaacagccgguccacaagccugucugugucccuuguucucgucggaguggugacccuguaucugggcgccgucgugcaggccgacagcggguguguugugucuuggaagaauaaagagcucaagugcggauccggcaucuucauuacagauaacguccacacguggaccgaacaguacaaguuucaaccugagagccccuccaaacuggcuucugccauccagaaggcucaugaagaggggauuuguggcaucagaagcgugacacgccuugagaaucugauguggaaacagaucaccccggaacucaaccacauucuguccgagaaugaaguuaagcugacaaucaugaccggagacauuaaaggcaucaugcaggccgggaagcggucucuuagaccucaacccacggagcucaaauauagcuggaagaccuggggaaaggcgaaaaugcuguccacagaaagccauaaccagaccuuccugauugauggcccugagacagccgagugccccaauaccaaccgcgcuuggaacucucucgaaguggaggacuacggguuuggagucuucacaaccaacaucuggcugaaacuucgggaaaaacaggacguguuuugugauuccaagcugaugagcgccgcuaucaaagacaauagagccguucacgcggauaugggcuauuggauugagucugcccucaacgacacguggaagauggagaaggcuuccuucaucgaagugaaaagcugccacuggccuaagucucauacacuguggagcaauggcguccuggaguccgaaaugauuauccccaaaaacuucgccgggccggugagccagcacaacuaccgcccuggauaucauacccaaaccgcuggccccuggcaccuugggaagcucgagauggauuuugacuucugugaaggaacaaccguggucguuacggaggauugcggcaaucgggggcccucucugagaacaaccacagccuccggaaaacugauuaccgaguggugcugucggagcugcacacucccuccgcugcgcuacagaggcgaagacggcuguugguacgggauggagauccggccccuuaaggaaaaggaggaaaaccuggugaauagccucgugaccgccggacauggccagauugauaacuuuucucuggggguccugggaauggcucuuuuccucgaggagaugcugagaacgcgcaucggcaccaaacacgcgauccugcucguggccguuagcuuugugacacugauuaccgggaauauguccuuccgggaccuuggaagagucauggugaugguuggcgcuacaaugaccgaugacaucggcaugggggugacguaucuggcccuccuggccgcuuuuaagguccgcccuacauucgccgcgggacugcuucugagaaaacucaccucuaaggaacugaugauggcuacaauuggcaucgcccuccugagccaguccaccauucccgagaccauccuugaacugacagaugcccucgcucuggggaugauggugcugaaaaucguucggaacauggagaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggacucaaucccacagccaucuuucugaccacgcugagccgcacaucuaaaaagagauccuggccgcuuaacgaagcgauuauggccgugggcauggugagcauccuggcuucuucccuccugaaaaaugacauuccuaugaccgggccccucgucgccggaggccugcuuaccgugugcuauguucugacaggccggagcgcugaucuggagcucgagcgcgccgccgacgugaagugggaagaucaagcugagaucuccgggagcucuccuauucugagcaucaccauuuccgaagacggaucuaugagcaucaaaaacgaggaggaagaacagacacuuacgauccugauuagaaccggccuccuggucaucuccgggguguuccccguuucuauuccgaucacagcggccgcuugguaccucugggaagugaagaagcagcgggccggaguccugugggaugugccuucucccccucccgucgagaaagccgaacuugaggacggcgcuuaucgcauuaagcagagagggauccugggauacucccaaaucggcgccggcguguauaaagaggggaccuuucacacaauguggcauguuacccggggagcggugcugaugcaccgcggcaagagaauugaacccuccugggcugaugucaaaaaggaccucaucagcuacgggggaggcuggaagcuggagggggaauggaaagagggagaagaggugcagguucuugcccuggagccuggcaagaauccgcgggccgugcagacgaaacccggcauuuucaagaccaacacagggaccaucggagcugucucccucgauuuuagcccuggcacaucugggucccccauuguggacagaaaaggaaaggugguuggccuguacgggaauggagucgugacccgcagcggcgccuaugugucugcgaucgcucagacagaaaaguccaucgaggauaacccugaaauugaggacgauaucuuccggaaaaagagacucacgauuauggaccugcaucccggcgccgggaaaaccaagcgcuaccuuccugccaucguccgggaagcuauuaaaagaggacugcgcacacugauccucgccccgacccgggugguugcugccgagauggaggaagcgcugagaggccuucccauucgcuaucaaaccccugccaucaagacagagcacacggggcgggaaaucguggaccugaugugucaugcuaccuucacaaugagacuccugagccccguccgggugccuaacuacaaucucauuaucauggaugaggcccacuuuaccgaccccgcuuccauugccgcccgcggauauaucucuacaagaguugagaugggcgaagcugcggggauuuucaugaccgccacgccgccuggcagccgggaucccuuuccccaguccaacgcuccuaucauggacgaggaacgcgagauccccgaaagaagcuggaacucuggacacgagugggugacagauuucaagggcaaaaccgucugguuugugccuuccauuaaggccgggaacgacaucgccgcuugccugcggaaaaauggaaagaaaguuauucagcuuagcagaaagaccuucgauucugaguacgugaagacacgcgccaacgacugggauuuugucgugaccacagacaucagcgaaaugggcgcgaauuucaaagcugagcgggugauugauccgagacgcuguaugaagcccgucauccugaccgacggggaggaacggguuauccuggccggaccuaugcccgugacgcauuccucugccgcucaaagacgcggccggauugggagaaacccuaaaaaugaaaacgaccaguauaucuacaugggcgagccccucgagaaugaugaagacugcgcccacuggaaggaggcgaaaaugcugcuugauaacauuaauacaccggaaggaaucauuccuagcauguuugagcccgaacgcgagaagguggacgccaucgauggcgaguacagacugagaggggaagcucgcaaaaccuucgucgaccucaugagacggggagaucugccuguguggcuggccuauaagguugcugccgagggcauuaacuacgcugaccgcaagugguguuuugaugggaucaaaaauaaccagauccucgaagagaacauggagguggaaauuuggacaaaggagggagaacgcaagaaacuuaaaccccgguggcuggacgccagaaucuauuccgauccucuggcgcucaaggaguucaaggaguucgccgcuggccgcaaaucucugacccuuaaucugauuacggagauggggcggcuccccaccuuuaugacacagaaggccagaaacgcucuggacaaucuggccguccuccauaccgccgaggcuggcggacgcgcguacaaccacgcccuuagcgaacugccggagacacuggaaacccuccugcuucugacacuccuggcuaccgugacgggcgggaucuuccuguuucucauguccggaaaaggcauugggaagaugacacuuggaaugugcugcaucaucaccgccagcauucugcugugguaugcccaaauccagccucacuggauugcugccucuaucauucucgaguucuuucugaucguucuucugauccccgaacccgagaaacagcggaccccucaggauaaucaacucacauacguggucauugcgauccugaccguggucgccgcuacaauggccaacgagaugggcuuccuggaaaagacgaagaaagaccucggccuuggguccauuaccacacaggagagcgaauccaauauccuggacauugaucugagaccggcuucugccuggacccucuaugcgguggccacaaccuuuguuacgcccaugcugcggcauagcaucgagaacuccucugugaaugugagccuuaccgcuauugccaaccaggcuacaguccugaugggacucggcaagggguggccucuguccaaaauggacaucggaguuccccugcucgccaucggcuguuacagccaggugaauccuauuacccuuacagcugcccugcugcuccugguggcgcacuacgccaucauugggcccggacuucaagcuaaggccacccgcgaagcucagaaaagagccgccgcgggcaucaugaagaacccuacggucgauggcauuacagugaucgaccuggagccgauccccuaugauccuaaguucgagaaacagcucgggcagguuaugcugcugauucucugcgugacccaaguccuuaugaugcggacaaccugggcucugugugaagcccugacccucgcuacaggacccaucucuacgcugugggagggcaauccugggcgcuuuuggaacaccacaauugccguguccauggccaauaucuucagaggaagcuaccuugcuggcgccgggcugcucuuuucuauuaugaagaacaccacauccacccggcgcggaacgggcaauaucggcgaaacacugggggagaaauggaaaagcagacugaacgcgcucggaaaaucugaguuccagaucuauaagaaaagcggcauucaggaagucgaccggacccuugccaaggaggggaucaagcgcggagaaaccgaucaucacgcuguguccagaggcucugccaaacugcggugguuuguugagagaaacauggugacacccgaagggaaggucguggaccugggaugcggccgcggcggguggagcuacuauuguggaggccucaaaaauguucgggaggugaaggggcugaccaaaggaggcccggggcaugaggaaccuauucccauguccacauacggauggaaccuugucagacugcaaagcggcguggauguguucuucacgcccccugagaagugcgacacccuccugugugauaucggcgaauccucucccaauccuacaauugaggcugggcgcacccugcggguucucaaccuugucgaaaauuggcugaacaauaacacacaguuuugcaucaaggugcugaauccguauaugcccagcgugaucgagaaaauggaggcccuccagagacaguacggaggcgcgcugguccgcaacccucuuuccagaaauucuacccacgaaauguacuggguuagcaacgccacggggaauauuguguccucugugaacaugaucagcagaaugcugauuaaucgcuucaccaugaagcacaaaaaggcuacauaugagcccgacgucgaucucggauccggcacccggaacaucgggauugaaagcgagaucccuaaccuggacauuaucggaaaaagaaucgaaaagauuaagcaagagcaugagaucucuuggcacuacgaccaggaucaucccuauaaaacaugggccuaccacggcuccuaugaaaccaagcagacaggcagcgcuucuuccauggugaaugggguugugcgccugcucaccaaaccgugggacgucgugccuaugguuacgcagauggccaugacagauaccacccccuuuggacaacagcggguguucaaggagaaagucgacacaagaacgcaggaaccuaaggagggcaccaagaaacuuaugaagauuacagcugaguggcuguggaaagaacuggggaagaaaaagacccccagaauguguacaagagaggaauuuaccaaaaaggugcggagcaacgccgcgcucggagccaucuucacagaugagaauaaguggaaaucugcucgcgaagccguggaggacggcagauuuugggagcuggucgaucgggaaagaaaccuucaccuggaggggaagugcgaaaccuguguuuacaauaugaugggaaaacgggagaagaaacucggcgaguucggcaaggcuaaggggucccgcgccauuugguauauguggcugggagccagauuucuggaguucgaggcgcucggcuuucugaacgaagaccauugguucagccggggaaauucccuuagcggaguggagggcgaagggcugcaccgccucggcuacauccugagagaugugggcaagaaggagggcggggcuauguacgccgacgauacggccggaugggacacccggaucacacuugaagaccugaaaaacgaggagauggucaccaaucauaugaagggcgaacacaaaaagcucgcugaggccauuuuuaagcugacauaucagaacaaagugguucgcgugcaaagaccuacaccccgggggacggucauggauaucauuucucgcagagaccagcggggaagcggccagguggggacauacggccugaauaccuucacaaacauggaagcucaacucauccgccagauggagggagagggcauuuucaaguccauccagcaucugaccgccacggaagagaucgcgguucagaauuggcuugccagaguggggcgggaacgccugucuagaauggcuauuagcggagaugacugcgucgugaaaccgaucgaugaccgguuugccuccgcucucaccgcccugaacgauaugggcaagguuagaaaagacauucaacagugggagccuucucgcggguggaaugauuggacacaggugcccuucugcagccaccacuuucaugaacuugucaugaaggacggacgggugcuggucgugcccuguagaaaccaggaugagcucaucggccgcgcgcggauuucccaaggggccggcuggucucugaaggagaccgcuugccugggaaaaagcuaugcccagauguggacacucauguacuuccacagacgcgaccugcggcuugcugccaacgcuaucuguuccgccguuccuagccauugggugccgaccucuagaacaaccugguccauucacgcgaagcacgaauggaugacgacagaggauaugcuggccgucuggaaucgcguguggauccaggaaaaccccuggauggaggacaaaaccccuguggaaagcugggaggagguucccuaucucggcaagcgggaagaccaguggugcgggucucugaucggacuuaccuccagagcuacaugggccaaaaauauucaaaccgccaucaaccaggugcgcagccugauuggcaaugaggaauacacagauuauaugccuuccaugaagcgguuuagacgggaggaagaggaggcugggguccucugguga

SEQ ID NO: 19756 - RNA, 9876 nt, Artificial Sequence
  derived and/or modified CDS sequence (opt5) from DENV-2__FJ182014__SS-prME
acagccggcgugaucgucaugcugauucccacagcuauggccuuccaccucacgacccggaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccguuccuucgccaaaaugaacccgaggauauugacuguuggugcaauuccacaucuaccugggugacguauggcaccuguacaaccacaggggagcacagacgggaaaagcgcagcgucgcucuggugccucauguuggaaugggccucgagaccagaacggaaacauggauguccucugagggcgccuggaaacacgugcagcggaucgagaccuggauccugcgccaucccggguuuacaauuauggccgcuauccuggccuacaccauuggaaccacacacuuccagagagcucucaucuuuauucugcuuacggccgucgcgccuagcaugaccaugcggugcaucggcauuuccaaccgcgauuucguggaagggguuucuggaggcagcuggguggacaucguccuggagcacggguccugugugacaaccauggccaagaauaagcccacacucgauuuugaacugaucaaaaccgaggcuaagcagccugccacgcuuagaaaauauugcauugaagcuaagcugacaaacaccaccacagagagccgguguccgacccaaggagagcccucucucaaugaagaacaggacaaacgcuucaucugcaagcauuccaugguggauagaggcuggggcaacggguguggacuguuuggcaaaggcgggauugucacaugcgccauguucacgugcaaaaagaauauggaagggaaaguugugcagccugagaaccuggaauacaccaucgugauuacaccccacagcggggaggagcaugcggucggaaaugacaccggcaagcacggcaaagaaaucaagaucacaccucagucuuccauuaccgaggccgaacucacgggguauggaaccgugacaauggaguguagcccccggaccggccuggauuuuaacgaaaugguucuucugcaaauggaggacaaggcuuggcucgugcaccgccagugguuccuggaucuuccgcugccuuggcuccccggggccgacacacagggaucuaauuggauccagaaggagacccuggucacguuuaagaacccucaugcuaaaaagcaagacgugguugugcugggcucccaggaaggggccaugcacacagcccucaccggcgcuacagagauucagaugagcuccggaaaucugcuuuucaccggccaucugaaaugcagacuccggauggauaagcugcaacuuaaagggaugucuuacagcauguguaccggaaaguucaagaucgucaaagaaauugcggagacacagcacggcacgaucgugaucagaguccaguaugagggggacggaucccccugcaagauucccuuugaaaucaccgaucuggagaaacgccaugugcucggccggcugauuacaguuaacccuaucgugaccgaaaaggacagcccggucaacauugaggccgaacccccuuucggggauucuuacaucauuaucggcguggagcccggacagcugaaacucaauugguuuaagaagggcuccagcaucgggcaaauguucgagacaaccaugagaggagcuaaacgcauggccauucugggcgacacggccugggauuuugggucucuuggaggcguuuucacaagcaucgggaaggcucugcaccagguguuuggcgccauuuacggagcggcuuucuccggcgucucuuggaccaugaaaauccucauuggggugaucaucaccuggauuggaaugaacagccgguccacaagccugucugugucccugguucuugucggcguggugacccucuaucugggggccgucgugcaggccgacagcggauguguugugucuuggaagaauaaagaacugaagugcggcuccgggaucuuuauuacagauaacguccacacguggaccgagcaguacaaguuccaaccugaaagccccuccaaacucgcuucugccauccagaaggcucaugaggaaggcauuuguggaaucagaagcgugacacgccuggagaaucuuauguggaaacagaucaccccggagcugaaccacauucucuccgaaaaugagguuaagcugacaaucaugaccggcgacauuaaagggaucaugcaggccggaaagcggucucugagaccucaacccacggaacuuaaauauagcuggaagaccuggggcaaggcgaaaaugcucuccacagagagccauaaccagaccuuucugauugaugggccugaaacagccgagugccccaauaccaaccgcgcuuggaacucucuggagguggaagacuacggauucggcgucuuuacaaccaacaucuggcucaagcugcgggagaaacaggacguguucugugauuccaaacuuaugagcgccgcuaucaaagacaauagagccguucacgcggauaugggcuauuggauugaaucugcccugaacgacacguggaagauggagaaggcuuccuucaucgaggugaaaagcugccacuggccuaagucucauacacucuggagcaaugggguccuggaauccgagaugauuauccccaaaaacuuugccggaccggugagccagcacaacuaccgcccuggcuaucauacccaaaccgcugggcccuggcaccugggaaaacuugaaauggauuucgacuuuugugagggcacaaccguggucguuacggaagauugcgggaaucggggacccucucucagaacaaccacagccuccggcaaacugauuaccgaguggugcugucggagcugcacacugccuccgcuccgcuacagaggcgaggacggguguugguacggaauggaaauccggccccugaaggagaaggaagagaaccuugugaauagccuggugaccgccggccaugggcagauugauaacuucucucucggaguccugggcauggcucuguuucuugaagagaugcucagaacgcgcaucgggaccaaacacgcgauccugcugguggccguuagcuucgugacacucauuaccggaaauauguccuuucgggaccugggcagagucauggugaugguuggcgcuacaaugaccgaugacaucgggaugggagugacguaucuugcccugcucgccgcuuucaagguccgcccuacauuugccgcgggccugcugcuuagaaaacugaccucuaaggagcucaugauggcuacaauugggaucgcccugcucagccaguccaccauucccgaaaccauccuggagcuuacagaugcccuggcucucggaaugauggugcugaaaaucguucggaacauggaaaaguaccaacuggccgugacgauuauggcgaucucuugcgucccuaaugcugugauucuucagaacgccuggaaggugagcuguaccauccuggccgcugucuccguuagcccccuccugcucacaucuucccagcagaaagccgacuggauuccucuggcucuuaccaucaagggccugaaucccacagccaucuuccucaccacgcugagccgcacaucuaaaaagagauccuggccgcugaacgaggcgauuauggccguggggauggugagcauccuugcuucuucccugcucaaaaaugacauuccuaugaccggaccccuggucgccggcggccuccugaccgugugcuauguucuuacagggcggagcgcugaucuggaacuggagcgcgccgccgacgugaagugggaggaucaagcugaaaucuccggaagcucuccuauucucagcaucauuaucuccgaggacggcucuaugagcaucaaaaacgaagaggaggaacagacccugacaauucuuaucagaacggggcugcucgucauuuccggaguguuucccguuucuaucccgauuaccgcggccgcuugguaccugugggaggugaagaagcagcgggccggcguccucugggaugugccuucucccccucccgucgaaaaagccgagcuggaagacggggcuuaucgcaucaagcagagaggaauccuuggcuacucccaaauuggcgccgggguguauaaagagggaacauuccacaccauguggcauguuacacggggcgcggugcugaugcaccgcgggaagagaaucgagcccuccugggcugaugucaaaaaggaccugauuagcuacggaggcggguggaagcucgaaggagaguggaaagaaggcgaggaagugcagguucuggcccuugagccuggcaagaauccgcgggccgugcagaccaaacccgggaucuuuaagacgaacaccggaacaauuggcgcugucucccuggauuucagcccugggaccucuggaucccccaucguggacagaaaaggcaaggugguugggcucuacggaaauggcgucgugacacgcagcggcgccuaugugucugcgaucgcucagaccgagaaguccauugaagauaacccugagaucgaagacgauauuuuccggaaaaagagacugacaaucauggaccuccaucccggggccggaaaaacgaagcgcuaccugccugccauuguccgggaggcuaucaaaagaggccuucgcacccugauucuggccccgacacgggugguugcugccgaaauggaggaggcgcucagagggcugcccauccgcuaucaaaccccugccaucaagaccgaacacacaggacgggagauuguggaccuuaugugucaugcuacguuuaccaugagacugcucagccccguccgggugccuaacuacaaucugaucauuauggaugaagcccacuucacagaccccgcuuccaucgccgcccgcggcuauauuucuaccagaguugagaugggggaggcugcgggcaucuuuaugacagccaccccgccuggaagccgggaucccuucccccaguccaacgcuccuaucauggacgaagaaagagaaauucccgagagaagcuggaacucuggccacgaaugggugacggauuuuaaggggaaaacagucugguucgugccuuccaucaaggccggaaacgacauugccgcuugccuccggaaaaauggcaagaaaguuauccagcugagcagaaagaccuuugauucugaguacgugaagacccgcgccaacgacugggauuucgucgugacaaccgacauuagcgagaugggggcgaauuuuaaagcugaacgggugaucgauccgagacgcuguaugaagcccgucauccuuacagacggagaggaacggguuauucuggccggcccuaugcccgugacccauuccucugccgcucaaagacgcgggcggaucggcagaaacccuaaaaaugagaacgaccaguauauuuacaugggagaaccccuggagaaugaugaggacugcgcccacuggaaggaagcgaaaaugcuccuggauaacaucaauacgccggagggcauuaucccuagcauguucgaacccgagcgcgaaaagguggacgccauugauggggaguacagacuucggggagaggcucgcaaaacauuugucgaccugaugagacggggcgaucucccuguguggcuggccuauaagguugcugccgaagggaucaacuacgcugaccgcaagugguguuucgauggaaucaaaaauaaccagauucuggaggaaaacauggagguggagaucuggaccaaggaaggcgagcgcaagaagcucaaaccccgguggcuugacgccagaauuuauuccgauccucuggcgcugaaggaguucaaggaguuugccgcugggcgcaaaucucucacacugaaucuuaucaccgaaaugggccggcugcccacguucaugacccagaaggccagaaacgcucucgacaaucuggccguccugcauacagccgaggcuggaggccgcgcguacaaccacgcccucagcgagcuuccggaaacccuggagacacugcuccugcuuacccugcucgcuacagugaccgggggaauuuuucuguuccugauguccggcaaagggaucggaaagaugacgcucggcaugugcugcaucauuacagccagcauccuucugugguaugcccaaauucagccucacuggaucgcugccucuauuauccuggaauuuuuccucaucguucugcuuauucccgagcccgaaaaacagcggaccccucaggauaaucaacugaccuacguggucaucgcgauucucacaguggucgccgcuaccauggccaacgagaugggcuuucuggagaagacaaagaaagaccuggggcucggauccaucacgacccaggaaagcgaguccaauauucuugacaucgaucugagaccggcuucugccuggacacuguaugcgguggccaccacauucguuacccccaugcuccggcauagcauugaaaacuccucugugaaugugagccugacggcuaucgccaaccaggcuaccguccuuaugggccuggggaagggauggccucucuccaaaauggacaucggcguuccccugcuggccauuggguguuacagccaggugaauccuaucacacucaccgcugcccuucugcugcucguggcgcacuacgccauuaucggacccggccugcaagcuaaggccacacgcgaggcucagaaaagagccgccgcgggcauuaugaagaacccuaccgucgaugggaucacggugaucgaccuugaaccgauucccuaugauccuaaguuugagaaacagcugggacagguuaugcuccugauccugugcgugacacaaguccucaugaugcggaccacaugggcucuuugugaggcccugacccuggcuaccggccccauuucuacacucugggaagggaauccuggacgcuucuggaacacgaccaucgccguguccauggccaauauuuuuagaggcagcuaccuggcuggggccggacuucuguucucuaucaugaagaacacaaccuccacacggcgcggcaccggcaauaucggggagacgcucggagaaaaauggaaaagcagacugaacgcgcugggcaaaucugaguuucagauuuauaagaaaagcgggauccaggaggucgaccggacacucgccaaggaaggaauuaagcgcggcgagaccgaucaucacgcuguguccagagggucugccaaacuucggugguucguugaaagaaacauggugacccccgagggaaaggucguggaccugggcugcggccgcgggggauggagcuacuauuguggcgggcugaaaaauguucgggaagugaagggacucacaaaaggcgggccgggacaugaggagccuauccccauguccaccuacggcuggaaccuggucagacuucaaagcggcguggauguguucuuuacacccccugaaaagugcgacacgcugcucugugauauuggggaguccucucccaauccuaccaucgaagcuggacgcacacugcggguucugaaccucgucgagaauuggcuuaacaauaacacccaguucugcaucaaggugcugaauccguauaugcccagcgugauugagaagauggaggcccugcagagacaguacggcggggcgcucguccgcaacccucuguccagaaauucuacacacgagauguacuggguuagcaacgccaccggaaauaucguguccucugugaacaugauuagcagaaugcuuaucaaucgcuuuacgaugaagcacaaaaaggcuaccuaugaacccgacgucgaucugggcuccgggacacggaacauuggaaucgagagcgaaauuccuaaccucgacaucaucggcaaaagaauugagaagaucaagcaagaacaugagauuucuuggcacuacgaccaggaucaucccuauaaaaccugggccuaccacggcuccuaugagacaaagcagaccgggagcgcuucuuccauggugaauggaguugugcgccugcugacaaaaccgugggacgucgugccuaugguuacccagauggccaugacggauacaacccccuucggccaacagcggguguuuaaggaaaaagucgacaccagaacacaggagccuaaggaagggacgaagaaacucaugaagaucaccgcugaguggcuuuggaaagagcugggaaagaaaaagacaccccgcauguguaccagagaagaguucaccaagaaggugcggagcaacgccgcgcugggcgccauuuuuaccgaugaaaauaaguggaaaucugcucgcgaggccguggaagacgggagauucugggagcucgucgaucgggagagaaaccugcaccuugaaggaaagugcgagacauguguuuacaauaugaugggcaaacgggaaaagaaacugggcgaguuugggaaggcuaagggaucccgcgccaucugguauauguggcucggcgccagauuccuggaauuugaggcgcugggguuccucaacgaggaccauugguuuagccggggaaauucccugagcggcguggaaggggagggccuucaccgccugggauacauccucagagaugugggcaaaaaggaagggggagcuauguacgccgacgauaccgccggcugggacacgcggauuacccuggaggaccuuaaaaacgaagagauggucacaaaucauaugaagggggagcacaaaaagcuggcugaagccaucuucaagcucaccuaucagaacaaagugguucgcgugcaaagaccuacaccccggggaaccgucauggauauuaucucucgcagagaccagcggggcagcggacaggugggcacguacggacugaauacauucaccaacauggaggcucaacugauucgccagauggaaggcgaggggaucuuuaaguccauccagcaucucacagccaccgaggaaauugcgguucagaauuggcuggccagagugggacgggagcgccuuucuagaauggcuaucagcggcgaugacugcgucgugaaaccgauugaugaccgguucgccuccgcucugacggcccucaacgauauggggaagguuagaaaagacauccaacagugggaaccuucucgcggauggaaugauuggacccaggugcccuuuugcagccaccacuuccaugagcuggucaugaaggacggccgggugcuugucgugcccuguagaaaccaggaugaacugauugggcgcgcgcggaucucccaaggcgccggauggucucucaaggagacagcuugccugggcaaaagcuaugcccagauguggacccugauguacuuucacagacgcgaccuccggcuggcugccaacgcuauuuguuccgccguuccuagccauugggugccgacaucuagaaccacaugguccauccacgcgaagcacgaguggaugaccacggaagauaugcuugccgucuggaaucgcguguggauccaggagaaccccuggauggaagacaaaacaccuguggagagcugggaagagguucccuaucuggggaagcgggaggaccaguggugcggaucucucauuggccugaccuccagagcuaccugggccaaaaauauccaaacagccauuaaccaggugcgcagccuuaucgggaaugaagaguacaccgauuauaugccuuccaugaagcgguucagacgggaagaggaagaggcuggaguccugugguga

SEQ ID NO: 19757 - RNA, 9876 nt, Artificial Sequence
  derived and/or modified CDS sequence (opt5) from DENV-2__FJ547090__SS-prME
acagccggcgugaucgugaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccacgaucaaagacaauagagcuguucacgccgauaugggcuauuggauugaaucugcgcucaacgacacauggaagauggagaaggccuccuucaucgaggugaaaagcugccacuggccuaagucucauacccuguggagcaaugggguccuggaauccgagaugauuauccccaaaaacuucgcuggaccggugagccagcacaacuaccgccuuggcuaucauacccaaacagccgggccuuggcaccucggaaagcuggaaauggauuuugacuucugugagggcaccacgguggucguuacagaagauugcgggaaucggggacccucucugagaaccacaaccgcuuccggcaaacucauuacagaguggugcugucggagcugcacccugcccccucuucgcuacagaggcgaggacggguguugguacggaauggaaauccggccgcugaaggagaaggaagagaaccucgucaauucccuggugacggccggccaugggcagauugauaacuuuucucugggaguccuuggcauggcccucuuccuggaagagaugcugagaacccgcaucgggacaaaacacgcuauccuccugguggcgguuagcuuugugacccuuauuacaggaaauauguccuuccgggaccugggcagagucauggugaugguuggcgccaccaugacggaugacaucgggaugggagugacauaucucgcucugcuggccgccuuuaagguccgccccaccuucgcugccggccuucugcucagaaaacugacaucuaaggagcucaugauggcgaccauugggaucgcucugcuuagccaguccaccauuccugaaacaauccuggagcucacggaugcccuggcccugggaaugauggugcuuaaaaucguucggaacauggaaaaguaccaacuggcugugaccauuauggccaucucuugcguccccaaugcggugauucuccagaacgcuuggaaggugagcuguacaauccuggccgccgucuccguuagcccucuccugcuuaccucuucccagcagaaagcugacuggauuccccuggcccucacaaucaagggccugaauccuaccgcuaucuuucugacgacacuuagccgcaccucuaaaaagagauccuggccccugaacgaggccauuauggcgguggggauggugagcauccucgccucuucccugcucaaaaaugacauuccgaugaccggaccucuggucgcuggcggccuucugacagugugcuauguucugaccgggcggagcgccgaucucgaacuggagcgcgcugccgacgugaagugggaggaucaagccgaaaucuccggaagcucucccauucuuagcaucacaauuuccgaggacggcucuaugagcaucaaaaacgaagaggaggaacagacgcugaccauccucauuagaacagggcugcucgucaucuccggaguguucccuguuucuauucccaucaccgcugcggccugguaccugugggaggugaagaagcagcgggcuggcguccuuugggaugugccgagcccucccccugucgaaaaagccgagcuggaagacggggccuaucgcauuaagcagagaggaauccugggcuacucccaaaucggcgcugggguguauaaagagggaacauuucacaccauguggcauguuacgcggggcgccgugcucaugcaccgcgggaagagaauugagcccucuugggcggaugucaaaaaggaccugaucagcuacggaggcggguggaaacuugaaggagaguggaaagaaggcgaggaagugcagguucuggcucucgagcccggcaagaauccucgggccgugcagaccaaaccggggauuuucaagacaaacaccggaacaaucggcgccgucucccuggauuuuagccccgggaccucuggauccccuauuguggacagaaaaggcaaggugguugggcucuacggaaauggcgucgugacacgcagcggcgcuuaugugucugccaucgcgcagacggagaaguccaucgaagauaaccccgagauugaagacgauaucuuccggaaaaagagacugaccauuauggaccuucauccuggggcuggaaaaacaaagcgcuaccugcccgccaucguccgggaggccauuaaaagaggccugcgcacccucauccuggcuccuacccgggugguugccgcugaaauggaggaggcccuuagagggcugccgauucgcuaucaaacacccgcgaucaagacggaacacaccggacgggagaucguggaccucaugugucaugccacauucaccaugagacugcucagcccuguccgggugcccaacuacaaucugauuaucauggaugaagcucacuuuacagacccugccuccauugcugcccgcggcuauaucucuaccagaguugagaugggggaggccgcuggcauuuucaugacggcgacacccccgggaagccgggauccuuuuccccaguccaacgcccccaucauggacgaagaaagagaaaucccugagagaagcuggaacucuggccacgaaugggugaccgauuucaaggggaaaaccgucugguuugugcccuccauuaaggcuggaaacgacaucgccgccugccuucggaaaaauggcaagaaaguuauucagcugagcagaaagacauucgauucugaguacgugaagacccgcgcuaacgacugggauuuugucgugacaaccgacaucagcgagaugggggccaauuucaaagcggaacgggugauugauccuagacgcuguaugaagccggucauccugacggacggagaggaacggguuauccucgcuggccccaugccugugacacauuccucugccgcccaaagacgcgggcggauuggcagaaaccccaaaaaugagaacgaccaguauaucuacaugggagaaccucuggagaaugaugaggacugcgcucacuggaaggaagccaaaaugcuucuggauaacauuaauacccccgagggcaucauuccgagcauguuugaaccugagcgcgaaaagguggacgcgaucgauggggaguacagacuccggggagaggcccgcaaaacauucgucgaccugaugagacggggcgaucugcccguguggcucgcuuauaagguugccgcugaagggauuaacuacgccgaccgcaagugguguuuugauggaaucaaaaauaaccagauccuugaggaaaacauggagguggagauuuggaccaaggaaggcgagcgcaagaagcugaaaccucgguggcuggacgcuagaaucuauuccgauccccucgcccugaaggaguucaaggaguucgcggccgggcgcaaaucucuuacgcugaaucucauuaccgaaaugggccggcugccuacauuuaugacccagaaggcuagaaacgcccuggacaaucucgcuguccuucauacagccgaggccggaggccgcgcuuacaaccacgcgcugagcgagcugcccgaaacccucgagacacugcuucugcucacccugcuggccacggugacagggggaaucuuccucuuucuuauguccggcaaagggauuggaaagaugacccugggcaugugcugcaucaucaccgcuagcauucugcucugguaugcccaaauccagccgcacuggauugccgcuucuaucauucuggaguucuuucuuaucguucugcucaucccugagcccgaaaaacagcggacaccccaggauaaucaacugaccuacguggucauugccauccugacaguggucgcggccacgauggcuaacgagaugggcuuccucgagaagaccaagaaagaccuugggcugggauccauuacaacccaggaaagcgaguccaauauccuggacauugaucucagaccugccucugcuuggacacuguaugccguggcgaccacguuuguuaccccgaugcuucggcauagcaucgaaaacuccucugugaaugugagccugacagccauugcuaaccaggccaccguccucaugggccuggggaagggauggccccuguccaaaauggacaucggcguuccucuccuugcuaucggguguuacagccaggugaaucccauuacacugaccgccgcucugcuccugcuuguggcccacuacgcgaucauuggaccuggccugcaagccaaggcuacgcgcgaggcccagaaaagagcugccgccggcaucaugaagaaccccacagucgaugggauuaccgugaucgaccucgaaccuaucccguaugaucccaaguucgagaaacagcugggacagguuaugcugcucauucuuugcgugacacaaguccugaugaugcggaccaccugggcgcugugugaggcucucacacuggccacgggcccuaucucuacccuuugggaagggaaucccggacgcuuuuggaacacaaccauugcuguguccauggccaauaucuucagaggcagcuaccuggccggggcuggacuccuguuuucuauuaugaagaacacaaccuccacgcggcgcggcacaggcaauaucggggagacccugggagaaaaauggaaaagcagacucaacgcccuuggcaaaucugaguuccagaucuauaagaaaagcgggauucaggaggucgaccggacccuggcgaaggaaggaaucaagcgcggcgagacagaucaucacgccguguccagagggucugcuaaacugcggugguuuguugaaagaaacauggugaccccugagggaaaggucguggaccucggcugcggccgcgggggauggagcuacuauuguggcgggcugaaaaauguucgggaagugaagggacuuacaaaaggcgggcccggacaugaggagccgauuccuauguccacguacggcuggaaccuggucagacuccaaagcggcguggauguguucuucaccccucccgaaaagugcgacacacugcugugugauaucggggaguccucucccaaucccaccauugaagccggacgcacacuccggguucuuaaccuggucgagaauuggcugaacaauaacacccaguuuugcaucaaggugcucaauccuuauaugccgagcgugaucgagaagauggaggcucugcagagacaguacggcggggcccuuguccgcaacccccuguccagaaauucuacgcacgagauguacuggguuagcaacgcgaccggaaauauuguguccucugugaacaugaucagcagaaugcucauuaaucgcuucacaaugaagcacaaaaaggccaccuaugaaccugacgucgaucugggcuccgggacacggaacaucggaauugagagcgaaauccccaaccuggacauuaucggcaaaagaaucgagaagauuaagcaagaacaugagaucucuuggcacuacgaccaggaucauccuuauaaaaccugggcuuaccacggcuccuaugagacaaagcagaccgggagcgccucuuccauggugaauggaguugugcgccuccuuacgaaacccugggacgucgugccgaugguuacacagauggcuaugaccgauaccacaccuuuuggccaacagcggguguucaaggaaaaagucgacacgagaacccaggagcccaaggaagggacaaagaaacugaugaagauuaccgccgaguggcuguggaaagagcucggaaagaaaaagacaccucgcauguguaccagagaagaguuuaccaagaaggugcggagcaacgcugcccugggcgcgaucuucaccgaugaaaauaaguggaaaucugcccgcgaggcuguggaagacgggagauuuugggagcuugucgaucgggagagaaaccugcaccucgaaggaaagugcgagacguguguuuacaauaugaugggcaaacgggaaaagaaacugggcgaguucgggaaggccaagggaucccgcgcuauuugguauauguggcugggcgccagauuucucgaguucgaggcccugggguuucuuaacgaggaccauugguucagccggggaaauucccugagcggcguggaaggggagggccuccaccgccugggauacauccuuagagaugugggcaaaaaggaagggggagcgauguacgcugacgauaccgccggcugggacacacggaucacccuggaggaccucaaaaacgaagagauggucacaaaucauaugaagggggagcacaaaaagcuggccgaagcuauuuuuaagcugaccuaucagaacaaagugguucgcgugcaaagacccacgccucggggaacagucauggauaucauuucucgcagagaccagcggggcagcggacaggugggcaccuacggacucaauacauucaccaacauggaggcccaacugauccgccagauggaaggcgaggggauuuucaaguccauccagcaucuuacggcuaccgaggaaaucgccguucagaauuggcuggcgagagugggacgggagcgccucucuagaauggccauuagcggcgaugacugcgucgugaaacccaucgaugaccgguuugcuuccgcccugacagcucuuaacgauauggggaagguuagaaaagacauucaacagugggaaccgucucgcggauggaaugauuggacccaggugccuuucugcagccaccacuuucaugagcuggucaugaaggacggccgggugcucgucgugcccuguagaaaccaggaugaacugaucgggcgcgcccggauuucccaaggcgcgggauggucucugaaggagacagccugccucggcaaaagcuaugcucagauguggacccugauguacuuccacagacgcgaccuucggcuggccgcuaacgccaucuguuccgcuguucccagccauugggugccuacaucuagaaccacgugguccauucacgccaagcacgaguggaugacaaccgaagauaugcucgcggucuggaaucgcguguggauccaggagaacccguggauggaagacaaaacccccguggagagcugggaagagguuccuuaucuggggaagcgggaggaccaguggugcggaucucuuaucggccugacauccagagccaccugggcuaaaaauauucaaacagccaucaaccaggugcgcagccucauugggaaugaagaguacacggauuauaugcccuccaugaagcgguuuagacgggaagaggaagaggccggaguccugugguga

SEQ ID NO: 19758 - RNA, 9876 nt, Artificial Sequence
  derived and/or modified CDS sequence (opt5) from DENV-2__EU482630__SS-prME
accgccggcgugaucgucaugcugauucccaccgcuauggccuuccaccucacgacccggaauggggagccucauaugaucguuggacggcaggaaaagggcaagagccugcuuuuuaagaccgaggacggggugaauaugugcacccugauggcgauugaucucggagaacugugugaggacacgaucaccuacaaaugcccguuccuucgccaaaaugaacccgaggauauugacuguuggugcaauuccacaucuaccugggugacguauggcaccuguacaaccacaggggagcacagacgggaaaagcgcagcgucgcucuggugccucauguuggaaugggccucgagaccagaacggaaacauggauguccucugagggcgccuggaaacacgugcagcggaucgagaccuggauccugcgccaucccggguuuacaauuauggccgcuauccuggccuacaccauuggaaccacacacuuccagagagcucucaucuuuauucugcuuacggccgucgcgccuagcaugaccaugcggugcaucggcauuuccaaccgcgauuucguggaagggguuucuggaggcagcuggguggacaucguccuggagcacggguccugugugacaaccauggccaagaauaagcccacacucgauuuugaacugaucaaaaccgaggcuaagcagccugccacgcuuagaaaauauugcauugaagcuaagcugacaaacaccaccacagagagccgguguccgacccaaggagagcccucucucaaugaagaacaggacaaacgcuucaucugcaagcauuccaugguggauagaggcuggggcaacggguguggacuguuuggcaaaggcgggauugucacaugcgccauguucacgugcaaaaagaauauggaagggaaaguugugcagccugagaaccuggaauacaccaucgugauuacaccccacagcggggaggagcaugcggucggaaaugacaccggcaagcacggcaaagaaaucaagaucacaccucagucuuccauuaccgaggccgaacucacgggguauggaaccgugacaauggaguguagcccccggaccggccuggauuuuaacgaaaugguucuucugcaaauggaggacaaggcuuggcucgugcaccgccagugguuccuggaucuuccgcugccuuggcuccccggggccgacacacagggaucuaauuggauccagaaggagacccuggucacguuuaagaacccucaugcuaaaaagcaagacgugguugugcugggcucccaggaaggggccaugcacacagcccucaccggcgcuacagagauucagaugagcuccggaaaucugcuuuucaccggccaucugaaaugcagacuccggauggauaagcugcaacuuaaagggaugucuuacagcauguguaccggaaaguucaagaucgucaaagaaauugcggagacacagcacggcacgaucgugaucagaguccaguaugagggggacggaucccccugcaagauucccuuugaaaucaccgaucuggagaaacgccaugugcucggccggcugauuacaguuaacccuaucgugaccgaaaaggacagcccggucaacauugaggccgaacccccuuucggggauucuuacaucauuaucggcguggagcccggacagcugaaacucaauugguuuaagaagggcuccagcaucgggcaaauguucgagacaaccaugagaggagcuaaacgcauggccauucugggcgacacggccugggauuuugggucucuuggaggcguuuucacaagcaucgggaaggcucugcaccagguguuuggcgccauuuacggagcggcuuucuccggcgucucuuggaccaugaaaauccucauuggggugaucaucaccuggauuggaaugaacagccgguccacaagccugucugugucccugguucuugucggcguggugacccucuaucugggggccgucgugcaggccgacagcggauguguugugucuuggaagaauaaagaacugaagugcggcuccgggaucuuuauuacagauaacguccacacguggaccgagcaguacaaguuccaaccugaaagccccuccaaacucgcuucugccauccagaaggcucaugaggaaggcauuuguggaaucagaagcgugacacgccuggagaaucuuauguggaaacagaucaccccggagcugaaccacauucucuccgaaaaugagguuaagcugacaaucaugaccggcgacauuaaagggaucaugcaggccggaaagcggucucugagaccucaacccacggaacuuaaauauagcuggaagaccuggggcaaggcgaaaaugcucuccacagagagccauaaccagaccuuucugauugaugggccugaaacagccgagugccccaauaccaaccgcgcuuggaacucucuggagguggaagacuacggauucggcgucuuuacaaccaacaucuggcucaagcugcgggagaaacaggacguguucugugauuccaaacuuaugagcgccgcuaucaaagacaauagagccguucacgcggauaugggcuauuggauugaaucugcccugaacgacacguggaagauggagaaggcuuccuucaucgaggugaaaagcugccacuggccuaagucucauacacucuggagcaaugggguccuggaauccgagaugauuauccccaaaaacuuugccggaccggugagccagcacaacuaccgcccuggcuaucauacccaaaccgcugggcccuggcaccugggaaaacuugaaauggauuucgacuuuugugagggcacaaccguggucguuacggaagauugcgggaaucggggacccucucucagaacaaccacagccuccggcaaacugauuaccgaguggugcugucggagcugcacacugccuccgcuccgcuacagaggcgaggacggguguugguacggaauggaaauccggccccugaaggagaaggaagagaaccuugugaauagccuggugaccgccggccaugggcagauugauaacuucucucucggaguccugggcauggcucuguuucuugaagagaugcucagaacgcgcaucgggaccaaacacgcgauccugcugguggccguuagcuucgugacacucauuaccggaaauauguccuuucgggaccugggcagagucauggugaugguuggcgcuacaaugaccgaugacaucgggaugggagugacguaucuugcccugcucgccgcuuucaagguccgcccuacauuugccgcgggccugcugcuuagaaaacugaccucuaaggagcucaugauggcuacaauugggaucgcccugcucagccaguccaccauucccgaaaccauccuggagcuuacagaugcccuggcucucggaaugauggugcugaaaaucguucggaacauggaaaaguaccaacuggccgugacgauuauggcgaucucuugcgucccuaaugcugugauucuucagaacgccuggaaggugagcuguaccauccuggccgcugucuccguuagcccccuccugcucacaucuucccagcagaaagccgacuggauuccucuggcucuuaccaucaagggccugaaucccacagccaucuuccucaccacgcugagccgcacaucuaaaaagagauccuggccgcugaacgaggcgauuauggccguggggauggugagcauccuugcuucuucccugcucaaaaaugacauuccuaugaccggaccccuggucgccggcggccuccugaccgugugcuauguucuuacagggcggagcgcugaucuggaacuggagcgcgccgccgacgugaagugggaggaucaagcugaaaucuccggaagcucuccuauucucagcaucaccauuuccgaggacggcucuaugagcaucaaaaacgaagaggaggaacagacacugacgauccuuauuagaaccgggcugcucgucaucuccggaguguuucccguuucuauuccgaucacagcggccgcuugguaccugugggaggugaagaagcagcgggccggcguccucugggaugugccuucucccccucccgucgaaaaagccgagcuggaagacggggcuuaucgcauuaagcagagaggaauccuuggcuacucccaaaucggcgccgggguguauaaagagggaaccuuccacacaauguggcauguuacccggggcgcggugcugaugcaccgcgggaagagaauugagcccuccugggcugaugucaaaaaggaccugaucagcuacggaggcggguggaagcucgaaggagaguggaaagaaggcgaggaagugcagguucuggcccuugagccuggcaagaauccgcgggccgugcagacgaaacccgggauuuuuaagaccaacacaggaaccaucggcgcugucucccuggauuucagcccugggacaucuggaucccccauuguggacagaaaaggcaaggugguugggcucuacggaaauggcgucgugacccgcagcggcgccuaugugucugcgaucgcucagacagagaaguccaucgaagauaacccugagauugaagacgauaucuuccggaaaaagagacugacgauuauggaccuccaucccggggccggaaaaaccaagcgcuaccugccugccaucguccgggaggcuauuaaaagaggccuucgcacacugauccuggccccgacccgggugguugcugccgaaauggaggaggcgcucagagggcugcccauucgcuaucaaaccccugccaucaagacagaacacacgggacgggagaucguggaccuuaugugucaugcuaccuuuacaaugagacugcucagccccguccgggugccuaacuacaaucugauuaucauggaugaagcccacuucaccgaccccgcuuccauugccgcccgcggcuauaucucuacaagaguugagaugggggaggcugcgggcauuuuuaugaccgccacgccgccuggaagccgggaucccuucccccaguccaacgcuccuaucauggacgaagaaagagaaauccccgagagaagcuggaacucuggccacgaaugggugacagauuuuaaggggaaaaccgucugguucgugccuuccauuaaggccggaaacgacaucgccgcuugccuccggaaaaauggcaagaaaguuauucagcugagcagaaagaccuuugauucugaguacgugaagacacgcgccaacgacugggauuucgucgugaccacagacaucagcgagaugggggcgaauuuuaaagcugaacgggugauugauccgagacgcuguaugaagcccgucauccuuaccgacggagaggaacggguuauccuggccggcccuaugcccgugacgcauuccucugccgcucaaagacgcgggcggauuggcagaaacccuaaaaaugagaacgaccaguauaucuacaugggagaaccccuggagaaugaugaggacugcgcccacuggaaggaagcgaaaaugcuccuggauaacauuaauacaccggagggcaucauuccuagcauguucgaacccgagcgcgaaaagguggacgccaucgauggggaguacagacuucggggagaggcucgcaaaaccuuugucgaccugaugagacggggcgaucucccuguguggcuggccuauaagguugcugccgaagggauuaacuacgcugaccgcaagugguguuucgauggaaucaaaaauaaccagauccuggaggaaaacauggagguggagauuuggacaaaggaaggcgagcgcaagaagcucaaaccccgguggcuugacgccagaaucuauuccgauccucuggcgcugaaggaguucaaggaguuugccgcugggcgcaaaucucucacccugaaucuuauuacggaaaugggccggcugcccaccuucaugacacagaaggccagaaacgcucucgacaaucuggccguccugcauaccgccgaggcuggaggccgcgcguacaaccacgcccucagcgagcuuccggaaacacuggagacccugcuccugcuuacacugcucgcuaccgugacagggggaaucuuucuguuccugauguccggcaaagggauuggaaagaugacacucggcaugugcugcaucaucaccgccagcauucuucugugguaugcccaaauccagccucacuggauugcugccucuaucauucuggaauuuuuccucaucguucugcuuauccccgagcccgaaaaacagcggaccccucaggauaaucaacugacauacguggucauugcgauccucaccguggucgccgcuacaauggccaacgagaugggcuuucuggagaagacgaagaaagaccuggggcucggauccauuaccacacaggaaagcgaguccaauauccuugacauugaucugagaccggcuucugccuggacccuguaugcgguggccacaaccuucguuacgcccaugcuccggcauagcaucgaaaacuccucugugaaugugagccugaccgcuauugccaaccaggcuacaguccuuaugggccuggggaagggauggccucucuccaaaauggacaucggcguuccccugcuggccaucggguguuacagccaggugaauccuauuacccucacagcugcccuucugcugcucguggcgcacuacgccaucauuggacccggccugcaagcuaaggccacccgcgaggcucagaaaagagccgccgcgggcaucaugaagaacccuacggucgaugggauuacagugaucgaccuugaaccgauccccuaugauccuaaguuugagaaacagcugggacagguuaugcuccugauucugugcgugacccaaguccucaugaugcggacaaccugggcucuuugugaggcccugacccuggcuacaggccccaucucuacgcucugggaagggaauccuggacgcuucuggaacaccacaauugccguguccauggccaauaucuuuagaggcagcuaccuggcuggggccggacuucuguucucuauuaugaagaacaccacauccacccggcgcggcacgggcaauaucggggagacacucggagaaaaauggaaaagcagacugaacgcgcugggcaaaucugaguuucagaucuauaagaaaagcgggauucaggaggucgaccggacccucgccaaggaaggaaucaagcgcggcgagaccgaucaucacgcuguguccagagggucugccaaacuucggugguucguugaaagaaacauggugacacccgagggaaaggucguggaccugggcugcggccgcgggggauggagcuacuauuguggcgggcugaaaaauguucgggaagugaagggacucaccaaaggcgggccgggacaugaggagccuauucccauguccacauacggcuggaaccuggucagacuucaaagcggcguggauguguucuuuacgcccccugaaaagugcgacacccugcucugugauaucggggaguccucucccaauccuacaauugaagcuggacgcacccugcggguucugaaccucgucgagaauuggcuuaacaauaacacacaguucugcaucaaggugcugaauccguauaugcccagcgugaucgagaagauggaggcccugcagagacaguacggcggggcgcucguccgcaacccucuguccagaaauucuacccacgagauguacuggguuagcaacgccacgggaaauauuguguccucugugaacaugaucagcagaaugcuuauuaaucgcuuuaccaugaagcacaaaaaggcuacauaugaacccgacgucgaucugggcuccgggacccggaacaucggaauugagagcgaaaucccuaaccucgacauuaucggcaaaagaaucgagaagauuaagcaagaacaugagaucucuuggcacuacgaccaggaucaucccuauaaaacaugggccuaccacggcuccuaugagaccaagcagacagggagcgcuucuuccauggugaauggaguugugcgccugcugaccaaaccgugggacgucgugccuaugguuacgcagauggccaugacagauaccacccccuucggccaacagcggguguuuaaggaaaaagucgacacaagaacgcaggagccuaaggaagggaccaagaaacucaugaagauuacagcugaguggcuuuggaaagagcugggaaagaaaaagacaccccgcauguguacaagagaagaguucaccaaaaaggugcggagcaacgccgcgcugggcgccaucuuuacagaugaaaauaaguggaaaucugcucgcgaggccguggaagacgggagauucugggagcucgucgaucgggagagaaaccugcaccuugaaggaaagugcgagaccuguguuuacaauaugaugggcaaacgggaaaagaaacugggcgaguuugggaaggcuaagggaucccgcgccauuugguauauguggcucggcgccagauuccuggaauuugaggcgcugggguuccucaacgaggaccauugguuuagccggggaaauucccugagcggcguggaaggggagggccuucaccgccugggauacauccucagagaugugggcaaaaaggaagggggagcuauguacgccgacgauacggccggcugggacacccggaucacacuggaggaccuuaaaaacgaagagauggucaccaaucauaugaagggggagcacaaaaagcuggcugaagccauuuucaagcucacauaucagaacaaagugguucgcgugcaaagaccuacaccccggggaacggucauggauaucauuucucgcagagaccagcggggcagcggacaggugggcacauacggacugaauaccuucacaaacauggaggcucaacugauccgccagauggaaggcgaggggauuuuuaaguccauccagcaucucaccgccacggaggaaaucgcgguucagaauuggcuggccagagugggacgggagcgccuuucuagaauggcuauuagcggcgaugacugcgucgugaaaccgaucgaugaccgguucgccuccgcucugaccgcccucaacgauauggggaagguuagaaaagacauucaacagugggaaccuucucgcggauggaaugauuggacacaggugcccuuuugcagccaccacuuccaugagcuggucaugaaggacggccgggugcuugucgugcccuguagaaaccaggaugaacugaucgggcgcgcgcggauuucccaaggcgccggauggucucucaaggagaccgcuugccugggcaaaagcuaugcccagauguggacacugauguacuuucacagacgcgaccuccggcuggcugccaacgcuaucuguuccgccguuccuagccauugggugccgaccucuagaacaaccugguccauucacgcgaagcacgaguggaugacgacagaagauaugcuugccgucuggaaucgcguguggauccaggagaaccccuggauggaagacaaaaccccuguggagagcugggaagagguucccuaucuggggaagcgggaggaccaguggugcggaucucucaucggccugaccuccagagcuacaugggccaaaaauauucaaaccgccaucaaccaggugcgcagccuuauugggaaugaagaguacacagauuauaugccuuccaugaagcgguucagacgggaagaggaagaggcuggaguccugugguga

SEQ ID NO: 19759 - RNA, 9876 nt, Artificial Sequence
  derived and/or modified CDS sequence (opt5) from DENV-2__FJ882594__SS-prME
accgccggcgugaucgucaugcugauucccaccgcuauggccuuccaccucacgaccagaaauggggagccucauaugaucguuggacggcaggaaaagggcaagagccugcuuuuuaagacggaggacggggugaauaugugcacccugauggcgauugaucucggagaacugugugaggacacaaucaccuacaagugcccccuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaacauccuggagcucaccgaugcccuggcucugggaaugaugguccuuaagaucgugcgcaauauggaaaaauaccaacuggccguuacaauuauggcgaucucuugcgugccuaacgcugucauucuccagaaugccuggaaggugagcuguacgauccuggccgcuguguccgucagcccccuccugcuuaccucuucccagcagaaggccgacuggauuccucuggcucucacaaucaaaggccugaaccccaccgccaucuuccugacaacccuuagcagaacgucuaagaaacgguccuggccgcugaaugaggcgauuauggccguugggauggugagcauccucgcuucuucccugcucaagaacgacauuccuaugacaggaccccugguggccggcggccuucugaccgucugcuaugugcugaccgggcgcagcgcugaucucgaacuggagagagccgccgacguuaaaugggaggaucaagcugaaaucuccggaagcucuccuauucuuagcaucacaauuuccgaggacggcucuaugagcaucaagaaugaagaggaggaacagacccugacaauccucauucggacggggcugcucgugaucuccggagucuuucccgugucuauuccgaucaccgcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaacauuccacaccauguggcaugugacacgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaacccgagagccguucagaccaagcccgggauuuuuaaaacgaauaccggaacaaucggcgcugugucccuggauuucagcccugggaccucuggaucccccauugucgaccgcaagggcaaagugguggggcucuacggaaacggcguugucacacggagcggcgccuaugugucugcgaucgcucagaccgagaaguccaucgaagauaacccugagauugaagacgauaucuuuagaaagaaacgccugacaauuauggaccuucaucccggggccggaaagacgaaacgguaccugccugccaucgugagagaggcuauuaagcgcggccugcggacccucauccuggccccgacaagagucguggcugccgaaauggaggaggcgcuucgcgggcugcccauucgguaucaaaccaccgccaucaaaacagaacacacgggaagagagaucguugaccucaugugucaugcuaccuucacaaugcggcugcucagcccugugcgcguccccaauuacaaccugauuaucauggaugaagcccacuucaccgacccugcuuccauugccgccagaggcuauaucucuacacggguggagaugggggaggcugcgggcauuuuuaugaccgccacgcccccgggaagccgcgauccuuucccccaguccaaugcucccaucauggacgaagagagagaaaucccugagcggagcuggaacucuggccacgaauggguuacagauuuuaaggggaagaccgugugguucguccccuccauuaaagccggaaaugacaucgccgcuugccuuagaaagaacggcaaaaaggugauucagcugagccgcaaaaccuuugauucugaguacguuaagacacgggccaaugacugggauuucguggucaccacagacaucagcgagaugggggcgaacuuuaaggcugaaagagugauugauccucgccgguguaugaaaccggugauccugaccgacggagaggaaagagucauccucgccggccccaugccuguuacgcauuccucugccgcucaacgccgggggagaauuggccgcaaucccaagaacgagaaugaccaguauaucuacaugggagaaccucuggagaacgaugaggacugcgcccacuggaaagaagcgaagaugcuucuggauaauauuaacacacccgagggcaucauuccgagcauguucgaaccugagagagaaaaaguggacgccaucgauggggaguaccggcuccgcggagaggcuagaaagaccuuuguggaccugaugcggcgcggcgaucugcccgucuggcucgccuauaaaguggcugccgaagggauuaauuacgcugacagaaagugguguuucgauggaaucaagaacaaccagauccuugaggaaaauauggagguugagauuuggacaaaagaaggcgagcggaagaaacugaagccuagauggcuggacgcccgcaucuauuccgauccccucgcgcugaaagaauuuaaggaguucgccgcugggcggaagucucuuacccugaaccucauuacggaaaugggcagacugccuaccuucaugacacagaaagcccgcaaugcucuggacaaccucgccgugcuucauaccgccgaggcuggaggccgggcguacaaucacgcccugagcgagcugcccgaaacacucgagacccugcuucugcucacacugcuggcuaccgucacagggggaaucuuucucuuccuuauguccggcaaggggauuggaaaaaugacacugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaccaacugacauacguugugauugcgauccugaccgucguggccgcuacaauggccaaugagaugggcuuucucgagaaaacgaagaaggaccuugggcugggauccauuaccacacaggaaagcgaguccaacauccuggacauugaucuccggccugcuucugccuggacccuguaugcggucgccacaaccuucgugacgccgaugcuucgccauagcaucgaaaauuccucuguuaacgugagccugaccgcuauugccaaucaggcuacagugcucaugggccuggggaaaggauggccccuguccaagauggacaucggcgucccucuccuugccaucggguguuacagccagguuaaccccauuacccugacagcugcccugcuccugcuuguggcgcacuacgccaucauuggaccuggccugcaagcuaaagccaccagagaggcucagaagcgggccgccgcgggcaucaugaaaaaucccacgguggaugggauuacagucaucgaccucgaaccuaucccguaugaucccaaguuugagaagcagcugggacaggugaugcugcucauucuuugcguuacccaagugcugaugaugcgcacaaccugggcucugugugaggcccucacccuggcuacaggcccuaucucuacgcuuugggaagggaaccccggaagauucuggaauaccacaauugccgucuccauggccaacaucuuucggggcagcuaccuggcuggggccggacuccuguucucuauuaugaaaaauaccacaaacacccgcagaggcacgggcaacaucggggagacacugggagaaaaguggaaaucccggcucaaugcgcuuggcaagagcgaguuucagaucuauaaaaagucugggauucaggagguggaccgcacccuggccaaagaaggaaucaagagaggcgagaccgaucaucacgcugucagccggggguccgccaagcugagaugguucguggaacgcaacaugguuacaccugagggaaaaguggucgaccucggcugcggcagagggggauggucuuacuauuguggcgggcugaagaaugugcgggaaguuaaaggacuuaccaagggcgggcccggacaugaggagccgauuccuaugagcacauacggcuggaaccuggugcgccuccaauccggcgucgauguguuuuucacgccgcccgaaaaaugcgacacccugcugugugauaucggggagagcuccccuaaucccacaauugaagcuggacggacccucagagugcuuaaccugguugagaauuggcugaacaauaacacacaguucugcaucaagguccucaauccuuauaugccgucugugaucgaaaagauggaggcccugcagcgcaaauacggcggggcgcuugugcggaacccccugagcagaaauuccacccacgagauguacugggucucuaacgccacgggaaauauuguuagcuccgugaacaugaucucucgcaugcucauuaaccgguuuaccaugaagcacaaaaaggcuacauaugaaccugacguggaucugggcagcgggaccagaaauaucggaauugaguccgaaauccccaaccuggacauuaucggcaaacgcaucgagaagauuaagcaggaacaugaggccagcuggcacuacgaccaagaucauccuuauaaaacaugggcuuaccacggcucuuaugagaccaagcagacaggguccgccagcucuauggucaauggagugguucggcuccuuaccaaacccugggacguggucccgauggugacgcagauggcuaugacagauaccaccccuuucggccagcaaagaguuuuuaaggaaaaaguggacacacgcacgcaggagcccaaggaagggaccaagaaacugaugaagaucacagccgaguggcuguggaaagagcucggaaagaaaaagaccccuagaauguguacacgggaagaguucaccaaaaagguccgcuccaacgcggcccugggcgcuauuuuuacagaugaaaauaaguggaaaagcgccagagaggcuguggaagacgggcgguucugggagcuuguggauagagagcggaaccugcaccucgaaggaaagugcgagaccugugucuacaauaugaugggcaaacgcgaaaagaaacugggcgaguuugggagagccaagggaucucgggccaucugguauauguggcugggcgcgcgcuuccucgaauuugaggcucugggguuccuuaacgaggaccauugguuuuccagaggaaauagccuguccggcguugaaggggagggccuccaccggcugggauacauucuucgcgaugugggcaagaaagaagggggagccauguacgccgacgauacggcuggcugggacaccagaaucacacuggaggaccucaagaacgaagagauggugaccaaucauaugaaaggggagcacaagaaacuggccgaagcuaucuucaagcugacauaucagaacaaggucgugcggguucagcgccccaccccuagaggaacggugauggauauuaucagccggcgcgaccaaagaggcucugggcaggucggcacauacggacucaauaccuuuacaaacauggaggcccagcugauucggcaaauggaaggcgaggggaucuucaaaagcauucagcaucuuaccgcgacggaggaaaucgccgugcagaauuggcuggcucgcguuggaagagagcggcucuccagaauggccaucucuggcgaugacugcguggucaagcccauugaugaccgcuucgcuagcgcccugaccgcgcuuaacgauauggggaaagugcggaaggacauccagcaaugggaaccguccagaggauggaacgauuggacacagguuccuuuuugcucucaccacuuccaugagcuggugaugaaagacggccgcguccucgugguccccugucggaaucaggaugaacugauugggagagcccgcaucagccagggcgcuggauggucccugaaggagaccgccugccucggcaagucuuaugcucaaauguggacacugauguacuuucaccggagagaccuucgccuggccgcuaacgccauuuguagcgcggugcccucccauuggguuccuaccagccggacaaccuggucuauccacgccaaacacgaguggaugacgacagaagauaugcucgcuguguggaauagagucuggauucaggagaacccguggauggaagacaagacccccguggaguccugggaagaggugccuuaucuggggaaacgcgaggaccaguggugcggaagccuuaucggccugaccucucgggccacaugggccaagaauauccagaccgcuauuaaccaaguuagaucccucaucgggaaugaagaguacacagauuauaugcccagcaugaaacgguucagacgcgaagaggaagaggccggagugcugugguga

SEQ ID NO: 19760 - RNA, 9876 nt, Artificial Sequence
  derived and/or modified CDS sequence (opt5) from DENV-2__FJ205885__SS-prME
accgccggcgugaucgucaugcugauucccacagcuauggccuuccaccucacgacccggaauggggaaccucauaugaucguuggacggcaggaaaagggcaagagccugcuuuuuaagaccgaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguucucacaagcaucgggaaggcucugcaccagguguuuggcgccauuuacggagcggcuuucuccggcgucucuuggaccaugaaaauccugauuggggugaucaucaccuggauuggaaugaacagccgguccacaagccuuucugugucccucguucuggucggcguggugacccuguaucucggggccgucgugcaggccgacagcggauguguugugucuuggaagaauaaagaacugaagugcggcuccgggaucuuuauuacagauaacguccacacguggaccgagcaguacaaguuccaaccugaaagccccuccaaacuugcuucugccauccagaaggcucaugaggaaggcauuuguggaaucagaagcgugacacgccuggagaaucucauguggaaacagaucaccccggagcugaaccacauucuguccgaaaaugagguuaaacuuacaaucaugaccggcgacauuaaagggaucaugcaggccggaaagcggucucucagaccucaacccacggaacugaaauauagcuggaagaccuggggcaaggcgaaaaugcuguccacagagagccauaaccagaccuuucucauugaugggccugaaacagccgagugccccaauaccaaccgcgcuuggaacucucuggagguggaagacuacggauucggcgucuuuacaaccaacaucuggcuuaagcugcgggagaaacaggacguguucugugauuccaagcucaugagcgccgcuaucaaagacaauagagccguucacgcggauaugggcuauuggauugaaucugcccugaacgacacguggaagauggagaaggcuuccuuuaucgaggugaaaagcugccacuggccuaagucucauacacuguggagcaaugggguccuugaauccgagaugauuauccccaaaaacuucgccggaccggugagccagcacaacuaccgcccuggcuaucauacccaaaccgcugggcccuggcaccucggaaagcuggaaauggauuucgacuuuugugagggcacaaccguggucguuacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucgugaauagccuggugaccgccggccaugggcagauugauaacuucucucugggaguccuuggcauggcucucuuucuggaagagaugcugagaacgcgcaucgggaccaaacacgcgauccuccugguggccguuagcuucgugacacuuauuaccggaaauauguccuuucgggaccugggcagagucauggugaugguuggcgcuacaaugaccgaugacaucgggaugggagugacguaucucgcccugcuggccgcuuucaagguccgcccuacauuugccgcgggccuucugcucagaaaacugaccucuaaggagcucaugauggcuacaauugggaucgcccugcuuagccaguccaccauucccgaaaccauccuggagcucacagaugcccuggcucugggaaugauggugcuuaaaaucguucggaacauggaaaaguaccaacuggccgugacgauuauggcgaucucuugcgucccuaaugcugugauucuccagaacgccuggaaggugagcuguaccauccuggccgcugucuccguuagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcgauuauggccguggggauggugagcauccucgcuucuucccugcucaaaaaugacauuccuaugaccggaccccuggucgccggcggccuucugaccgugugcuauguucugacagggcggagcgcugaucucgaacuggagcgcgccgccgacgugaagugggaggaucaagcugaaaucuccggaagcucuccuauucuuagcaucaccauuuccgaggacggcucuaugagcaucaaaaacgaagaggaggaacagacacugacgauccucauuagaaccgggcugcucgucaucuccggaguguuucccguuucuauuccgaucacagcggccgcuugguaccugugggaggugaagaagcagcgggccggcguccuuugggaugugccuucucccccucccgucgaaaaagccgagcuggaagacggggcuuaucgcauuaagcagagaggaauccugggcuacucccaaaucggcgccgggguguauaaagagggaaccuuccacacaauguggcauguuacccggggcgcggugcucaugcaccgcgggaagagaauugagcccuccugggcugaugucaaaaaggaccugaucagcuacggaggcggguggaaacuugaaggagaguggaaagaaggcgaggaagugcagguucuggcccucgagccuggcaagaauccgcgggccgugcagacgaaacccgggauuuuuaagaccaacacaggaaccaucggcgcugucucccuggauuucagcccugggacaucuggaucccccauuguggacagaaaaggcaaggugguugggcucuacggaaauggcgucgugacccgcagcggcgccuaugugucugcgaucgcucagacagagaaguccaucgaagauaacccugagauugaagacgauaucuuucggaaaaagagacugacgauuauggaccuucaucccggggccggaaaaaccaagcgcuaccugccugccaucguccgggaggcuauuaaaagaggccugcgcacacucauccuggccccgacccgggugguugcugccgaaauggaggaggcgcuuagagggcugcccauucgcuaucaaaccccugccaucaagacagaacacacgggacgggagaucguggaccucaugugucaugcuaccuucacaaugagacugcucagccccguccgggugccuaacuacaaucugauuaucauggaugaagcccacuucaccgaccccgcuuccauugccgcccgcggcuauaucucuacaagaguugagaugggggaggcugcgggcauuuuuaugaccgccacgccgccuggaagccgggaucccuucccccaguccaacgcuccuaucauggacgaagagagagaaauccccgagagaagcuggaacucuggccacgaaugggugacagauuuuaaggggaaaaccgucugguucgugccuuccauuaaggccggaaacgacaucgccgcuugccuucggaaaaauggcaagaaaguuauucagcugagcagaaagaccuuugauucugaguacgugaagacacgcgccaacgacugggauuucgucgugaccacagacaucagcgagaugggggcgaauuuuaaagcugaacgggugauugauccgagacgcuguaugaagcccgucauccugaccgacggagaggaacggguuauccucgccggcccuaugcccgugacgcauuccucugccgcucaaagacgcgggcggauuggcagaaacccuaaaaaugagaacgaccaguauaucuacaugggagaaccccuggagaaugaugaggacugcgcccacuggaaggaagcgaaaaugcuucuggauaacauuaauacaccggagggcaucauuccuagcauguucgaacccgagcgcgaaaagguggacgccaucgauggggaguacagacuccggggagaggcucgcaaaaccuuugucgaccugaugagacggggcgaucugccuguguggcucgccuauaagguugcugccgaagggauuaacuacacagaccgcaagugguguuucgauggaaucaaaaauaaccagauccuugaggaaaacauggagguggagauuuggaccaaggaaggcgagcgcaagaagcugaaaccccgguggcuggacgcuagaaucuauuccgauccucucgcccugaaggaauuuaaggaguucgcggccgggcgcaaaucucuuacgcugaaucucauuaccgaaaugggccggcugcccacauucaugacccagaaggcuagaaacgcccuggacaaucucgcuguccuucauacagccgaggccggaggccgcgcuuacaaccacgcgcugagcgagcugccggaaacccucgagacacugcuucugcucacccugcuggccacggugacagggggaaucuuucucuuccuuauguccggcaaagggauuggaaagaugacccugggcaugugcugcaucaucaccgcuagcauucugcucugguaugcccaaauccagccucacuggauugccgcuucuaucauucuggaauuuuuccuuaucguucugcucauccccgagcccgaaaaacagcggacaccucaggauaaucaacugaccuacguggucauugccauccugacaguggucgcggccacgauggcuaacgagaugggcuuucucgagaagaccaagaaagaccuugggcugggauccauuacaacccaggaaagcgaguccaauauccuggacauugaucucagaccggccucugcuuggacacuguaugccguggcgaccacguucguuacccccaugcuucggcauagcaucgaaaacuccucugugaaugugagccugacagccauugcuaaccaggccaccguccucaugggccuggggaagggauggccucuguccaaaauggacaucggcguuccccuccuugcuaucggguguuacagccaggugaauccuauuacacugaccgccgcucugcuccugcuuguggcccacuacgcgaucauuggacccggccugcaagccaaggcuacgcgcgaggcccagaaaagagcugccgccggcaucaugaagaacccuacagucgaugggauuaccgugaucgaccucgaaccgauccccuaugauccuaaguuugagaaacagcugggacagguuaugcugcucauucuuugcgugacacaaguccugaugaugcggaccaccugggcgcugugugaggcucucacacuggccacgggccccaucucuacccuuugggaagggaauccuggacgcuucuggaacacaaccauugcuguguccauggccaauaucuuuagaggcagcuaccuggccggggcuggacuccuguucucuauuaugaagaacacaaccuccacgcggcgcggcacaggcaauaucggggagacccugggagaaaaauggaaaagcagacucaacgcccuuggcaaaucugaguuucagaucuauaagaaaagcgggauucaggaggucgaccggacccuggcgaaggaaggaaucaagcgcggcgagacagaucaucacgccguguccagagggucugcuaaacugcggugguucguugaaagaaacauggugacccccgagggaaaggucguggaccucggcugcggccgcgggggauggagcuacuauuguggcgggcugaaaaauguucgggaagugaagggacuuacaaaaggcgggccgggacaugaggagccuauucccauguccacguacggcuggaaccuggucagacuccaaagcggcguggauguguuuuucacacccccugaaaagugcgacacacugcugugugauaucggggaguccucucccaauccuaccauugaagccggacgcacacuccggguucuuaaccuggucgagaauuggcugaacaauaacacccaguucugcaucaaggugcucaauccguauaugcccagcgugaucgagaagauggaggcucugcagagacaguacggcggggcccuuguccgcaacccucuguccagaaauucuacgcacgagauguacuggguuagcaacgcgaccggaaauauuguguccucugugaacaugaucagcagaaugcucauuaaucgcuuuacaaugaagcacaaaaaggccaccuaugaacccgacgucgaucugggcuccgggacacggaacaucggaauugagagcgaaaucccuaaccuggacauuaucggcaaaagaaucgagaagauuaagcaagaacaugagaucucuuggcacuacgaccaggaucaucccuauaaaaccugggcuuaccacggcuccuaugagacaaagcagaccgggagcgccucuuccauggugaauggaguugugcgccuccuuacgaaaccgugggacgucgugccuaugguuacacagauggcuaugaccgauaccacacccuucggccaacagcggguguuuaaggaaaaagucgacacgagaacccaggagccuaaggaagggacaaagaaacugaugaagauuaccgccgaguggcuguggaaagagcucggaaagaaaaagacaccccgcauguguaccagagaagaguucacacggaaagugcgcagcaacgcugcccugggcgcgaucuuuaccgaugaaaauaaguggaagucugccagagaggcuguggaagacgggcgguucugggagcuugucgauagagagcggaaccugcaccucgaaggaaaaugcgagacguguguuuacaauaugaugggcaagcgcgagaagaagcugggcgaguuugggaaagccaagggauccagagcuauuugguauauguggcugggcgcccgguuccucgaauuugaggcccugggguuccuuaacgaggaccauugguuuagccgcggaaauucccugagcggcguggaaggggagggccuccacagacugggauacauccuucgggaugugggcaagaaagaagggggagcgauguacgcugacgauaccgccggcugggacacacgcaucacccuggaggaccucaagaacgaagagauggucacaaaucauaugaaaggggagcacaagaaacuggccgaagcuauuuucaagcugaccuaucagaacaaggugguuagagugcaacggccuacgccccgcggaacagucauggauaucauuucuagacgggaccagcgcggcagcggacaggugggcaccuacggacucaauacauuuaccaacauggaggcccaacugaucagacagauggaaggcgaggggauuuucaaauccauccagcaucuuacggcuaccgaggaaaucgccguucagaauuggcuggcgcgggugggacgcgagagacucucucggauggccauuagcggcgaugacugcgucgugaagccgaucgaugacagauucgcuuccgcccugacagcucuuaacgauauggggaaaguucgcaaggacauucaacagugggaaccuucucggggauggaaugauuggacccaggugcccuuuugcagccaccacuuccaugagcuggucaugaaagacggcagagugcucgucgugcccugucgcaaccaggaugaacugaucgggcgggccagaauuucccaaggcgcgggauggucucugaaggagacagccugccucggcaagagcuaugcucagauguggacccugauguacuuucaccgccgggaccuuagacuggccgcuaacgccaucuguuccgcuguuccuagccauugggugccgacaucucgcaccacgugguccauucacgccaaacacgaguggaugacaaccgaagauaugcucgcggucuggaaucggguguggauccaggagaaccccuggauggaagacaagaccccuguggagagcugggaagagguucccuaucuggggaaaagagaggaccaguggugcggaucucuuaucggccugacaucccgcgccaccugggcuaagaauauucaaacagccaucaaccaggugcggagccucauugggaaugaagaguacacggauuauaugccuuccaugaaaagauuccggagagaagaggaagaggccggaguccugugguga

SEQ ID NO: 19761 - RNA, 9876 nt, Artificial Sequence
  derived and/or modified CDS sequence (opt5) from DENV-2__FJ744743__SS-prME
acagccggcgugaucgucaugcugauucccacagcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgggaaggacagcccggucaacauugaagccgagcccccuuuuggcgauucuuacaucauuaucggaguggaacccggccagcucaaacugaauugguucaagaagggguccagcaucggacaaauguuugagacaaccaugagaggcgcuaaacgcauggccauucuuggggacacggccugggauuucggaucucugggcgggguuuuuacaagcaucggcaaggcucuccaccagguguucggagccauuuacggcgcggcuuuuuccggggucucuuggaccaugaaaauccugauuggagugaucaucaccuggauuggcaugaacagccgguccacaagccugucugugucccuuguucucgucgggguggugacccuguaucugggagccgucgugcaggccgacagcggcuguguugugucuuggaagaauaaagagcucaagugcggguccggcaucuucauuacagauaacguccacacguggaccgaacaguacaaguuucaaccugagagccccuccaaacuggcuucugccauccagaaggcucaugaagagggaauuuguggcaucagaagcgugacacgccuugaaaaucugauguggaaacagaucaccccggagcucaaccacauucuguccgagaaugaaguuaagcugacaaucaugaccggggacauuaaaggaaucaugcaggccggcaagcggucucuuuggccucaacccacggagcucaaauauagcuggaagaccugggggaaggcgaaaaugcuguccacagaaagccauaaccagaccuuccugauugauggaccugagacagccgaaugccccaauaccaacagagcuuggaacucucucgagguggaggacuacggcuuuggcgucuucacaaccaacaucuggcugaaacuucgcgaaaaacaggacguguuuugugauuccaagcugaugagcgccgcuaucaaagacaaucgggccguucacgcggauaugggguauuggauugagucugcccucaacgacacguggaagauggaaaaggcuuccuucaucgaggugaaaagcugccacuggccuaagucucauacacuguggagcaauggaguccuggaguccgaaaugauuauccccaaaaacuucgccggcccggugagccagcacaacuacagaccuggguaucauacccaaaccgcuggacccuggcaccuuggcaagcucgagauggauuuugacuucugugaagggacaaccguggucguuacggaggauugcggaaaucgcggccccucucugcggacaaccacagccuccggcaaacugauuaccgaauggugcuguagaagcugcacacucccuccgcugcgguaccgcggggaggacggauguugguacggcauggagaucagaccccuuaaggaaaaggaggaaaaccuggugaauagccucgugaccgccgggcauggacagauugauaacuuuucucugggcguccuggggauggcucuuuuccucgaggaaaugcugcggacgagaaucggaaccaaacacgcgauccugcucguggccguuagcuuugugacacugauuaccggcaauauguccuuccgcgaccuuggccgggucauggugaugguuggggcuacaaugaccgaugacaucggaaugggcgugacguaucuggcccuccuggccgcuuuuaaggucagaccuacauucgccgcggggcugcuucugcgcaaacucaccucuaaggagcugaugauggcuacaauuggaaucgcccuccugagccaguccaccauucccgagaccauccuugaacugacagaugcccucgcucugggcaugauggugcugaaaaucguuagaaacauggagaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaaggggcucaaucccacagccaucuuucugaccacgcugagccggacaucuaaaaagcgcuccuggccgcuuaacgaagcgauuauggccgugggaauggugagcauccuggcuucuucccuccugaaaaaugacauuccuaugaccggcccccucgucgccggcgggcugcuuaccgugugcuauguucugacaggaagaagcgcugaucuggagcucgaacgggccgccgacgugaagugggaggaucaagcugagaucuccggcagcucuccuauucugagcaucaccauuuccgaagacgggucuaugagcaucaaaaacgaggaagaggagcagacacuuacgauccugauucgcaccggacuccuggucaucuccggcguguuccccguuucuauuccgaucacagcggccgcuugguaccucugggaagugaagaagcagagagccgggguccugugggaugugccuucucccccucccgucgagaaagccgaacuugaggacggagcuuaucggauuaagcagcgcggcauccugggcuacucccaaaucggggccggaguguauaaagaaggcaccuuucacacaauguggcauguuaccagaggggcggugcugaugcaccggggaaagcgcauugagcccuccugggcugaugucaaaaaggaccucaucagcuacggcgggggauggaagcuggagggcgaauggaaagagggcgaagaggugcagguucuugcccuggaaccugggaagaauccgagagccgugcagacgaaacccggaauuuucaagaccaacacaggcaccaucggggcugucucccucgauuuuagcccuggaacaucuggcucccccauuguggaccggaaagggaaggugguuggacuguacggcaauggcgucgugaccagaagcggggccuaugugucugcgaucgcucagacagagaaguccaucgaggauaacccugaaauugaggacgauaucuuccgcaaaaagcggcucacgauuauggaccugcaucccggagccggcaaaaccaagagauaccuuccugccaucguccgcgaagcuauuaaacgggggcugagaacacugauccucgccccgacccgcgugguugcugccgagauggaagaggcgcugcggggacuucccauuagauaucaaaccccugccaucaagacagagcacacgggccgcgaaaucguggaccugaugugucaugcuaccuucacaaugcggcuccugagccccgucagagugccuaacuacaaucucauuaucauggaugaggcccacuuuaccgaccccgcuuccauugccgcccggggguauaucucuacacgcguugaaaugggcgaggcugcgggaauuuucaugaccgccacgccgccuggcagcagagaucccuuuccccaguccaacgcuccuaucauggacgaggaacgggagauccccgaacgcagcuggaacucugggcacgagugggugacagauuucaagggaaaaaccgucugguuugugccuuccauuaaggccggcaacgacaucgccgcuugccugcgcaagaaugggaagaaaguuauucagcuuagccggaagaccuucgauucugaauacgugaagacaagagccaacgacugggauuuugucgugaccacagacaucagcgagaugggagcgaauuucaaagcugagcgcgugauugauccgcggagauguaugaagcccgucauccugaccgacggcgaagaaagaguuauccuggccgggccuaugcccgugacgcauuccucugccgcucaacggagaggccgcauuggacggaacccuaaaaaugaaaacgaccaguauaucuacaugggcgagccccucgaaaaugaugaggacugcgcccacuggaaggaggcgaaaaugcugcuugauaacauuaauacaccggaagggaucauuccuagcauguuugagcccgaaagagagaagguggacgccaucgauggagaauaccgccugagaggcgaggcucggaaaaccuucgucgaccucaugcgcagaggggaucugccuguguggcuggccuauaagguugcugccgagggaauuaacuacgcugaccggaagugguguuuugauggcaucaaaaauaaccagauccucgaagagaacauggaaguggagauuuggacaaaggagggggaacgcaagaaacuuaaacccagauggcuggacgcccggaucuauuccgauccucuggcgcucaaagaguucaaggaguucgccgcuggcagaaaaucucugacccuuaaucugauuacggagaugggacgccuccccaccuuuaugacacagaaggcccggaacgcucuggacaaucuggccguccuccauaccgccgaagcuggcgggagagcguacaaccacgcccuuagcgagcugccggagacacuggaaacccuccugcuucugacacuccuggcuaccgugacgggaggcaucuuccuguuucucauguccgggaaaggaauuggcaagaugacacuuggcaugugcugcaucaucaccgccagcauucugcugugguaugcccaaauccagccucacuggauugcugccucuaucauucucgaguucuuucugaucguucuucugauccccgaacccgagaaacagcgcaccccucaggauaaucaacucacauacguggucauugcgauccugaccguggucgccgcuacaauggccaacgaaaugggguuccuggagaagacgaagaaagaccucggacuuggcuccgugaccacacaggagagcgaauccaauauucuggacaucgaucugcggccggcuucugccuggacccucuaugcgguugccacaaccuuugugacgcccaugcugagacauagcauugagaacuccucugugaaugucagccuuaccgcuaucgccaaccaggcuacaguucugauggggcucggaaagggcuggccucuguccaaaauggacauuggggugccccugcucgccaucggauguuacagccaggugaauccuaucacccuuacagcuacccugcugcgguucgucgcccaauacgcgauuaucggccccggccuccaggccaaggcuacgcgcgaagcccagaaaagagcugccgccgggauuaugaagaacccuacaguggauggaaucaccguuauugaccuggagccgauccccuaugauccuaaguuugaaaaacagcuuggccaagugaugcugcucauccugugcgucacacaggugcugaugaugcggaccaccugggcgcucugugaggcucuuacacuggccacggggcccauuucuacccugugggagggaaauccuggccgcuucuggaacacaaccaucgcugucuccauggccaauauuuuuagagggagcuaccucgccggagcuggccugcuuuucucuaucaugaagaacacaaccuccacgcggcgcggcacagggaauauuggagaaacccugggcgagaaauggaaaagcagacucaacgcccuggggaaaucugaauuucagaucuauaagaaaagcggaauccaagagguggaccggacccuggcgaaggagggcauuaagcgcggggaaacagaucaccaugccguuuccagaggaucugcuaaacuccggugguucguggagagaaacauggucacccccgaaggcaaggugguugaccuuggcugcgggcgcggaggcuggagcuacuauugugggggacugaaaaaugugcgggaggucaagggccugacaaaagggggaccgggccacgaggaaccuauccccauguccacguacggcuggaaccucgugagacugcagagcgggguggauguuuucuuuacacccccugagaagugcgacacccuucugugugauauuggagaauccucucccaauccuaccaucgaggccggccgcacacuccggguccugaaccugguggaaaauuggcucaacaauaacacccaguucugcauuaaggugcuuaauccguauaugcccagcgucaucgagaaaauggaagcucugcagagacaauacgggggagcccugguucgcaacccucucuccagaaauucuacgcaugagauguacugggugagcaacgcgaccggcaauaucguguccucugucaacaugauuagcagaaugcugaucaaucgcuuuacaaugaagcacaaaaaggccaccuaugagcccgacguggaucuuggguccggaacacggaacauuggcaucgaaagcgagauuccuaaccuggacaucauuggcaaaagaaucgaaaagaucaagcaggagcacgaaauuucuuggcauuacgaccaggaucaccccuauaaaaccugggcuuaccauggguccuaugagacaaagcagaccggaagcgccucuuccaugguuaauggcgugguccgccuccugacgaaaccgugggacgugguuccuauggugacacaaauggcuaugaccgauaccacacccuucgggcagcagcgggucuuuaaggagaaaguggacacgagaacccaggaaccuaaggagggaacaaagaaacugaugaagaucaccgccgaauggcucuggaaagagcuuggcaagaaaaagacaccccgcauguguaccagagaggaguucaccaagaaggugcggagcaacgcugcccugggggcgauuuuuaccgaugagaauaaguggaaaucugcccgcgaagcugucgaggacggaagauucugggaacugguugaucgggagagaaaccuccaccuggagggcaagugcgaaacguguguguacaauaugaugggcaaacgggagaagaaacuuggggaauuuggaaaggccaagggcucccgcgcuaucugguauauguggcugggggccagauuccucgaguuugaagcccugggauuccugaacgaggaccacugguuuagccggggcaauucccucagcgggguggagggcgaaggacugcaucgccuuggcuacauucugagagaugucgggaaaaaggagggaggcgcgauguacgcugacgauaccgccgggugggacacacggaucacccucgaagaccugaaaaacgaggaaauggugacaaaucacaugaagggagagcauaagaaacuugccgaggcuaucuucaaacugaccuaucaaaacaaaguugugcgcguccagagaccuacgccccggggcacagugauggauauuaucucucgcagagaccagcgggggagcggccaaguuggaaccuacggccucaauacauucaccaacauggaagcccagcugauucgccagauggagggggaaggaaucuuuaaguccauucagcaccugacggcuaucgaggagaucgccgugcaaaauuggcucgcgagagucggccgggaacgccugucuagaauggccauuagcggggaugacugcgugguuaaaccgaucgaugaccgguucgcuuccgcccuuaccgcucugaacgauaugggaaaggugagaaaagacauucagcagugggagccuucucgcggcuggaaugauuggacacagguccccuuuugcagccaucacuuccacgaacucgugaugaaggacgggcggguccuggugguucccuguagaaaccaagaugagcuuaucggccgcgcccggauuucccagggagcgggcuggucucugaaggaaaccgccugccucgggaaaagcuaugcucagauguggacacugauguacuuucauagacgcgaccugcggcucgccgcuaacgccaucuguuccgcugugccuagccacugggucccgaccucuagaacaaccugguccauucaugccaagcacgaguggaugacgacagaggauaugcuggcgguguggaaucgcguguggauccaggaaaaccccuggauggaggacaaaaccccuguugaaagcugggaggaagugcccuaucuuggaaagcgggaggaccaauggugcggcucucugaucgggcucaccuccagagccacaugggcuaaaaauauucagaccgccaucaaccagguccgcagccugauuggaaaugaggaauacacagauuauaugccuuccaugaagcgguucagacgggaggaagaggaagccggcgugcuuugguga

SEQ ID NO: 19762 - RNA, 9876 nt, Artificial Sequence
  derived and/or modified CDS sequence (opt5) from DENV-2__JN819424__SS-prME
acagcuggcgugaucgucaugcugauucccacggcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaagugcccccuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaagaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccucuuccaucgacaauagagcuguucacgccgauaugggcuauuggauggaaagcgcgccuucugacagcugcaaaauggagaaggccuccuucauugaggauaagagcuguuacuggcccaacucucagcaccucugguccaauggggugcuggaaagcgagaugaucuucccgaaaaacuuugcuggaccugucucccaacauauuuaucgccccggcuaccacacgcagacagccgggcccugcaaccugggaaaacuugaaauggacuucgauuuuugcgagggcaccaccgugguggucacagaagacugugggaaucggggaccuucucucagaaccacgacagcuagcggcaaacugaucaccgaguggugcugucgguccugcacacugccgccccuccgcuacagaggcgaggauggguguugguauggaauggaaauucggccucugaaggagaaagaagagaaccuuguuaauucucuggugaccgccggccaugggcagaucgacaacuucagccucggagugcugggcauggcccuguuucuugaagagaugcucagaacacgcauugggaccaagcacgcuauccugcuggucgcgguguccuucguuacgcucaucaccggaaauaugucuuuucgggaucugggcagagugauggucauggugggcgccacaaugaccgacgauauugggaugggaguuacauaccuugcucugcucgccgccuucaaggugcgccccaccuuugcugccggccugcugcuuagaaaacugacgagcaaggagcucaugauggcgacaaucgggauugcucugcucucccaaagcaccaucccugaaacaauucuggagcuuaccgacgcccuggcccucggaaugaugguccugaaaaucgugcggaacauggaaaaguaucagcuggcuguuaccaucauggccauuucuugcgugcccaaugcggucauccuucagaacgcuuggaaaguguccuguacaauucuggccgccgugagcgucucuccucuccugcucacguccagccagcaaaaggcugacuggaucccccuggcccuuaccauuaagggccugaauccgacagcuaucuuccucaccacacugucucgcaccuccaaaaagagaagcuggccucugaacgaggccaucauggcgguugggaugguguccauucuugccagcucucugcucaaaaaugauauccccaugacgggaccucugguggcuggcggccuccugacagucugcuacgugcuuaccgggcggagcgccgaccuggaacuggagcgcgcugccgauguuaagugggaggaccaggccgaaauuuccggaucuagccccauccucuccauuaccaucucugaggauggcagcauguccauuaaaaacgaagaggaggaacagacacugaccauccuuaucagaacagggcugcucgugauuucuggagucuuuccggugagcaucccuauuacggcugcggccugguaucugugggagguuaagaaacagcgggcuggcgugcucugggacguccccuccccuccgcccguggaaaaggccgagcuggaagauggggccuaccgcaucaagcaaagagggauucuuggcuauagccagaucggcgcuggggucuacaaagagggaaccuuccauacaauguggcacgugacccggggcgccguucugaugcaccgcgggaagagaaucgagccuucuugggcggacgugaaaaaggaucugauuuccuacggaggcggguggaaacucgaaggagaguggaaggaaggcgaggaaguccaggugcuggcucuugagccgggcaagaauccccgggccguucagacaaaaccugggaucuuuaagaccaacacgggaaccauuggcgccgugagccuggacuucucucccgggacauccggaagcccuaucgucgauagaaaaggcaaggugguggggcucuauggaaauggcguugucacccgcuccggcgcuuacgugucugccauugcgcaaacagagaaaagcaucgaagacaaccccgagaucgaagaugacauuuuccggaagaagagacugaccaucauggaccuccauccuggggcuggaaaaacaaagcgcuaucugccggccauugugcgggaggccaucaaaagaggccuucgcacgcugauucuggcucccacccgggucguggccgcugaaauggaggaggcccucagagggcugccuauccgcuaccagacacccgcgauuaagaccgaacacaccggacgggagaucguugaucuuaugugucaugccacauuuacgaugagacugcucuccccugugcggguccccaacuauaaucugaucauuauggacgaagcucacuucaccgauccggccagcaucgcugcccgcggcuacauuucuacaagaguggagaugggggaggccgcuggcaucuuuaugaccgcgacaccucccggaucccgggaccccuucccucagagcaacgcccccauuauggaugaggagcgcgaaaucccugagagaucuuggaauagcggccaugaauggguuaccgacuuuaaagggaagacggugugguucgucccguccaucaaggcuggaaacgauauugccgccugccuccggaaaaauggcaagaaagugauccaacugucuagaaagacauuugacagcgaguauguuaaaacccgcgcuaacgauugggacuucguggucaccacagauauuuccgagaugggggccaauuuuaaggcggaacgggugaucgaccccagacgcuguaugaagccugugauucuuaccgacggagaggaacgggucauccuggcuggccccaugccuguuacacacucuagcgccgcccagagacgcgggcggaucggcagaaaccccaaaaaugagaacgaucaguacauuuacaugggagaaccgcuggagaaugacgaggauugcgcucacuggaaggaagccaaaaugcuccuggacaacaucaauaccccugagggcauuauccccuccauguucgaaccugagcgcgaaaagguggaggcgauugauggggaguauagacuucggggagaagcccgcaaaacguuuguggaccugaugagacggggcgaucuccccguccgccuggcuuacaagguggccgcugaggggaucaacuaugccgacagaaaauggugcuucgauggaauuaagaauagccagauccuggaagagaacauggagguugaaaucuggacaaaggagggcgaacggaaaaagcucaaaccuagauggcuugacgcucgcauuuacucugauccccuggcccugaaggaguucaaagaauuugcggccgggcggaagucccucacccugaaccuuaucacagagaugggcagacugccgaccuucaugacgcaaaaggcucgcaaugcccucgacaaccuggcugugcugcauaccgccgaggccggaggccgggcuuauaaucacgcgcucagcgaacuuccugagacacuggaaacccugcuccugcuuacacugcucgccaccgucacagggggaauuuuucuguuccugauguccggcaaagggaucggaaagaugacccucggcauguguugcauuaucacggcuucuauccuucugugguacgcccagauucagccccauuggaucgccgcuagcauuauccuggaguuuuuccucauugugcugcuuauccccgaaccugagaaacagagaacaccgcaagauaaccagcugaccuauguugugaucgccauucucaccgucguggcggccacaauggcuaaugagaugggcuuucuggaaaagaccaaaaaggaccuggggcucggauccaucacaacgcaggagucugaaagcaacauucuugacaucgaucugcggcccgccuccgcuuggacccuguacgccgucgcgacaaccuucgugacaccuaugcuccgccacagcauugaaaauucuuccguuaacgugagccugaccgccaucgcuaaucaggccacggugcuuaugggccuggggaagggauggccccucucuaaaauggacauuggcgucccucugcuggcuaucggguguuacucccaaguuaaccccaucacccucacagccgcccuucugcugcucguggcccacuaugcgauuaucggaccuggccugcaggccaaggcuaccagagaagcccagaaacgggcugccgccggcauuaugaagaauccgacaguggaugggaucaccgucauugaccuugagcccaucccuuacgaucccaaauuugagaagcagcugggacaagugaugcuccugauccugugcguuacacaggugcucaugaugcgcacaaccugggcgcuuugugaagcucugacacuggccaccggcccuauuagcacccucugggaggggaaccccggaagauucuggaauacaacgaucgcugucucuauggccaacauuuuucggggcagcuaucuggccggggcuggacuucuguucuccaucaugaagaauaccacaucuacccgcagaggcacaggcaacauuggggaaacccucggagagaaauggaaaagccggcugaaugcccugggcaaauccgaguuucagaucuacaagaaaagcgggauccaagaaguggaccgcacgcucgcgaaggagggaauuaaaagaggcgaaacagaucaucacgccgucucccgggggucugcuaaacuuagaugguucguggagcgcaacaugguuaccccggaaggaaagguggucgaccugggcugcggccggggaggauggagcuauuacuguggcgggcugaaaaacgugagagagguuaagggacucaccaaaggcgggccuggacaugaggaacccauccccauguccacauauggcuggaaucuggugcgccuucagucuggcgucgauguguucuuuaccccucccgagaagugcgacacacugcucugugauauuggggaaagcuccccuaacccgacgaucgaggccggacggacccugagagugcugaaucucguugaaaacuggcuuaauaacaauacacaguucugcauuaaaguccugaaccccuacaugccuucugugaucgagaagauggaggcucugcagcgccaauacggcggggcccucgugcggaauccccugagcagaaacuccacccacgaaauguauugggucagcaaugcgacaggaaacaucguuucuuccgugaauaugauuagccgcaugcuuaucaaccgguuuaccaugaagcauaaaaaggccacguacgagccugacguggaucugggcucugggaccagaaauauuggaaucgaauccgagauucccaaccucgacaucauuggcaaacgcaucgaaaagaucaaacaggagcacgagauuagcuggcacuaugaccaggaucauccguacaagacaugggcuuaucacggcucuuacgaaaccaagcagacaggguccgccagcuccauggucaacggagugguucggcugcugaccaaaccuugggacgugguccccauggugacacaaauggcuaugaccgauacgacaccuuucggccagcagagaguuuuuaaggagaaaguggacacccgcacccaggaacccaaggaggggaccaagaagcucaugaagaucacggccgaguggcuuuggaaagaacugggaaagaaaaagaccccuagaauguguacacgggaggaguucaccaaaaagguccgcagcaaugcugcccugggcgcgauuuuuacagaugagaacaaauggaagucugccagagaagcuguggaggacgggcgguucugggagcucguggauagagaacggaaucugcaucuugagggaaagugcgaaaccugcgucuauaacaugaugggcaaacgcgagaagaaacugggcgaauuugggaaggccaaaggaagcagagcuaucugguacauguggcucggcgcccgguuccuggaguuugaggcccugggguuccucaaugaagaccacugguuuucccgcggaaacucucugagcggcguugagggggaaggccuucacagacugggauacauucuccgggaugugggcaagaaggaagggggagcgauguaugcugacgauacagccggcugggacacccgcaucacgcuggaagaccuuaaaaaugaggagauggugaccaaccauaugaagggggaacacaaaaagcuggccgaggcuaucuucaaacucacauaccaaaauaaggucgugagaguucagcggcccaccccgcgcggaacagugauggauauuaucuccagacgggaccagcgcggcucugggcaagucggcaccuauggacugaacacguucacaaauauggaagcccagcugauuagacagauggagggcgaggggaucuuuaagagcauucagcaucucaccgcuacagaagagaucgccgugcaaaacuggcuggcgcggguuggacgcgaaagacuuucccggauggccaucucuggcgaugacuguguggucaaaccuauugaugacagauucgcuagcgcccugaccgcucucaaugauauggggaaggugcgcaaagacauccagcagugggagcccucccggggauggaacgauuggacgcagguucccuuuugcagccaccauuuccacgaacuggugaugaaggacggcagaguccuuguggucccuugucgcaaucaagaugagcugauugggcgggccagaaucucucagggcgcgggauggucccucaaagagaccgccugccugggcaagagcuacgcucagauguggacacugauguauuuucaccgccgggaccucagacuggccgcuaacgccauuuguucugcugugccgucccauuggguucccaccagccgcacaaccugguccauccacgccaagcaugaauggaugacaaccgaggauaugcuugcgguguggaaccgggucuggauucaggaaaauccuuggauggaggacaaaacgcccguggaaucuugggaggaggugccuuaccuggggaagagagaagaccaauggugcggaagccucaucggccugacaucccgcgccaccugggcuaaaaacauccagaccgccauuaaucagguucggagccuuaucgggaacgaggaauauacagauuacaugcccucuaugaagagauuccggagagaggaagaggaggccggagugcugugguga

SEQ ID NO: 19763 - RNA, 9876 nt, Artificial Sequence
  derived and/or modified CDS sequence (opt5) from DENV-2__FJ744741__SS-prME
accgccggagugaucgucaugcugauucccacagcuauggccuuccaccucacgaccagaaauggggagccucauaugaucguuggacggcaggaaaagggcaaaagccugcuuuuuaagaccgaggacggggugaauaugugcacccugauggcgauugaucucggagaacugugugaggacacaaucaccuacaaaugcccccuucugagacaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggagagugagcuguaccauccuggccgcuguguccgucagcccccuccugcuuacaucuucccagcagaaggccgacuggauuccucuggcucucaccaucaagggccugaaucccacagccaucuuccugaccacgcuuagccggacaucuaaaaagcgcuccuggccgcugaacgaggcgauuauggccguugggauggugagcauccucgcuucuucccugcucaaaaaugacauuccuaugaccggaccccugguggccggcggccuucugaccgucugcuaugugcugacagggagaagcgcugaucucgaacuggagcgggccgccgacguuaagugggaggaucaagcugaaaucuccggaagcucuccuauucuuagcaucaccauuuccgaggacggcucuaugagcaucaaaaacgaagaggaggaacagacacugacgauccucauucgcaccgggcugcucgugaucuccggagucuuucccgugucuauuccgaucacagcggccgcuugguaccugugggagguuaagaaacagagagccggcgugcuuugggaugucccuucucccccucccguggaaaaggccgagcuggaagacggggcuuaucggauuaagcagcgcggaauccugggcuacucccaaaucggcgccggggucuauaaagagggaaccuuccacacaauguggcaugugaccagaggcgcgguucucaugcaccgggggaagagaauugagcccuccugggcugaugugaaaaaggaccugaucagcuacggaggcggguggaaacuugaaggagaguggaaggaaggcgaggaaguccaggugcuggcccucgagccuggcaagaauccgcgcgccguucagacgaaacccgggauuuuuaagaccaacacaggaaccaucggcgcugugucccuggauuucagcccugggacaucuggaucccccauugucgaccggaaaggcaaggugguggggcucuacggaaauggcguugucaccagaagcggcgccuaugugucugcgaucgcucagacagagaaauccaucgaagauaacccugagauugaagacgauaucuuucgcaagaagcggcugacgauuauggaccuucaucccggggccggaaaaaccaagagauaccugccugccaucgugcgcgaggcuauuaaacggggccugagaacacucauccuggccccgacccgcgucguggcugccgaaauggaggaggcgcuucgggggcugcccauuagauaucaaaccacagccaucaagacggaacacaccggacgggagaucguugaccucaugugucaugcuacauucaccaugcgccugcucagcccugugagaguccccaacuacaaucugauuaucauggaugaagcccacuucacagacccugcuuccauugccgcccggggcuauaucucuacccgcguggagaugggggaggcugcgggcauuuuuaugacggccacacccccgggaagcagagauccuuucccccaguccaacgcucccaucauggacgaggaacgggaaaucccugagagaagcuggaacucuggccacgaauggguuaccgauuuuaaagggaagaccgugugguucguccccuccauuaaggccggaaacgacaucgccgcuugccuucgcaaaaauggcaagaaagugauucagcugagccggaagacauuugauucugaguacguuaaaaccagagccaacgacugggauuucguggucacaaccgacaucagcgagaugggggcgaauuuuaaggcugaacgcgugauugauccucggagauguaugaagccggugauccugacggacggagaggaacgcgucauccucgccggccccaugccuguuacacauuccucugccgcucaacggagagggcgcauuggcagaaaccccaaaaaugagaacgaccaguauaucuacaugggagaaccucuggagaaugaugaggacugcgcccacuggaaggaagcgaaaaugcuucuggauaacauuaauacccccgagggcaucauuccgagcauguucgaaccugagcgggaaaagguggacgccaucgauggggaguaccgccucagaggagaggcucggaaaacauuuguggaccugaugcgcagaggcgaucugcccgucuggcucgccuauaagguggcugccgaagggauuaacuacgcugaccggaaaugguguuucgauggaaucaagaauaaccagauccuugaggaaaacauggagguugagauuuggaccaaggaaggcgagcgcaagaagcugaaaccucgcuggcuggacgcccggaucuauuccgauccccucgcgcugaaggaauuuaaagaguucgccgcugggagaaagucucuuacgcugaaucucauuaccgaaaugggccgccugccuacauucaugacccagaaggcccggaacgcucuggacaaucucgccgugcuucauacagccgaggcuggaggcagagcguacaaccacgcccugagcgagcugcccgaaacccucgagacacugcuucugcucacccugcuggcuacggucacagggggaaucuuucucuuccuuauguccggcaaagggauuggaaagaugacccugggcaugugcugcaucaucaccgccagcauucugcucugguaugcccaaauccagccgcacuggauugcugccucuaucauucuggaauuuuuccuuaucgugcugcucaucccugagcccgaaaaacagcggacaccccaggauaaucaacugaccuacguugugauugcgauccugacagucguggccgcuacgauggccaacgagaugggcuuucucgagaagaccaaaaaggaccuugggcugggauccauuacaacccaggaaagcgaguccaauauccuggacauugaucuccgcccugcuucugccuggacacuguaugcggucgccaccacguucgugaccccgaugcuuagacauagcaucgaaaacuccucuguuaaugugagccugacagcuauugccaaccaggcuaccgugcucaugggccuggggaagggauggccccuguccaaaauggacaucggcgucccucuccuugccaucggguguuacagccagguuaaucccauuacacugaccgcugcccugcuccugcuuguggcgcacuacgccaucauuggaccuggccugcaagcuaaggccacgcgggaggcucagaaacgcgccgccgcgggcaucaugaagaaccccacaguggaugggauuaccgucaucgaccucgaaccuaucccguaugaucccaaauuugagaagcagcugggacaggugaugcugcucauucuuugcguuacacaagugcugaugaugagaaccaccugggcucugugugaggcccucacacuggcuacgggcccuaucucuacccuuugggaagggaaucccggacgguucuggaacacaaccauugccgucuccauggccaauaucuuucgcggcagcuaccuggcuggggccggacuccuguucucuauuaugaagaacacaaccaauacgagacggggcacaggcaacaucggggagacccugggagaaaaauggaagucccgccucaacgcgcuuggcaaaagcgaguuucagaucuauaagaaaucugggauucaggagguggacagaacccuggccaaggaaggaaucaaacggggcgagacagaucaucacgcugucagcagaggguccgccaagcugcgcugguucguggaacggaauaugguuaccccugagggaaagguggucgaccucggcugcggcagagggggauggucuuacuauuguggcgggcugaaaaacgugcgcgaaguuaagggacuuacaaaaggcgggcccggacaugaggagccgauuccuaugagcacguacggcuggaaucuggugcggcuccaauccggcgucgauguguuuuucacaccgcccgaaaagugcgacacacugcugugugauaucggggagagcuccccuaaccccaccauugaagcuggaagaacacuccgcgugcuuaaucugguugagaacuggcugaauaacaauacccaguucugcaucaaaguccucaacccuuauaugccgucugugaucgaaaagauggaggcccugcagcggaaguacggcggggcgcuugugagaaauccccugagccgcaacuccacgcacgagauguacugggucucuaaugccaccggaaacauuguuagcuccgugaauaugaucucucggaugcucauuaacagauuuacaaugaaacacaagaaagcuaccuaugaaccugacguggaucugggcagcgggacacgcaacaucggaauugaguccgaaauccccaaucuggacauuaucggcaagcggaucgagaaaauuaagcaggaacaugagaccagcuggcacuacgaccaagaucauccuuauaagacaugggccuaccacggcucuuaugagaccaaacagacgggguccgcuagcucuauggucaacggagugguuagacuccuuacaaagcccugggacguggucccgauggugacccagauggccaugaccgauacaacgccuuucggccagcaacgcguuuuuaaagaaaagguggacaccagaacacaggagcccaaagaagggaccaagaagcugaugaaaaucacagcugaguggcuguggaaggagcucggcaagaagaaaaccccucggauguguacacgcgaagaguucaccagaaagguccgguccaaugccgcgcugggcgccauuuuuacggaugaaaacaaauggaaaagcgcuagagaggccguggaagacgggcgguucugggagcuuguggaucgcgagagaaaucugcaccucgaaggaaagugcgagaccugugucuacaacaugaugggcaaacgggaaaagaaacugggcgaguuugggaaggcuaaaggaucucgcgccaucugguauauguggcugggcgccagauuccucgaauuugaggcgcugggguuccuuaaugaggaccauugguuuucccggggaaacagccuguccggcguugaaggggagggccuccaccgccugggauacauucuuagagaugugggcaagaaggaagggggagcuauguacgccgacgauacagccggcugggacacccggaucacacuggaggaccucaaaaaugaagagauggugaccaaccauaugaagggggagcacaaaaagcuggcugaagccaucuucaaacugacguaucagaauaaggucgugcgcguucagagacccacaccucggggaaccgugauggauauuaucagccgcagagaccaacggggcucugggcaggucggcacauacggacucaacaccuuuacgaauauggaggcucagcugauucgccaaauggaaggcgaggggaucuucaagagcauucagcaucuuaccgccacagaggaaaucgcggugcagaacuggcuggccagaguuggacgggagagacucucccgcauggcuaucucuggcgaugacugcguggucaaacccauugaugaccgguucgccagcgcucugaccgcccuuaaugauauggggaaggugagaaaagacauccagcaaugggaaccgucccgcggauggaacgauuggacacagguuccuuuuugcucucaccacuuccaugagcuggugaugaaggacggccggguccucgugguccccuguagaaaccaggaugaacugauugggcgcgcgcggaucagccagggcgccggauggucccugaaagagaccgcuugccucggcaagucuuaugcccaaauguggacacugauguacuuucacagacgcgaccuucggcuggcugccaaugcuauuuguagcgccgugcccucccauuggguuccuaccagcagaacgacauggucuauccacgcgaagcacgaguggaugaccaccgaagauaugcucgccguguggaaccgcgucuggauucaggagaauccguggauggaagacaaaacacccguggaguccugggaagaggugccuuaucuggggaagcgggaggaccaguggugcggaagccuuaucggccugaccucuagagcuacaugggccaaaaacauccagacggccauuaaucaaguucggucccucaucgggaacgaagaguacaccgauuauaugcccagcaugaagagauuccgccgggaagaggaagaggcuggagugcugugguga

SEQ ID NO: 19764 - RNA, 9876 nt, Artificial Sequence
  derived and/or modified CDS sequence (opt5) from DENV-2__FJ744703__SS-prME
acagccggcgugaucgugaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaaaugcccccuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggaccgauaaacuucaacugaaagggaugucuuacagcauguguacaggaaaguucaagaucgucaaagaaauugcggagacgcagcacggcaccaucgugaucagaguccaguaugagggggacggaucccccugcaagauucccuucgaaaucacagaucucgagaaacgccaugugcugggccggcugauuaccguuaacccuaucgugacagaaaaggacagcccggucaacauugaggccgaacccccuuuuggggauucuuacaucauuaucggcguggagcccggacagcucaaacugaauugguucaagaagggcuccagcaucgggcaaauguuugagaccacgaugagaggagcuaaacgcauggccauucuuggcgacacagccugggauuucgggucucugggaggcguuuuuaccagcaucgggaaggcucuccaccagguguucggcgccauuuacggagcggcuuuuuccggcgucucuuggaccaugaaaauccugauuggggugaucaucacauggauuggaaugaacagccgguccaccagccugucugugucccuuguucucgucggcguggugacacuguaucugggggccgucgugcaggccgacagcggauguguugugucuuggaagaauaaagaacucaagugcggcuccgggaucuucauuacggauaacguccacaccuggacagagcaguacaaguuucaaccugaaagccccuccaaacuggcuucugccauccagaaggcucaugaggaaggcauuuguggaaucagaagcgugacccgccuugagaaucugauguggaaacagaucacaccggagcucaaccacauuccuuccgaaaaugagguuaagcugaccaucaugacgggcgacauuaaagggaucaugcaggccggaaagcggucucugagaccccaaccuaccgaacuuaaauauagcuggaagacauggggcaaggcgaaaaugcucuccaccgagagccauaaccagacauuccugauugaugggcccgaaaccgccgagugcccuaauacaaaccgcgcuuggaacucucuggagguggaagacuacggauuuggcgucuucaccacgaacaucuggcucaagcugcgggagaaacaggacguguuuugugauuccaaacuuaugagcgccgcuaucaaagacaauagagccguucacgcggauaugggcuauuggauugaaucugcccugaacgacacauggaagauggagaaggcuuccuucaucgaggugaaaagcugccacuggcccaagucucauacccucuggagcaaugggguccuggaauccgagaugauuaucccgaaaaacuucgccggaccugugagccagcacaacuaccgccccggcuaucauacccaaacagcugggcccuggcaccugggaaaacuugaaauggauuuugacuucugugagggcaccacgguggucguuacagaagauugcgggaaucggggaccuucucucagaaccacaaccgccuccggcaaacugauuacagaguggugcugucggagcugcacccugccgccccuccgcuacagaggcgaggacggguguugguacggaauggaaauccggccucugaaggagaaggaagagaaccuugucaauucccuggugacggccggccaugggcagauugauaacuuuucucucggaguccugggcauggcucuguuccuugaagagaugcucagaacccgcaucgggacaaaacacgcgauccugcugguggccguuagcuuugugacccucauuacaggaaauauguccuuccgggaccugggcagagucauggugaugguuggcgcuaccaugacggaugacaucgggaugggagugacauaucuugcccugcucgccgcuuuuaagguccgccccaccuucgccgcgggccugcugcuuagaaaacugacaucuaaggagcucaugauggcuaccauugggaucgcccugcucagccaguccaccauuccugaaacaauccuggagcuuacggaugcccuggcucucggaaugauggugcugaaaaucguucggaacauggaaaaguaccaacuggccgugaccauuauggcgaucucuugcguccccaaugcugugauucuucagaacgccuggaaggugagcuguacaauccuggccgcugucuccguuagcccucuccugcucaccucuucccagcagaaagccgacuggauuccccuggcucuuacaaucaagggccugaauccgaccgccaucuuucucacgacacugagccgcaccucuaaaaagagauccuggccucugaacgaggcgauuauggccguggggauggugagcauccuugcuucuucccugcucaaaaaugacauucccaugaccggaccucuggucgccggcggccuccugacagugugcuauguucuuaccgggcggagcgcugaucuggaacuggagcgcgccgccgacgugaagugggaggaucaagcugaaaucuccggaagcucucccauucucagcaucacaauuuccgaggacggcucuaugagcaucaaaaacgaagaggaggaacagacgcugaccauccuuauuagaacagggcugcucgucaucuccggaguguucccgguuucuauuccuaucaccgcggccgcuugguaccugugggaggugaagaagcagcgggccggcguccucugggaugugcccagcccuccgcccgucgaaaaagccgagcuggaagacggggcuuaucgcauuaagcagagaggaauccuuggcuacucccaaaucggcgccgggguguauaaagagggaacauuucacaccauguggcauguuacgcggggcgcggugcugaugcaccgcgggaagagaauugagccuucuugggcugaugucaaaaaggaccugaucagcuacggaggcggguggaagcucgaaggagaguggaaagaaggcgaggaagugcagguucuggcccuugagccgggcaagaauccccgggccgugcagaccaaaccugggauuuucaagacaaacaccggaacaaucggcgcugucucccuggauuuuagccccgggaccucuggauccccuauuguggacagaaaaggcaaggugguugggcucuacggaaauggcgucgugacacgcagcggcgccuaugugucugcgaucgcucagacggagaaguccaucgaagauaaccccgagauugaagacgauaucuuccggaaaaagagacugaccauuauggaccuccauccuggggccggaaaaacaaagcgcuaccugccggccaucguccgggaggcuauuaaaagaggccuucgcacccugauccuggcccccacccgggugguugcugccgaaauggaggaggcgcucagagggcugccuauucgcuaucaaacacccgccaucaagacggaacacaccggacgggagaucguggaccuuaugugucaugcuacauucaccaugagacugcucagcccuguccgggugcccaacuacaaucugauuaucauggaugaagcccacuuuacagacccggcuuccauugccgcccgcggcuauaucucuaccagaguugagaugggggaggcugcgggcauuuucaugacggccacaccucccggaagccgggaucccuuuccucaguccaacgcucccaucauggacgaagaaagagaaaucccugagagaagcuggaacucuggccacgaaugggugaccgauuucaaggggaaaaccgucugguuugugccguccauuaaggccggaaacgacaucgccgcuugccuccggaaaaauggcaagaaaguuauucagcugagcagaaagacauucgauucugaguacgugaagacccgcgccaacgacugggauuuugucgugacaaccgacaucagcgagaugggggcgaauuucaaagcugaacgggugauugaucccagacgcuguaugaagccugucauccuuacggacggagaggaacggguuauccuggccggccccaugccugugacacauuccucugccgcucaaagacgcgggcggauuggcagaaaccccaaaaaugagaacgaccaguauaucuacaugggagaaccgcuggagaaugaugaggacugcgcccacuggaaggaagcgaaaaugcuccuggauaacauuaauaccccugagggcaucauucccagcauguuugaaccugagcgcgaaaagguggacgccaucgauggggaguacagacuucggggagaggcucgcaaaacauucgucgaccugaugagacggggcgaucuccccguguggcuggccuauaagguugcugccgaagggauuaacuacgcugaccgcaagugguguuuugauggaaucaaaaauaaccagauccuggaggaaaacauggagguggagauuuggaccaaggaaggcgagcgcaagaagcucaaaccucgguggcuugacgccagaaucuauuccgauccccuggcgcugaaggaguucaaggaguucgccgcugggcgcaaaucucucacgcugaaucuuauuaccgaaaugggccggcugccgacauuuaugacccagaaggccagaaacgcucucgacaaucuggccguccugcauacagccgaggcuggaggccgcgcguacaaccacgcccucagcgagcuuccugaaacccuggagacacugcuccugcuuacccugcucgcuacggugacagggggaaucuuccuguuucugauguccggcaaagggauuggaaagaugacccucggcaugugcugcaucaucaccgccagcauucuucugugguaugcccaaauccagccccacuggauugcugccucuaucauucuggaguucuuucucaucguucugcuuauccccgagccugaaaaacagcggacaccgcaggauaaucaacugaccuacguggucauugcgauccucacaguggucgccgcuacgauggccaacgagaugggcuuccuggagaagaccaagaaagaccuggggcucggauccauuacaacccaggaaagcgaguccaauauccuugacauugaucugagacccgcuucugccuggacacuguaugcgguggccaccacguuuguuaccccuaugcuccggcauagcaucgaaaacuccucugugaaugugagccugacagcuauugccaaccaggcuaccguccuuaugggccuggggaagggauggccccucuccaaaauggacaucggcguuccucugcuggccaucggguguuacagccaggugaaucccauuacacucaccgcugcccuucugcugcucguggcgcacuacgccaucauuggaccuggccugcaagcuaaggccacgcgcgaggcucagaaaagagccgccgcgggcaucaugaagaacccgacagucgaugggauuaccgugaucgaccuugaacccaucccuuaugaucccaaguucgagaaacagcugggacagguuaugcuccugauucugugcgugacacaaguccucaugaugcggaccaccugggcucuuugugaggcccugacacuggcuacgggcccuaucucuacccucugggaagggaaucccggacgcuuuuggaacacaaccauugccguguccauggccaauaucuucagaggcagcuaccuggcuggggccggacuucuguuuucuauuaugaagaacacaaccuccacgcggcgcggcacaggcaauaucggggagacccucggagaaaaauggaaaagcagacugaacgcgcugggcaaaucugaguuccagaucuauaagaaaagcgggauucaggaggucgaccggacccucgccaaggaaggaaucaagcgcggcgagacagaucaucacgcuguguccagagggucugccaaacuucggugguuuguugaaagaaacauggugaccccggagggaaaggucguggaccugggcugcggccgcgggggauggagcuacuauuguggcgggcugaaaaauguucgggaagugaagggacucacaaaaggcgggccuggacaugaggagcccauucccauguccacguacggcuggaaccuggucagacuucaaagcggcguggauguguucuucaccccucccgaaaagugcgacacacugcucugugauaucggggaguccucuccuaauccgaccauugaagcuggacgcacacugcggguucugaaccucgucgagaauuggcuuaacaauaacacccaguuuugcaucaaggugcugaaucccuauaugccuagcgugaucgagaagauggaggcccugcagagacaguacggcggggcgcucguccgcaacccccuguccagaaauucuacgcacgagauguacuggguuagcaacgccaccggaaauauuguguccucugugaacaugaucagcagaaugcuuauuaaucgcuucacaaugaagcacaaaaaggcuaccuaugaaccugacgucgaucugggcuccgggacacggaacaucggaauugagagcgaaauccccaaccucgacauuaucggcaaaagaaucgagaagauuaagcaagaacaugagaucucuuggcacuacgaccaggaucauccguauaaaaccugggccuaccacggcuccuaugagacaaagcagaccgggagcgcuucuuccauggugaauggaguugugcgccugcugacgaaaccuugggacgucgugcccaugguuacacagauggccaugaccgauaccacaccuuuuggccaacagcggguguucaaggaaaaagucgacacgagaacccaggagcccaaggaagggacaaagaaacucaugaagauuaccgcugaguggcuuuggaaagagcugggaaagaaaaagacaccucgcauguguaccagagaagaguuuaccaagaaggugcggagcaacgccgcgcugggcgccaucuucaccgaugaaaauaaguggaaaucugcucgcgaggccguggaagacgggagauuuugggagcucgucgaucgggagagaaaccugcaccuugaaggaaagugcgagacguguguuuacaauaugaugggcaaacgggaaaagaaacugggcgaguucgggcgcgcuaagggauccagagccauuugguauauguggcucggcgcccgguuucuggaguucgaggcgcugggguuucucaacgaggaccauugguucagccgcggaaauucccugagcggcguggaaggggagggccuucacagacugggauacauccuccgggaugugggcaagaaagaagggggagcuauguacgccgacgauaccgccggcugggacacacgcaucacccuggaggaccuuaagaacgaagagauggucacaaaucauaugaaaggggagcacaagaaacuggcugaagccauuuuuaagcucaccuaucagaacaaggugguuagagugcaacggcccacgccgcgcggaacagucauggauaucauuucuagacgggaccagcgcggcagcggacaggugggcaccuacggacugaauacauucaccaacauggaggcucaacugaucagacagauggaaggcgaggggauuuucaaauccauccagcaucucacggccaccgaggaaaucgcgguucagaauuggcuggcccgggugggacgcgagagacuuucucggauggcuauuagcggcgaugacugcgucgugaagccuaucgaugacagauuugccuccgcucugacagcccucaacgauauggggaaaguucgcaaggacauucaacagugggaacccucucggggauggaaugauuggacccaggugcccuucugcagccaccacuuucaugagcuggucaugaaagacggcagagugcuugucgugccuugucgcaaccaggaugaacugaucgggcgggcgagaauuucccaaggcgccggauggucucucaaggagacagcuugccugggcaagagcuaugcccagauguggacccugauguacuuccaccgccgggaccucagacuggcugccaacgcuaucuguuccgccguuccgagccauugggugcccacaucucgcaccacgugguccauucacgcgaaacacgaguggaugacaaccgaagauaugcuugccgucuggaaucggguguggauccaggagaacccuuggauggaagacaagacccccguggagagcugggaagagguuccuuaucuggggaaaagagaggaccaguggugcggaucucucaucggccugacaucccgcgcuaccugggccaagaauauucaaacagccaucaaccaggugcggagccuuauugggaaugaagaguacacggauuauaugcccuccaugaaaagauuucggagagaagaggaagaggcuggaguccugugguga

SEQ ID NO: 19765 - RNA, 9876 nt, Artificial Sequence
  derived and/or modified CDS sequence (opt5) from DENV-2__FJ850067__SS-prME
accgccggcgugaucgucaugcugauucccacagcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaagcacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuacggaaauggcguugucacccggagcggcgccuaugugucugcgaucgcucagacagagaaguccaucgaagauaacccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucagcccugugcgcguccccaacuacaaucugauuaucauggaugaagcccacuucacagacccugcuuccauugccgccagaggcuauaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguacguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacauuccucugccgcucaacgccgggggagaauuggccgcaaccccaagaaugagaacgaccaguauaucuacaugggagaaccucuggagaaugaugaggacugcgcccacuggaaagaagcgaagaugcuucuggauaacauuaauacccccgagggcaucauuccgagcauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaacuacgcugacagaaagugguguuucgauggaaucaagaauaaccagauccuugaggaaaacauggagguugagauuuggaccaaagaaggcgagcggaagaaacugaagccuagauggcuggacgcccgcaucuauuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaucaacugaccuacguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguaugcggucgccaccacgcuugugaccccgaugcugcgccauagcaucgaaaacuccucuguuaaugugagccucacagcuauugccaaccaggcuaccgugcugaugggccuggggaaaggauggccccucuccaagauggacaucggcgucccucuucuggccaucggguguuacagccagguuaaucccauuacacugaccgcugcccuccugcuucugguggcgcacuacgccaucauuggaccuggccuccaagcuaaagccacgagagaggcucagaagcgggccgccgcgggcaucaugaaaaaccccacaguggaugggauuaccgucaucgaccuggaaccuaucccguaugaucccaaguucgagaagcagcugggacaggugaugcuccuuauucugugcguuacacaagugcugaugaugcgcaccaccugggcucucugugaggcccugacacuugcuacgggcccuaucucuacccugugggaagggaaucccggaagauuuuggaacacaaccauugccgucuccauggccaauaucuuccggggcagcuaccucgcuggggccggacugcuguuuucuauuaugaaaaacacaaccaauacgcgcagaggcacaggcaccaucggggagacccucggagaaaaguggaaaucccggcuuaacgcgcugggcaagagcgaguuccagaucuauaaaaagucugggauucaggagguggaccgcacacuggccaaagaaggaaucaagagaggcgagaccgaucaucacgcugucagccggggguccgccaagcucagaugguuuguggaacgcaacaugguuacaccugagggaaaaguggucgaccugggcugcggcagagggggauggucuuacuauuguggcgggcuuaagaaugugcgggaaguuaaaggacugacgaagggcgggcccggacaugaggagccgauuccuaugagcaccuacggcuggaaccucgugcgccugcaauccggcgucgauguguucuuuacaccgcccgaaaaaugcgagacccugcucugugacaucggggaaagcuccccuaaucccacaauugaggcuggacggacccuuagagugcugaaccugguugaaaauuggcucaacaauaacacgcaguucugcaucaagguccugaauccuuauaugccgucugugaucgagaagauggaggcccuucagcgcaaauacggcggggcgcuggugcggaacccccucagcagaaauuccacccacgaaauguacugggucucuaacgccacaggaaauauuguuagcuccgugaacaugaucucucgcaugcugauuaaucgguucaccaugaagcacaaaaaggcuacauaugagccugauguggaccugggcagcgggaccagaaacaucggaauugaauccgagauccccaaccucgauauuaucggcaaacgcaucgaaaagauuaagcaggagcaugagacaagcuggcacuacgaccaagaccauccuuauaaaaccugggccuaccacggcucuuaugaaacgaagcagacaggguccgcuagcucuauggucaauggagugguucggcuucugaccaaacccugggauguggucccgauggugacccagauggccaugacagacacgaccccuuuuggccagcaaagaguuuucaaggagaaaguggauacacgcacccaggaacccaaggaggggacaaagaaacugaugaagaucaccgcugaguggcucuggaaagaacugggaaagaaaaagacaccuagaauguguacccgggaggaauuuacgcgcaaagucagauccaacgccgcgcuuggcgccauuuucaccgacgagaauaaguggaaaagcgcucgggaagccguggaggaugggagauuuugggagcugguggaccgggaacgcaaccuccaccuggagggaaaaugcgaaacaugugucuacaauaugaugggcaagagagagaaaaagcugggcgaguucgggaaagcuaagggaucucgggccaucugguauauguggcucggcgcccgcuuucuggaguucgaggcgcuuggguuucugaacgaagaucauugguucuccagaggaaauagccucuccggcguugagggggaaggccugcaccggcuuggauacauucugcgcgacgugggcaagaaagaagggggagcuauguacgccgaugacaccgccggcugggauacaagaaucacccucgaagaccugaagaacgaggagauggugacgaaucauaugaaaggggaacacaagaaacuggcugaggccaucuuuaagcucacauaucagaacaaggucgugcggguucagcgccccaccccuagaggaacagugauggacauuaucagccggcgcgaucaaagaggcucugggcaggucggcaccuacggacugaauacguucaccaacauggaagcucagcuuauucggcaaauggagggcgaggggaucuuuaaaagcauucagcaucugacagccaccgaagagaucgcggugcagaauuggcucgcccgcguuggaagagaacggcuguccagaauggcuaucucuggcgacgauugcguggucaagcccauugacgaucgcuucgccagcgcucuuacagcccugaacgacauggggaaaauccggaaggauauucagcaaugggagccguccagaggauggaaugacuggacccaggugccuuucugcucucaccacuuucaugaacucguuaugaaagauggccgcgugcuggucgugcccugucggaaccaggacgagcugaucgggagagcgcgcauuagccagggcgccggauggucccucaaggagacagcuugccugggcaagucuuaugcccaaauguggacccuuauguacuuccaccggagagaucugcgccucgcugccaacgcuaucuguagcgccguccccucccauugggugccuacgagccggacaaccuggucuauucacgcgaaacacgaauggaugaccacagaggacaugcuggccguuuggaauagaguguggauccaggaaaacccguggauggaggauaagacccccgucgaauccugggaggaggugccuuaucuugggaaacgcgaagaccaguggugcggaagccugaucggccucacaucucgggcuacgugggccaagaauauucagaccgccaucaaccaagugagaucccugauugggaaugaggaauacacagacuauaugcccagcaugaaacgguuuagacgcgaggaagaggaggcuggaguucugugguga

SEQ ID NO: 19766 - RNA, 9876 nt, Artificial Sequence
  derived and/or modified CDS sequence (opt5) from DENV-2__FJ850060__SS-prME
accgccggagugaucgucaugcugauucccaccgcuauggccuuccaccucacgaccagaaauggggagccucauaugaucguuggacggcaggaaaagggcaagagccugcuuuuuaagaccgaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaagauucgcccuacauuugccgcgggccuucugcucagaaaacugaccucuaaggagcucaugauggcuacaaucgggauugcccugcuuagccaguccaccauccccgaaaccauccuggagcucacagaugcccuggcucugggaaugauggugcuuaaaauuguccggaacauggaaaaguaccaacuggccgugacgaucauggcgauuucuugcguuccuaaugcugugauccuccagaacgccuggaaggucagcugugccauucuggcugccguguccgugagcccccuccugcuuaccucuucccagcagaaagcugacuggaucccucuggcccucacaaucaagggccugaaucccaccgcgauuuuccugacaacccuuagccgcacgucuaaaaagagauccuggccgcugaacgaggccgucauggcuguugggauggugagcauccucgccucuucccugcucaaaaaugacauuccuaugacaggaccccugguggcuggcggccuucugaccgucugcuaugugcugaccgggcggagcgccgaucucgaacuggagcgcgccgcugacguuaagugggaggaucaagcggaaaucuccggaagcucuccuauucuuagcaucacaauuuccgaggacggcucuaugagcaucaaaaacgaagaggaggaacagacccugacaauccucauuagaacggggcugcucgugaucuccggagucuuucccgugucuauuccgaucaccgccgcugccugguaccugugggagguuaagaagcagcgggccggcgugcuuugggaugucccuucucccccucccguggaaaaagcugagcuggaagacggggccuaucgcauuaagcagagaggaauccugggcuacucccaaaucggcgcgggggucuauaaagagggaacauuccacaccauguggcaugugacacggggcgcuguucucaugcaccgcgggaagagaauugagcccuccugggccgaugugaaaaaggaccugaucagcuacggaggcggguggaaacuugaaggagaguggaaagaaggcgaggaaguccaggugcuggcccucgagccuggcaagaauccgcgggcuguucagaccaaacccgggauuuuuaagacgaacaccggaacaaucggcgccgugucccuggauuucagcccugggaccucuggaucccccauugucgacagaaaaggcaaggugguggggcucuacggaaauggcguugucacacgcagcggcgcguaugugucugcuaucgcccagaccgagaaguccaucgaagauaacccugagauugaagacgauaucuuucggaaaaagagacugacaauuauggaccuucaucccggggccggaaaaacgaagcgcuaccugccugcuaucgugcgggaggccauuaaaagaggccugcgcacccucauccuggcuccgacacgggucguggccgcggaaauggaggaggcccuuagagggcugcccauucgcuaucaaaccccugcuaucaagaccgaacacacaggacgggagaucguugaccucaugugucaugccacguucaccaugagacugcucagccccgugcgggucccuaacuacaaucugauuaucauggaugaagcucacuucacagaccccgccuccauugccgcucgcggcuauaucucuaccagaguggagaugggggaggcggccggcauuuuuaugacagcuaccccgccuggaagccgggaucccuucccccaguccaacgccccuaucauggacgaggaacgcgaaauccccgagagaagcuggaacucuggccacgaauggguuacggauuuuaaggggaaaacagugugguucgucccuuccauuaaggccggaaacgacaucgcugccugccuucggaaaaauggcaagaaagugauucagcugagcagaaagaccuuugauucugaguacguuaagacccgcgcgaacgacugggauuucguggucacaaccgacaucagcgagaugggggcuaauuuuaaagccgaacgggugauugauccgagacgcuguaugaagcccgugauccugacagacggagaggaacgggucauccucgccggcccuaugcccguuacccauuccucugcugcccaaagacgcgggcggauuggcagaaacccuaaaaaugagaacgaccaguauaucuacaugggagaaccccuggagaaugaugaggacugcgcgcacuggaaggaagccaaaaugcuucuggauaacauuaauacgccggagggcaucauuccuagcauguucgaacccgagcgcgaaaagguggacgcuaucgauggggaguacagacuccggggagaggcccgcaaaacauuuguggaccugaugagacggggcgaucugccugucuggcucgcuuauaagguggccgcugaagggauuaacuacgccgaccgcaagugguguuucgauggaaucagaaauaaccagauccuugaggaaaacauggagguugagauuuggaccaaagaaggcgagcggaagaaacugaagcccagauggcuggacgcgcgcaucuauuccgauccucucgcccugaaagaauuuaaggaguucgcugccgggcggaagucucuuacacugaaucucauuaccgaaaugggcaaacugcccacguucaugacccagaaggcuagaaacgcccuggacaaucucgccgugcuucauacagcugaggcgggaggccgcgccuacaaccacgcucugagcgagcugccggaaacccucgagacacugcuucugcucacccugcuggccacagucaccgggggaaucuuucucuuccuuauguccggcaaagggauuggaaagaugacgcugggcaugugcugcaucaucacagccagcauucugcucugguaugcucaaauccagccucacuggauugccgcgucuaucauucuggaauuuuuccuuaucgugcugcucauccccgagcccgaaaaacagcggaccccucaggauaaucaacugaccuacguugugauugccauccugacagucguggcugccaccauggcuaacgagaugggcuuucucgagaagacaaagaaagaccuugggcugggauccauuacgacccaggaaagcgaguccaauauccuggacauugaucucagaccggccucugcguggacacuguaugccgucgcuaccacauucgugacccccaugcuucggcauagcaucgaaaacuccucuguuaaugugagccugacggccauugcuaaccaggccaccgugcucaugggccuggggaagggauggccucuguccaaaauggacaucggcgucccccuccuugcuaucggguguuacagccagguuaauccuauuacacugaccgccgcgcugcuccugcuuguggcccacuacgcuaucauuggacccggccugcaagccaaggcuacacgcgaggcccagaaaagagccgcggcuggcaucaugaagaacccuaccguggaugggauuacggucaucgaccucgaaccgauccccuaugauccuaaguuugagaaacagcugggacaggugaugcugcucauucuuugcguuacacaagugcugaugaugcggaccacaugggcccugugugaggcucucacccuggccaccggccccaucucuacacuuugggaagggaauccuggacgcuucuggaacacgaccauugccgucuccauggcuaauaucuuuagaggcagcuaccuggccggggcgggacuccuguucucuauuaugaagaacacaaccaauacacggcgcggcaccggcaacaucggggagacgcugggagaaaaauggaaguccagacucaacgcccuuggcaaaagcgaguuucagaucuauaagaaaucugggauucaggagguggaccggacacuggcuaaggaaggaaucaagcgcggcgagaccgaucaucacgccgucagcagaggguccgcuaaacugcggugguucguggaaagaaauaugguuacccccgagggaaagguggucgaccucggcugcggccgcgggggauggucuuacuauuguggcgggcugaaaaacgugcgggaaguuaagggacuuacaaaaggcgggccgggacaugaggagccuauucccaugagcaccuacggcuggaaucuggugagacuccaauccggcgucgauguguuuuucacacccccugaaaagugcgacacgcugcugugugauaucggggagagcucccccaacccuaccauugaagccggacgcacacuccgggugcuuaaucugguugagaacuggcugaauaacaauacccaguucugcaucaagguccucaacccguauaugcccucugugaucgagaagauggaggcgcugcagagaaaguacggcggggcccuugugcgcaauccucugagccggaacuccacacacgagauguacugggucucuaaugcuaccggaaacauuguuagcuccgugaauaugaucucuagaaugcucauuaaccgcuuuacgaugaaacacaagaaagccaccuaugaacccgacguggaucugggcagcgggacacggaacaucggaauugaguccgaaaucccuaaucuggacauuaucggcaagagaaucgagaagauuaaacaggaacaugagaccagcuggcacuacgaccaagaucaucccuauaagacaugggcuuaccacggcucuuaugagaccaaacagacaggguccgccagcucuauggucaacggagugguucgccuccuuaccaagccgugggacguggucccuauggugacgcagauggcuaugacagauaccacccccuucggccagcaacggguuuuuaaagaaaagguggacacaagaacgcaggagccuaaggaagggaccaaaaagcugaugaaaaucacagccgaguggcuguggaaggagcucggcaagaagaaaacaccccgcauguguacaagagaagaguucacccggaagguccgcuccaaugcggcccugggcgcuauuuuuacagaugaaaacaaguggaaaagcgccagagaggcuguggaagacgggcgguucugggagcuuguggauagagagcggaaucugcaccucgaaggaaagugcgagaccugugucuacaacaugaugggcaaacgcgaaaagaaacugggcgaguuugggaaggccaagggaucuagagccaucugguauauguggcugggcgcgcgguuccucgaauuugaggcucugggguuccuuaaugaggaccauugguuuucccgcggaaacagccuguccggcguugaaggggagggccuccacagacugggauacauucuucgggaugugggcaaaaaggaagggggagccauguacgccgacgauacggcuggcugggacacccgcaucacacuggaggaccucaaaaaugaagagauggugaccaaccauaugaagggggagcacaaaaagcuggccgaagcuaucuucaagcugacauaucagaauaaagucgugagaguucagcggccuacaccccgcggaacggugauggauauuaucagcagacgggaccaacgcggcucugggcaggucggcacauacggacucaacaccuuuacaaauauggaggcccagcugauuagacaaauggaaggcgaggggaucuucaagagcauucagcaucuuaccgcgacggaggaaaucgccgugcagaacuggcuggcucggguuggacgcgagagacucucccggauggccaucucuggcgaugacugcguggucaaaccgauugaugacagauucgcuagcgcccugaccgcgcuuaaugauauggggaaggugcgcaaagacauccagcaaugggaaccuucccggggauggaacgauuggacacagguucccuuuugcucucaccacuuccaugagcuggugaugaaggacggcagaguccucgugguccccugucgcaaccaggaugaacugauugggcgggccagaaucagccagggcgcuggauggucccugaaggagaccgccugccucggcaaaucuuaugcucaaauguggacacugauguacuuucaccgccgggaccuuagacuggccgcuaaugccauuuguagcgcggugccuccgcauuggguucccaccucccgcacaaccuggagcauccacgccaagcacgaguggaugacgacagaagauaugcucgcuguguggaaccgggucuggauucaggggaauccuuggauggaggacaaaacccccguggaaucuugggaggaagugccuuaucugggaaagagagaggaccaguggugcggcucccuuaucgggcugaccagccgcgccacaugggccaaaaacauccagaccgcuauuaaucaaguucggucucucaucggaaacgaggaauacacagauuauaugcccuccaugaagagauuccggagagaggaagaggaagccggcgugcugugguga

SEQ ID NO: 19767 - RNA, 9876 nt, Artificial Sequence
  derived and/or modified CDS sequence (opt5) from DENV-2__FJ850061__SS-prME
accgccggcgugaucauuaugcugauccccacggcuauggccuuccaccucacgaccagaaauggggaaccucauaugauugucggacggcaggaaaagggcaagagccugcuuuuuaagacagaggacgggguuaauaugugcacccugauggcgaucgaucucggagaacugugugaggacacaauuaccuacaagugcccgcuucugagacaaaaugaacccgaggauaucgacuguuggugcaauuccacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaagggggaaucgugacaugcgccauguuuacgugcaaaaagaauauggaaggcaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucaucggcgucgagcccggacagcucaaacugaauugguucaagaagggcuccagcauugggcaaauguuugcuacaaccaugagaggagccaaacgcauggccauccuuggcgacacggcuugggauuucgggucucugggaggcguguuuacaagcauugggaaggcccuccaccagguuuucggcgcgaucuacggagcugccuuuuccggcgugucuuggaccaugaaaauucugaucggggucaucauuaccuggaucggaaugaacagccgguccacaagccugucugugucccuugugcucguuggcgucgugacccuguaucugggggccauggugcaggcugacagcggaugugucgugucuuggaagaauaaagagcucaagugcggcuccgggauuuucaucacagauaacguucacacguggaccgaacaguacaaguuucaaccugagagccccuccaaacuggccucugcuauucagaaggcccaugaagagggcaucuguggaaucagaagcgugacacgccuugaaaaucugauguggaaacagauuaccccggagcucaaccacauccuguccgagaaugaagucaagcugacaauuaugaccggcgacaucaaagggauuaugcaggcgggaaagcggucucuuagaccucaacccacggagcucaaauauagcuggaagaccuggggcaaggccaaaaugcuguccacagaaagccauaaccagaccuuccugaucgaugggccugagacagcugaaugccccaauaccaaccgcgccuggaacucucucgagguggaggacuacggauuuggcguuuucacaaccaacaucuggcugaaacuucgggaaaaacaggacguguuuugugauuccaagcugaugagcgcugccauuaaagacaauagagcgguccacgccgauaugggcuauuggaucgagucugcucucaacgacacguggaagauggaaaaggccuccuucauugaggugaaaagcugccacuggccuaagucucauacacuguggagcaaugggguucuggaguccgaaaugaucauucccaaaaacuucgcuggaccggugagccagcacaacuaccgcccuggcuaucauacccaaaccgccgggcccuggcaccuuggaaagcucgagauggauuuugaccugugugaaggcacaaccgucguggugacggaggauugcgggaaucggggacccucucugagaacaaccacagccuccggcaaacucaucaccgaauggugcugucggagcugcacacugccuccgcuucgcuacagaggcgaggacggguguugguacggaauggagauucggccccugaaggaaaaggaggaaaaccucgucaauucccugguuaccgcuggccaugggcagaucgauaacuucucucugggagugcuuggcauggcgcucuuucuggaggaaaugcugagaacgcgcaucgggaccaaacacgccauucuccugguggcugucagcuucgugacacuuaucaccggaaauauguccuuucgggaccugggcagaguuauggugauggucggcgccacaaugaccgaugacauugggaugggagugacguaucucgcccugcuggcugccuucaagguucgcccuacauuugcggcuggccuucugcucagaaaacugaccucuaaggagcucaugauggccacaaucgggauugcccugcuuagccaguccaccauccccgagaccauccuggaacucacagaugcucuggcccugggaaugauggugcuuaaaauuguccggaacauggagaaguaccaacuggcggugacgaucauggcuauuucuugcguuccuaaugccgugauccuccagaacgccuggaaggucagcuguaccauucuggcugccguguccgugagcccccuccugcuuacaucuucccagcagaaagcugacuggaucccucuggcccucaccaucaagggccugaaucccacagcgauuuuccugaccacgcuuagccgcacaucuaaaaagagauccuggccgcugaacgaagccaucauggcugucgggaugguuagcauucucgccucuucccugcucaaaaaugacaucccuaugaccggaccccugguggcuggcggccuucugaccgugugcuauguccugacagggcggagcgccgaucucgagcuggaacgcgccgcugacgugaagugggaggaucaagcggagauuuccggaagcucuccuauccuuagcauuaccaucuccgaagacggcucuaugagcaucaaaaacgaggaagaggagcagacacugacgauucucaucagaaccgggcugcucguuauuuccggaguguuucccgucucuaucccgauuacagccgcugccugguaccugugggaagugaagaagcagcgggccggcguucuuugggaugugccuucucccccucccgucgagaaagcugaacuggaggacggggccuaucgcaucaagcagagaggaauccugggcuacucccaaauuggcgcggggguguauaaagaaggaaccuuccacacaauguggcaugucacccggggcgcugugcucaugcaccgcgggaagagaaucgagcccuccugggccgauguuaaaaaggaccugauuagcuacggaggcggguggaaacuugagggagaauggaaagagggcgaagaggugcagguccuggcccucgaaccuggcaagaauccgcgggcugugcagacgaaacccgggaucuuuaagaccaacacaggaaccauuggcgccguuucccuggauuucagcccugggacaucuggaucccccaucguggacagaaaaggcaaggucguggggcucuacggaaauggcgugguuacccgcagcggcgcguaugucucugcuaucgcccagacagagaaguccauugaggauaacccugaaaucgaggacgauauuuuucggaaaaagagacugacgaucauggaccuucaucccggggccggaaaaaccaagcgcuaccugccugcuauugugcgggaagccaucaaaagaggccugcgcacacucauucuggcuccgacccggguggucgccgcggagauggaagaggcccuuagagggcugcccauccgcuaucaaaccccugcuaucaagacagagcacacgggacgggaaauuguggaccucaugugucaugccaccuucacaaugagacugcucagccccguucgggugccuaacuacaaucugaucauuauggaugaggcucacuucaccgaccccgccuccaucgccgcucgcggcuauauuucuacaagagucgaaaugggggaggcggccggcaucuuuaugaccgcuacgccgccuggaagccgggaucccuucccccaguccaacgccccuaucauggacgaggaacgcgagauucccgaaagaagcuggaacucuggccacgagugggugacagauuuuaaggggaaaaccguuugguucgugccuuccaucaaggccggaaacgacauugcugccugccuucggaaaaauggcaagaaagucauccagcugagcagaaagaccuuugauucugaauacgugaagacacgcgcgaacgacugggauuucguugugaccacagacauuagcgagaugggggcuaauuuuaaagccgagcgggucaucgauccgagacgcuguaugaagcccgugauccugaccgacggagaagaacgggugauucucgccggcccuaugcccgucacgcauuccucugcugcccaaagacgcgggcggaucggcagaaacccuaaaaaugaaaacgaccaguauauuuacaugggagagccccuggaaaaugaugaggacugcgcgcacuggaaggaggccaaaaugcuucuggauaacaucaauacaccggaaggcauuaucccuagcauguucgagcccgaacgcgagaagguugacgcuauugauggggaauacagacuccggggagaggcccgcaaaaccuuuguggaccugaugagacggggcgaucugccuguguggcucgcuuauaaggucgccgcugaggggaucaacuacgccgaccgcaagugguguuucgauggaaucaaaaauaaccagauucuugaagagaacauggaaguggagaucuggacaaaggagggcgaacgcaagaagcugaaaccccgguggcuggacgcgagaauuuauuccgauccucucgcccugaaggaguuuaaggaguucgcugccgggcgcaaaucucuuacccugaaucucaucacggagaugggccggcugcccaccuucaugacacagaaggcuagaaacgcccuggacaaucucgccguucuucauaccgcugaagcgggaggccgcgccuacaaccacgcucugagcgagcugccggagacacucgaaacccugcuucugcucacacugcuggccaccgugacagggggaauuuuucucuuccuuauguccggcaaagggaucggaaagaugacacugggcaugugcugcaucauuaccgccagcauccugcucugguaugcucaaauucagccucacuggaucgccgcgucuauuauccuggaguuuuuccuuaucguccugcucauucccgaacccgagaaacagcggaccccucaggauaaucaacugacauacgugguuaucgccauucugaccguggucgcugccacaauggcuaacgaaaugggcuuucucgagaagacgaagaaagaccuugggcugggauccaucaccacacaggagagcgaauccaauauucuggacaucgaucucagaccggccucugcguggacccuguaugccguggcuacaaccuucgucacgcccaugcuucggcauagcauugagaacuccucugugaauguuagccugaccgccaucgcuaaccaggccacagugcucaugggccuggggaagggauggccucuguccaaaauggacaucggcgugccccuccuugcuauuggguguuacagccaggucaagccuaucaccuuuacagccgcgcugcugcuccugguugcccacuacgcuauuaucggacccggccuucaagccaaagcuccucgcgaagcccagaagagagccgcggcuggcauuaugaagaauccgaccguggaugggaucacggugaucgaccuggagcccauuccuuaugaucccaaauucgaaaagcagcucggacaggucaugcugcugauccucugcgugacacaaguucuuaugaugcggaccacaugggcccugugugaggcucugacccucgccaccggcccuauuucuacacugugggaggggaaccccggacgcuuuuggaauacgaccaucgccguguccauggcuaacauuuucagaggcagcuaccuugccggggcgggacugcucuuuucuaucaugaaaaauacaaccaacacacggcgcggcaccggcaauaucggggaaacgcugggagagaaguggaaauccagacugaacgcccucggcaagagcgaguuccagauuuauaaaaagucugggauccaggaggucgaccggacacuugcuaaggagggaauuaaacgcggcgaaaccgaucaucacgccgugagcagaggguccgcuaagcugcggugguuugucgagagaaacauggugaccccggaaggaaaaguuguggaccugggcugcggccgcgggggauggucuuacuauuguggcgggcucaagaauguccgggaggugaaaggacugacaaagggcgggccuggacaugaagaacccauccccaugagcaccuacggcuggaaccuuguuagacugcaauccggcguggaugucuucuucacaccucccgagaagugcgacacgcuccugugugauauuggggaaagcuccccuaauccgaccaucgaggccggacgcacacugcgggugcucaaccuuguggaaaauuggcugaacaauaacacccaguuuugcaucaaaguucugaaucccuauaugccuucugucauugagaagauggaagcgcuccagagaaaauacggcggggcccuggugcgcaacccccuuagccggaauagcacacacgagauguacugggugucuaacgcuaccggaaauaucgucagcuccguuaacaugauuucuagaaugcugaucaaucgcuucacgaugaagcacaaaaaggccaccuaugagccugacguggaucucggcagcgggacacggaacauuggaaucgaauccgaggugcccaaccuggacauuaucggcaagagaaucgagaagauuaagcaggagcaugaaaccagcuggcacuacgaccaagaucauccguauaaaacaugggcuuaccacggcucuuaugagaccaagcagacaggguccgccagcucuauggucaauggagugguucgccugcucaccaaaccuugggacgugguccccauggugacgcagauggcuaugacagauaccaccccuuuuggccagcaacggguuuucaaggagaagguggacacaagaacgcaggaacccaaagaggggaccaagaaacuuaugaagaucacagccgaauggcuguggaaagagcugggaaagaaaaagaccccucgcauguguacaagagaggaauuuacccggaagguccgcuccaacgcggcccucggcgcuauuuucacagaugagaauaaauggaaaagcgccagagaagcuguggaggacgggcgguuuugggaacugguggauagagagcggaaccuucaccuggagggaaaaugcgaaaccugugucuacaauaugaugggcaagcgcgagaaaaagcucggcgaguucgggaaggccaaaggaucuagagccaucugguauauguggcugggcgcgcgguuucuggaguucgaagcucucggguuucugaacgaggaccauugguucucccgcggaaauagccuuuccggcguugagggggaaggccugcacagacucggauacauucugcgggaugugggcaagaaagaagggggagccauguacgccgacgauacggcuggcugggacacccgcaucacacuugaagaccugaagaacgaggaaauggugaccaaucauaugaaaggggagcacaagaagcucgccgaggcuaucuuuaaacugacauaucagaacaaggucgugagaguucagcggcccaccccgcgcggaacggugauggauauuaucagcagacgggaccaacgcggcucugggcaggucggcacauacggacugaauaccuucacaaacauggaagcccagcucauuagacaaauggagggcgaagggaucuucaaaagcauucagcaucugaccgcgacggaggagaucgccgugcagaauuggcuugcucggguuggacgcgaaagacugucccggauggccaucucuggcgaugacugcguggucaagccuauugaugacagauuugcuagcgcccucaccgcgcugaacgauauggggaaagugcgcaaggacauccagcaaugggagcccucccggggauggaaugauuggacacagguucccuucugcucucaccacuuucaugaacuugugaugaaggacggcagaguccugguggucccuugucgcaaccaggaugagcucauugggcgggccagaaucagccagggcgcuggauggucccugaaagaaaccgccugccugggcaagucuuaugcucaaauguggacacucauguacuuccaccgccgggaccugagacuugccgcuaacgccauuuguagcgcggugccgccccauuggguuccuaccucccgcacaaccuggagcauccacgccaaacacgaguggaugacgacagaggauaugcuggcuguguggaaucgggucuggauucaggaaaaccccuggauggaggacaagaccccuguggaaucuugggaggaagugcccuaucucgggaaaagagaggaccaguggugcggaucccugaucggccuuaccagccgcgccacaugggccaagaauauccagaccgcuauuaaccaaguucggucucugaucgggaaugaggaauacacagauuauaugccuuccaugaagagauuucggagagaggaagaggaagccggagugcucugguga

SEQ ID NO: 19768 - RNA, 9876 nt, Artificial Sequence
  derived and/or modified CDS sequence (opt5) from DENV-2__FJ744709__SS-prME
accgccggagugaucguuaugcugauucccaccgcuauggccuuccaccucacgaccagaaauggggaaccucauaugaucguuggacggcaggaaaagggcaaaagccugcuuuuuaagacagaagacggggugaauaugugcacccugauggcgauugaucucggagaacugugugaggacacaaucaccuacaaaugcccgcuucugagacaaaaugaacccgaggauauugacuguuggugcaauuccacaucuaccugggugacguauggcaccuguacaaccacaggggagcacagacgggaaaagcgcagcguggcucucgugccucauguuggaaugggccuggagaccagaacggaaacauggauguccucugagggcgccuggaaacacgugcagcggaucgagaccuggauccugcgccaucccggguucacaauuauggccgcuguccucgccuacaccaucggaaccacacacuuucagaaggcucugauuuucauccuucugacggccguggcgccuagcaugaccaugagaugcauuggcaucuccaaccgggauuuuguugaaggggugucuggaggcagcugggucgacauugugcucgagcacggguccugugugacaaccauggccaagaauaaacccacacuggauuucgaacuuaucaagaccgaggcuaaacagccugccacgcugcgcaaguauugcaucgaagcuaaacucacaaacaccaccacagagagcagauguccgacccaaggagagcccucucugaaugaagaacaggacaagcgguuuauuugcaagcauuccauggucgaucgcggcuggggcaacggguguggacuguucggcaaagggggaaucguuacaugcgccauguuuacgugcaagaaaaauauggaaggcaagguggugcagccugagaaccucgaauacaccauugucaucacaccccacagcggggaggagcaugcggugggaaaugacaccggcaaacacggcaaggaaauuaaaaucacaccucagucuuccaucaccgaggccgaacugacgggguauggaaccguuacaauggaguguagccccagaaccggccuugauuucaacgaaauggugcugcuccaaauggaggacaaggcuuggcugguccaccggcagugguuucuugaucugccgcucccuuggcugcccggggccgacacacagggaucuaauuggauucagaaggagacccuggugacguucaaaaacccucaugcuaagaaacaagacguugugguccucggcucccaggaaggggccaugcacacagcccugaccggcgcuacagagauccagaugagcuccggaaaucuucuguuuaccggccaucucaagugccgccugagaauggauaaacuucaacugaaggggaugucuuacagcauguguaccggaaaguucaaaauugugaaggaaaucgcggagacacagcacggcacgauugucauccgggugcaguaugagggggacggaucccccugcaaaauccccuucgaaauuaccgaucucgagaagagacauguucugggccgccugaucacagugaacccuauugucaccgaaaaagacagcccggugaacaucgaggccgaacccccuuuuggggauucuuacauuaucauuggcguugagcccggacagcucaagcugaauugguucaagaaaggcuccagcaucgggcaaauguuugagacaaccaugcggggagcuaagagaauggccauccuuggcgacacggccugggauuucgggucucugggaggcguguuuacaagcauugggaaagcucuccaccaggucuucggcgccaucuacggagcggcuuuuuccggcgugucuuggaccaugaagauucugaucggggugauuaucaccuggaucggaaugaacagccgcuccacaagccugucuguuucccuuguccucgugggcguggucacccuguaucugggggccgugguucaggccgacagcggauguguggucucuuggaaaaauaaggaacucaagugcggcuccgggauuuucaucacagauaacgugcacacguggaccgagcaguacaaauuucaaccugaaagccccuccaagcuggcuucugccauucagaaagcucaugaggaaggcaucuguggcauucggagcguuacaagacuugagaaucugauguggaagcagaucaccccggagcucaaccacauccuguccgaaaaugaggugaaacugacaauuaugaccggcgacaucaaggggauuaugcaggccggaaaacgcucucuucggccucaacccacggaacucaaguauagcuggaagaccuggggcaaagcgaagaugcuguccacagagagccauaaccagaccuuccugaucgaugggccugaaacagccgagugccccaauaccaacagagcuuggaacucucucgaggucgaagacuacggauuuggcguguucacaaccaacauuuggcugaaacuucgcgagaagcaggacgucuuuugugauuccaaacugaugagcgccgcuaucaaggacaaucgggccgugcacgcggauaugggcuauuggaucgaaucugcccucaacgacacguggaagauggagaaggcuagcuucauugaggucaagagcugccacuggccuaaaucucauacacuguggagcaauggggugcuggaauccgagaugaucauucccaagaacuucgccggaccggugagccagcacaacuacagaccuggcuaucauacccaaaccgcugggcccuggcaccuuggaaaacucgaaauggauuuugacuucugugagggcacaaccgucguugugacggaagauugcgggaaucgcggacccucucugcggacaaccacagccuccggcaagcugaucaccgaguggugcuguagaagcugcacacucccuccgcugcgguaccgcggcgaggacggguguugguacggaauggaaauuagaccccuuaaggagaaagaagagaaccuggucaauucccucgucaccgccggccaugggcagaucgauaacuuuucucugggagugcugggcauggcucuuuuccucgaagagaugcugcggacgagaauugggaccaagcacgcgauccugcucguugccgugagcuuugucacacugaucaccggaaauauguccuuccgcgaccuuggccgggugaugguuauggugggcgcuacaaugaccgaugacauugggaugggagucacguaucuggcccuccuggccgcuuuuaaagugagaccuacauucgccgcgggccugcuucugcgcaagcucaccucuaaagagcugaugauggcuacaaucgggauugcccuccugagccaguccaccauccccgaaaccauucuugagcugacagaugcccucgcucugggaaugaugguucugaagaucgugagaaacauggaaaaguaccaacuugccgucacgaucauggcgauuucuugcgugccuaaugcugugauccugcagaacgccuggaaagucagcuguaccauucucgccgcuguuuccgugagcccccugcuccugacaucuucccagcagaaggccgacuggaucccucuugcucugaccauuaaaggccucaaucccacagccaucuuucugaccacgcugagccggacaucuaagaaacgcuccuggccgcuuaacgaggcgaucauggccguggggauggucagcauucuggcuucuucccuccugaagaaugacaucccuaugaccggaccccucguggccggcggccugcuuaccguuugcuaugugcugacagggagaagcgcugaucuggaacucgagcgggccgccgacgucaaaugggaggaucaagcugaaauuuccggaagcucuccuauccugagcauuaccaucuccgaggacggcucuaugagcauuaagaacgaagaggaggaacagacacuuacgauccugauccgcaccgggcuccuggugauuuccggaaucuuccccguuucuauuccgaucacagcggccgcuugguaccucugggaggugaagaaacagagagccggcguccugugggaugugccuucucccccucccgucgaaaaggccgagcuugaagacggggcuuaucggauuaaacagcgcggaauccugggcuacucccaaaucggcgccgggguguauaaggagggaaccuuucacacaauguggcauguuaccagaggcgcggugcugaugcaccgggggaaacgcauugagcccuccugggcugaugucaagaaggaccucaucagcuacggaggcggguggaaacuggaaggagaguggaaggaaggcgaggaagugcagguucuugcccuggagccuggcaaaaauccgagagccgugcagacgaagcccgggauuuucaaaaccaacacaggaaccaucggcgcugucucccucgauuuuagcccugggacaucuggaucccccauuguggaccggaagggcaaggugguugggcuguacggaaauggcgucgugaccagaagcggcgccuaugugucugcgaucgcucagacagagaaauccaucgaagauaacccugagauugaagacgauaucuuccgcaagaaacggcucacgauuauggaccugcaucccggggccggaaagaccaaaagauaccuuccugccaucguccgcgaggcuauuaagcggggccugagaacacugauccucgccccgacccgcgugguugcugccgaaauggaggaggcgcugcgggggcuucccauuagauaucaaaccccugccaucaagacagaacacacgggacgcgagaucguggaccugaugugucaugcuaccuucacaaugcggcuccugagccccgucagagugccuaacuacaaucucauuaucauggaugaagcccacuuuaccgaccccgcuuccauugccgcccggggcuauaucucuacacgcguugagaugggggaggcugcgggcauuuucaugaccgccacgccgccuggaagcagagaucccuuuccccaguccaacgcuccuaucauggacgaagaacgggaaauccccgagcgcagcuggaacucuggccacgaaugggugacagauuucaaagggaagaccgucugguuugugccuuccauuaaagccggaaacgacaucgccgcuugccugagaaagaauggcaaaaagguuauucagcuuagccggaagaccuucgauucugaguacgugaaaacaagagccaacgacugggauuuugucgugaccacagacaucagcgagaugggggcgaauuucaaggcugaacgcgugauugauccgcggagauguaugaaacccgucauccugaccgacggagaggaacgcguuauccuggccggcccuaugcccgugacgcauuccucugccgcucaacggagagggcgcauuggccggaacccuaagaaugagaacgaccaguauaucuacaugggagaaccccucgagaaugaugaggacugcgcccacuggaaagaagcgaagaugcugcuugauaacauuaauacaccggagggcaucauuccuagcauguuugaacccgagagagaaaaaguggacgccaucgauggggaguaccgccugagaggagaggcucggaagaccuucgucgaccucaugcgcagaggcgaucugccuguguggcuggccuauaagguugcugccgaagggauuaacuacacagaccggaaaugguguuuugauggaaucaagaauaaccagauccucgaggaaaacauggagguggagauuuggaccaaagaaggcgagcgcaagaaacuuaagcccagauggcuggacgcucggaucuauuccgauccucuggcccucaaggaguucaaagaguucgcggccgggagaaagucucugacgcuuaaucugauuaccgaaaugggccgccuccccacauuuaugacccagaaagcucggaacgcccuggacaaucuggcuguccuccauacagccgaggccggaggcagagcuuacaaccacgcgcuuagcgagcugccggaaacccuggagacacuccugcuucugacccuccuggccacggugacagggggaaucuuccuguuucucauguccggcaaggggauuggaaaaaugacccuuggcaugugcugcaucaucaccgcuagcauucugcugugguaugcccaaauccagccucacuggauugccgcuucuaucauucucgaguucuuucugaucguucuucugauccccgagcccgaaaagcagcgcacaccucaggauaaucaacucaccuacguggucauugccauccugacaguggucgcggccacgauggcuaacgagaugggcuuccuggagaagaccaaaaaggaccucgggcuuggauccauuacaacccaggaaagcgaguccaauauccuggacauugaucugcggccggccucugcuuggacacucuaugccguggcgaccacguuuguuacccccaugcugagacauagcaucgaaaacuccucugugaaugugagccuuacagccauugcuaaccaggccaccguccugaugggccucgggaaaggauggccucuguccaagauggacaucggcguuccccugcucgcuaucggguguuacagccaggugaauccuauuacacuuaccgccgcucugcugcuccugguggcccacuacgcgaucauuggacccggccuucaagccaaagcuacgcgggaggcccagaagcgcgcugccgccggcaucaugaagaacccuacagucgaugggauuaccgugaucgaccuggaaccgauccccuaugauccuaaauucgagaagcagcucggacagguuaugcugcugauucucugcgugacacaaguccuuaugaugagaaccaccugggcgcugugugaggcucugacacucgccacgggccccaucucuacccugugggaagggaauccuggacgguuuuggaacacaaccauugcuguguccauggccaauaucuuccgcggcagcuaccuugccggggcuggacugcucuuuucuauuaugaaaaacacaaccuccacgagacggggcacaggcaauaucggggagacccugggagaaaaguggaaaagccgccugaacgcccucggcaagucugaguuccagaucuauaaaaagagcgggauucaggaggucgacagaacccuugcgaaggaaggaaucaaacggggcgagacagaucaucacgccgugucccgcgggucugcuaagcugagaugguuuguugaacggaacauggugacccccgagggaaaagucguggaccugggcugcggcagagggggauggagcuacuauuguggcgggcucaagaauguucgcgaagugaaaggacugacaaagggcgggccgggacaugaggagccuauucccauguccacguacggcuggaaccuuguccggcugcaaagcggcguggauguguucuucacacccccugaaaagugcgacacacuccugugugauaucggggaguccucucccaauccuaccauugaagccggaagaacacugcgcguucucaaccuugucgagaauuggcugaacaauaacacccaguuuugcaucaaagugcugaauccguauaugcccagcgugaucgaaaagauggaggcucuccagcggcaguacggcggggcccuggucagaaacccucuuucccgcaauucuacgcacgagauguacuggguuagcaacgcgaccggaaauauuguguccucugugaacaugaucagccggaugcugauuaauagauucacaaugaaacacaagaaagccaccuaugaacccgacgucgaucucggcuccgggacacgcaacaucggaauugagagcgaaaucccuaaccuggacauuaucggcaagcggaucgagaagauuaaacaagaacaugagaucucuuggcacuacgaccaggaucaucccuauaagaccugggcuuaccacggcuccuaugagacaaaacagaccgggagcgccucuuccauggugaauggaguugugagacugcucacgaagccgugggacgucgugccuaugguuacacagauggcuaugaccgauaccacacccuuuggccaacagcgcguguucaaagaaaaggucgacacgcggacccaggagccuaaggaagggaccaagaaacuuaugaaaauuaccgccgaguggcuguggaaagagcugggacgcaaaaagacaccccgcauguguaccagagaagaguuuacacggaaagugcgcagcaacgcugcccucggcgcgaucuucaccgaugaaaauaaguggaagucugccagagaggcuguggaagacgggcgguuuugggagcuggucgauagagagcggaaccuucaccuggaaggaaaaugcgagacguguguuuacaauaugaugggcaagcgcgagaaaaagcucggcgaguucgggaaagccaagggauccagagcuauuugguauauguggcugggcgcccgguuucuggaguucgaggcccucggguuucugaacgaggaccauugguucagccgcgaaaauucccuuagcggaguggagggcgaagggcugcacagacucggcuacauccugcgggaugugggaaagaaagagggcggggcgauguacgcugacgauaccgccggaugggacacacgcaucacccuugaagaccugaagaacgaggagauggucacaaaucauaugaaaggcgaacacaagaaacucgccgaggcuauuuuuaagcugaccuaucagaacaaggugguuagagugcaacggccuacgccccgcgggacagucauggauaucauuucuagacgggaccagcgcggaagcggccagguggggaccuacggccugaauacauucaccaacauggaagcccaacucaucagacagauggagggagagggcauuuucaaauccauccagcaucugacggcuaccgaagagaucgccguucagaauuggcuugcgcggguggggcgcgaaagacugucucggauggccauuagcggagaugacugcgucgugaagccgaucgaugacagauuugcuuccgcccucacagcucugaacgauaugggcaaaguucgcaaggacauucaacagugggagccuucucggggguggaaugauuggacccaggugcccuucugcagccaccacuuucaugaacuugucaugaaagacggaagagugcuggucgugcccugucgcaaccaggaugagcucaucggccgggccagaauuucccaaggggcgggcuggucucugaaggagacagccugccugggaaagagcuaugcucagauguggacccucauguacuuccaccgccgggaccugagacuugccgcuaacgccaucuguuccgcuguuccuagccauugggugccgacaucucgcaccacgugguccauucacgccaaacacgaauggaugacaaccgaggauaugcuggcggucuggaaucggguguggauccaggaaaaccccuggauggaggacaagaccccuguggaaagcugggaggagguucccuaucucggcaaaagagaagaccaguggugcgggucucugaucggacuuacaucccgcgccaccugggcuaagaauauucaaacagccaucaaccaggugcggagccugauuggcaaugaggaauacacggauuauaugccuuccaugaaaagauuucggagagaggaagaggaggccgggguccucugguga

SEQ ID NO: 19769 - RNA, 9876 nt, Artificial Sequence
  derived and/or modified CDS sequence (opt5) from DENV-2__FJ744708__SS-prME
accgccggcgugaucgucaugcugauucccacggcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaagacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggaucccuuuccccaguccaacgcuccuaucauggacgaagaaagagaaauccccgagagaagcuggaacucuggccacgaaugggugacagauuucaaggggaaaaccgucugguuugugccuuccauuaaggccggaaacgacaucgccgcuugccugcggaaaaauggcaagaaaguuauucagcuuagcagaaagaccuucgauucugaguacgugaagacacgcgccaacgacugggauuuugucgugaccacagacaucagcgagaugggggcgaauuucaaagcugaacgggugauugauccgagacgcuguaugaagcccgucauccugaccgacggagaggaacggguuauccuggccggcccuaugcccgugacgcauuccucugccgcucaaagacgcgggcggauuggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccccgguggcuggacgccagaaucuauuccgauccucuggcgcucaaggaguucaaggaguucgccgcugggcgcaaaucucugacccuuaaucugauuacggaaaugggccggcuccccaccuuuaugacacagaaggccagaaacgcucuggacaaucuggccguccuccauaccgccgaggcuggaggccgcgcguacaaccacgcccuuagcgagcugccggaaacacuggagacccuccugcuucugacacuccuggcuaccgugacagggggaaucuuccuguuucucauguccggcaaagggauuggaaagaugacacuuggcaugugcugcaucaucaccgccagcauucugcugugguaugccgaaauccaaccucacuggauugcugccucuaucauucucgaguucuuucugaucguucuucugauccccgaacccgagaaacagcggaccccucaggauaaucagcucacauacguggucauugcgauccugaccguggucgccgcuacaauggccaacgagaugggcuuccuggaaaagacgaagaaagaccucgggcuuggauccauuaccacacaagagagcgaauccaauauccuggacauugaucugagaccggcuucugccuggacccucuaugcgguggccacaaccuuuguuacgcccaugcugcggcauagcaucgagaacuccucugugaaugugagccuuaccgcuauugccaaccaggcuacaguccugaugggccucgggaagggauggccucuguccaaaauggacaucggcguuccccugcucgccaucggguguuacagccaggugaauccuauuacccuuacagcugcccugcugcuccugguggcgcacuacgccaucauuggacccggccuucaggcuaaggccacccgcgaagcucagaagagagccgccgcgggcaucaugaagaacccuacggucgaugggauuacagugaucgaccuggagccgauccccuaugauccuaaguucgagaaacagcucggacagguuaugcugcugauucucugcgugacccagguccuuaugaugcggacaaccugggcucugugugaagcccugacccucgcuacaggccccaucucuacgcugugggaggggaauccuggacgcuuuuggaacaccacaauugccguguccauggucaauaucuucagcggcucuuaccuugccggggcuggacugcaugugccccucagaaagaacacccugcggacacgcagaggcaccggcaauacgggggaaacacugggagagaaauggaagucccggcucaacgcccuuggcaaaagcgaguuucaaauuuauaagaaaucugggauccaggaaguugaccgcacccuggcgaaggagggaaucaagagaggcgaaaccgaucaccaugccgugagccggggguccgcuaaacugagaugguucgucgagcgcaacauggugacaccggaaggaaagguuguggaccucggcugcggcagagggggauggucuuacuauuguggcgggcugaaaaauguccgggaggugaagggacuuaccaaaggcgggccuggacacgaggaacccauucccaugagcacauacggcuggaaccuggugcgccuccaguccggcguugaugucuuuuucacgccucccgagaagugcgacacccugcugugugauaucggggaaagcuccccuaauccgacaauugaggccggacggacccucagagugcuuaaccugguggaaaauuggcugaacaauaacacacaauucugcaucaagguccucaaucccuauaugccuucuguuauugagaaaauggaggcucugcagcgccaguacggcggggcccuugugcggaacccccugagcagaaauuccacccacgaaauguacugggugucuaacgcgacgggaaauaucgucagcuccgugaacaugaucucucgcaugcucauuaaucgguuuaccaugaagcauaaaaaggccacauaugagccugacguugaucugggcagcgggaccagaaacaucggaauugaauccgagauccccaaccuggacauuaucggcaaacgcauugaaaagaucaagcaggagcacgagaucagcuggcauuacgaccaagaucacccguauaaaacaugggcuuaccacggcucuuaugaaaccaagcagacaggguccgccagcucuauggugaauggagucgugcggcuccuuaccaaaccuugggacguugugcccauggucacgcagauggcuaugacagauaccaccccuuucggccagcaaagaguguuuaaggagaaaguggacacacgcacgcaggaacccaaggaggggaccaagaaacugaugaagauuacagccgaguggcuguggaaagaacucggaaagaaaaagaccccuagaauguguacacgggaggaguucaccaaaaagguccgcuccaacgcugcccugggcgcgaucuuuacagaugagaauaaguggaaaagcgccagagaagcuguugaggacgggcgguucugggagcuuguggauagagaacggaaccugcaucucgagggaaagugcgaaaccuguguguacaauaugaugggcaaacgcgagaagaaacugggcgaauuugggaaggccaagggaucuagagcuauuugguauauguggcugggcgcccgguuccucgaguuugaggcccugggguuccuuaacgaagaccacugguuuucccgcggaaauagccuguccggcgucgagggggaaggccuccauagacugggauacauccuucgggaugugggcaaaaaggaagggggagcgauguacgcugacgauacggccggcugggacacccgcauuacacuggaagaccucaaaaacgaggagaugguuaccaaucacaugaagggggaacauaaaaagcuggccgaggcuaucuucaagcugacauaucagaacaaaguggucagagugcagcggcccaccccgcgcggaacgguuauggauaucauuagcagacgggaccaacgcggcucuggacaggugggcacauacggacucaauaccuuuacaaacauggaagcccagcugaucagacaaauggagggcgaggggauuuucaagagcauccagcaccuuaccgcuacggaagagauugccguccagaauuggcuggcgcgggugggacgcgaaagacucucccggauggccaucucuggcgaugacugcguugugaaaccuaucgaugacagauucgcuagcgcccugaccgcucuuaacgauauggggaagguccgcaaagacauucagcaaugggagcccucccggggauggaaugauuggacacaggugcccuuuugcucucaccauuuccacgaacuggucaugaaggacggcagagugcucguugugccuugucgcaaccaggaugagcugaucgggcgggccagaauuagccagggcgcgggauggucccugaaggagaccgccugccucggcaaaucuuaugcucaaauguggacacugauguacuuucaucgccgggaccuuagacuggccgcuaacgccaucuguagcgcugucccgucccacugggugcccaccagccgcacaaccuggucuauucacgccaagcaugaauggaugacgacagaggauaugcucgcgguguggaaucggguuuggauccaggaaaacccuuggauggaggacaaaacccccguggaauccugggaggaggucccuuaucuggggaagagagaagaccaguggugcggaagccuuauuggccugaccucucgcgccacaugggcuaaaaauauccagaccgccaucaaccaagugcggucccucauugggaaugaggaauacacagauuauaugcccagcaugaagagauuccggagagaggaagaggaggccggaguucugugguga

SEQ ID NO: 19770 - RNA, 9876 nt, Artificial Sequence
  derived and/or modified CDS sequence (opt5) from DENV-2__FJ810418__SS-prME
accgccggagugaucguuaugcugauucccaccgcuauggccuuccaccucacgacccggaauggggaaccucauaugaucguuggacggcaggaaaagggcaaaagccugcuuuuuaagaccgaggacggggugaauaugugcacccugauggcgauugaucucggagaacugugugaggacacgaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuuaaaacaaccaugagaggagcuaagcgcauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauugggguggugaucaccuggaucggaaugaacagccgguccacaagccugucuguuucccuuguccucgugggcguggucacccuguaucugggggccgugguucaggccgacagcggauguguggucucuuggaaaaauaaggagcucaagugcggcuccgggauuuucaucacagauaacgugcacacguggaccgaacaguacaaauuucaaccugagagccccuccaagcuggcuucugccauucagaaagcucaugaagagggcaucuguggaauuagaagcguuacacgccuugaaaaucugauguggaagcagaucaccccggagcucaaccacauccuguccgagaaugaagugaaacugacaauuaugaccggcgacaucaaggggauuaugcaggccggaaaacggucucuuagaccucaacccacggagcucaaguauagcuggaagaccuggggcaaagcgaagaugcuguccacagaaagccauaaccagaccuuccugaucgaugggccugagacagccgaaugccccaauaccaaccgcgcuuggaacucucucgaggucgaggacuacggauuuggcguguucacaaccaacauuuggcugaaacuucgggaaaagcaggacgucuuuugugauuccaaacugaugagcgccgcuaucaaggacaauagagccgugcacgcggauaugggcuauuggaucgagucugcccucaacgacacguggaagauggaaaaggcuagcuucauugaggucaagagcugccacuggccuaaaucucauacacuguggagcaauggggugcuggaguccgaaauggugauccccaagaacuucgccggaccggucagccagcacaacuaccgcccuggcuaucauacccaaaccgcugggcccuggcaccuuggaaaacucgagauggauuuugacuucugugaaggcacaaccguuguggugacggaggauugcgggaaucggggacccucucugagaacaaccacagccuccggcaagcugauuaccgaauggugcugucggagcugcacacucccuccgcugcgcuacagaggcgaggacggguguugguacggaauggagauccggccccuuaaggaaaaagaggaaaaccuggucaauucccucgugaccgccggccaugggcagauugauaacuuuucucugggaguucugggcauggcucuuuuccucgaggaaaugcugagaacgcgcaucgggaccaagcacgcgauucugcucguggccgucagcuuugugacacugaucaccggaaauauguccuuccgggaccuuggcagaguuauggugauggucggcgcuacaaugaccgaugacaucgggaugggagugacguaucuggcccuccuggccgcuuuuaaaguucgcccuacauucgccgcgggccugcuucugagaaagcucaccucuaaagagcugaugauggcuacaauugggaucgcccuccugagccaguccaccauucccgagaccauccuugaacugacagaugcccucgcucugggaaugauggugcugaagauuguccggaacauggagaaguaccaacuugccgugacgaucauggcgaucucuugcgugccuaaugcugucauucugcagaacgccuggaaaguuagcuguaccauccucgccgcuguguccgugagcccccugcuccugacaucuucccagcagaaggccgacuggauuccucuugcucugaccaucaaaggccucaaucccacagccauuuuucugaccacgcugagccgcacaucuaagaaaagauccuggccgcuuaacgaagcgaucauggccgucgggauggugagcauccuggcuucuucccuccugaagaaugacauuccuaugaccggaccccucguugccggcggccugcuuaccgugugcuauguccugacagggcggagcgcugaucuggagcucgaacgcgccgccgacgugaaaugggaggaucaagcugagaucuccggaagcucuccuauucugagcaucaccauuuccgaagacggcucuaugagcaucaagaacgaggaagaggagcagacacuuacgauucugaucagaaccgggcuccugguuaucuccggaguguuccccgucucuauuccgaucacagcggccgcuugguaccucugggaagugaagaaacagcgggccggcguccugugggaugugccuucucccccucccguugagaaggccgaacuugaggacggggcuuaucgcauuaaacagagaggaauccugggcuacucccaaauuggcgccgggguguauaaggaaggaaccuuucacacaauguggcaugucacccggggcgcggugcugaugcaccgcgggaaaagaaucgagcccuccugggcugauguuaagaaggaccucaucagcuacggaggcggguggaaacuggagggagaauggaaggagggcgaagaggugcagguccuugcccuggaaccuggcaaaaauccgcgggccgugcagacgaagcccgggauuuucaaaaccaacacaggaaccaucggcgcugugucccucgauuuuagcccugggacaucuggaucccccauuguugacagaaagggcaaggucguggggcuguacggaaauggcguggucacccgcagcggcgccuaugugucugcgaucgcucagacagagaaauccauugaggauaacccugaaaucgaggacgauaucuuccggaagaaaagacucacgauuauggaccugcaucccggggccggaaagaccaaacgcuaccuuccugccaucguucgggaagcuauuaagagaggccugcgcacacugauccucgccccgacccggguggucgcugccgagauggaagaggcgcugagagggcuucccauucgcuaucaaaccccugccaucaagacagagcacacgggacgggaaauuguggaccugaugugucaugcuaccuucacaaugagacuccugagccccguucgggugccuaacuacaaucucaucaucauggaugaggcccacuuuaccgaccccgcuuccauugccgcccgcggcuauaucucuacaagagucgaaaugggggaggcugcgggcauuuucaugaccgccacgccgccuggaagccgggaucccuuuccccaguccaacgcuccuaucauggacgaggaacgcgagauucccgaaagaagcuggaacucuggccacgagugggugacagauuucaaagggaagaccguuugguuugugccuuccaucaaagccggaaacgacaucgccgcuugccugcggaagaauggcaaaaaggucauucagcuuagcagaaagaccuucgauucugaauacgugaaaacacgcgccaacgacugggauuuuguggucaccacagacaucagcgagaugggggcgaauuucaaggcugagcggguuauugauccgagacgcuguaugaaacccgugauccugaccgacggagaagaacgggugauucuggccggcccuaugcccgucacgcauuccucugccgcucaaagacgcgggcggaucggcagaaacccuaagaaugaaaacgaccaguauaucuacaugggagagccccucgaaaaugaugaggacugcgcccacuggaaagaggcgaagaugcugcuugauaacauuaauacaccggaaggcaucauuccuagcauguuugagcccgaacgcgagaaaguggacgccaucgauggggaauacagacugcggggagaggcucgcaagaccuucguugaccucaugagacggggcgaucugccuguguggcuggccuauaaggucgcugccgaggggauuaacuacgcugaccgcaaaugguguuuugauggaaucaagaauaaccagauucucgaagagaacauggaaguggagaucuggacaaaagagggcgaaagaaagaaacuuaagccccgguggcuggacgccagaaucuauuccgauccucuggcgcucaaggaguucaaagaguucgccgcugggcgcaagucucugacccuuaaucugauuacggagaugggccggcuccccaccuuuaugacacagaaagccagaaacgcucuggacaaucuggccguucuccauaccgccgaagcuggaggccgcgcguacaaccacgcccuuagcgagcugccggagacacuggaaacccuccugcuucugacacuccuggcuaccgugacagggggaaucuuccuguuucucauguccggcaaggggauuggaaaaaugacacuuggcaugugcugcaucauuaccgccagcauccugcugugguaugcccaaauccagccucacuggauugcugccucuaucauucucgaguucuuucugaucguccuucugauucccgaacccgagaagcagcggaccccucaggauaaucaacucacauacguggucaucgcgauccugaccgugguugccgcuacaauggccaacgaaaugggcuuccuggagaagacgaaaaaggaccucgggcuuggauccauuaccacacaggagagcgaauccaauauccuggacauugaucugagaccggcuucugccuggacccucuaugcgguggccacaaccuuugugacgcccaugcugcggcauagcaucgagaacuccucugucaauguuagccuuaccgcuauugccaaccaggcuacagugcugaugggccucgggaaaggauggccucuguccaagauggacaucggcgugccccugcucgccauuggguguuacagccaggucaauccuaucacccuuacagcugcccugcugcuccugguggcgcacuacgccaucauuggacccggccuucaagcuaaagccacccgcgaagcucagaagagagccgccgcgggcaucaugaagaacccuacgguugaugggauuacagugaucgaccuggagccgauucccuaugauccuaaauucgaaaagcagcucggacaggucaugcugcugauccucugcgugacccaaguccuuaugaugcggacaaccugggcucugugugaggcccugacccucgcuacaggccccaucucuacgcugugggaggggaauccuggacgcuuuuggaacaccacaauugccguguccauggccaauaucuucagaggcagcuaccuugcuggggccggacugcucuuuucuauuaugaaaaacaccacauccacccggcgcggcacgggcaauaucggggaaacacugggagagaaguggaaaagcagacugaacgcgcucggcaagucugaguuccagauuuauaaaaagagcgggauccaggagguugaccggacccuugccaaggagggaaucaaacgcggcgaaaccgaucaucacgcuguguccagagggucugccaagcugcggugguuugucgagagaaacauggugacacccgaaggaaaaguuguggaccugggcugcggccgcgggggauggagcuacuauuguggcgggcucaagaauguccgggaggugaaaggacugaccaagggcgggccgggacaugaagaaccuauucccauguccacauacggcuggaaccuugugagacugcaaagcggcguugaugucuucuucacgcccccugagaagugcgacacccuccugugugauaucggggaauccucucccaauccuacaauugaggcuggacgcacccugcgggugcucaaccuuguggaaaauuggcugaacaauaacacacaguuuugcaucaaaguccugaauccguauaugcccagcguuauugagaagauggaagcccuccagagacaguacggcggggcgcuggugcgcaacccucuuuccagaaauucuacccacgagauguacugggugagcaacgccacgggaaauaucgucuccucugugaacaugaucagcagaaugcugauuaaucgcuucaccaugaaacacaagaaagcuacauaugagcccgacguugaucucggcuccgggacccggaacaucggaauugaaagcgagaucccuaaccuggacauuaucggcaagagaauugaaaagaucaaacaagagcaugaaaucucuuggcacuacgaccaggaucaucccuauaagacaugggccuaccacggcuccuaugagaccaaacagacagggagcgcuucuuccauggugaauggagucgugcgccugcucaccaagccgugggacguugugccuauggucacgcagauggccaugacagauaccacccccuuuggccaacagcggguguucaaagagaagguggacacaagaacgcaggaaccuaaggaggggaccaagaaacuuaugaaaauuacagcugaauggcuguggaaagagcugggcaagaagaaaacaccccgcauguguacaagagucgaguuuaccaagaagguucggagcaacgccgcgcucggcgccaucuucacagaugaaaauaaauggaagucugcucgcgaggccguggaagacgggagauuuugggagcugguggaucgggaaagaaaccuucaccuggagggaaaaugcgagaccugugucuacaauaugaugggcaagcgggagaaaaagcucggcgaguucgggaaggcuaaaggaucccgcgccauuugguauauguggcugggcgccagauuucuggaguucgaggcgcucggguuucugaacgaagaccauugguucagccggggaaauucccuuagcggcguggagggggagggccugcaccgccucggauacauccugagagauguuggcaagaaagaagggggagcuauguacgccgacgauacggccggcugggacacccggauuacacuugaggaccugaagaacgaagagauggugaccaaucauaugaaaggggaacacaagaagcucgcugaggccaucuuuaaacugacauaucagaacaaggucgugcgcguucaaagaccuacaccccggggaacggugauggauaucauuucucgcagagaccagcggggcagcgggcaggucggcacauacggacugaauaccuucacaaacauggaggcucaacucauccgccagauggaaggcgaggggauuuucaaauccauccagcaucugaccgccacggaagagauugcggugcagaauuggcuugccagaguuggacgggagcgccugucuagaauggcuaucagcggcgaugacugcguggucaagccgaucgaugaccgguuugccuccgcucucaccgcccugaacgauauggggaaagugagaaaggacauucaacagugggaaccuucucgcggauggaaugauuggacacagguccccuucugcagccaccacuuucaugagcuugugaugaaggacggccggguucuggugguccccuguagaaaccaggaugaacucaucgggcgcgcgcggauuucccaaggcgccggauggucucugaaagagaccgcuugccugggcaagagcuaugcccagauguggacacucauguacuuccacagacgcgaccugcggcuugcugccaacgcuaucuguuccgccgugccuagccauugggugccgaccucuagaacaaccugguccauucacgcgaaacacgaauggaugacgacagaggauaugcuggccguuuggaaucgcguguggauccaggagaaccccuggauggaagacaagaccccugucgagagcugggaagaggugcccuaucucgggaaacgggaagaccaguggugcggaucucugauuggccuuaccuccagagcuacaugggccaagaauauccaaaccgccaucaaccagguucgcagccugauugggaaugaggaguacacagauuauaugccuuccaugaagcgguuuagacgggaagaggaagaggcuggagugcucugguga

SEQ ID NO: 19771 - RNA, 9876 nt, Artificial Sequence
  derived and/or modified CDS sequence (opt5) from DENV-2__FJ639835__SS-prME
accgccggcgugaucgucaugcugauucccaccgcuauggccuuccaccucacgaccagaaauggggaaccucauaugaucguuggacggcaggaaaagggcaaaagccugcuuuuuaagaccgaagacggggugaauaugugcacccugauggcgauugaucucggagaacugugugaagacacgaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggagggauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagauggugauucccaaaaacuucgccggaccggugagccagcacaacuaccgcccuggcuaucauacccaaaccgcugggcccuggcaccuuggaaagcucgaaauggauuuugacuucugugagggcacaaccgucguugugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgucaccgccggccaugggcagaucgauaacuuuucucugggagugcugggcauggcucuuuuccucgaagagaugcugagaacgcgcauugggaccaaacacgcgauccugcucguugccgugagcuuugucacacugaucaccggaaauauguccuuccgggaccuuggcagagugaugguuauggugggcgcuacaaugaccgaugacauugggaugggagucacguaucuggcccuccuggccgcuuuuaaggugcgcccuacauucgccgcgggccugcuucugagaaaacucaccucuaaggagcugaugauggcuacaaucgggauugcccuccugagccaguccaccauccccgaaaccauucuugagcugacagaugcccucgcucugggaaugaugguucugaaaaucgugcggaacauggaaaaguaccaacuugccgucacgaucauggcgauuucuugcgugccuaaugcugugauccugcagaacgccuggaaggucagcuguaccauucucgccgcuguuuccgugagcccccugcuccugacaucuucccagcagaaagccgacuggaucccucuugcucugaccauuaagggccucaaucccacagccaucuuucugaccacgcugagccgcacaucuaaaaagagauccuggccgcuuaacgaggcgaucauggccguggggauggucagcauucuggcuucuucccuccugaaaaaugacaucccuaugaccggaccccucguggccggcggccugcuuaccguuugcuaugugcugacagggcggagcgcugaucuggaacucgagcgcgccgccgacgucaagugggaggaucaagcugaaauuuccggaagcucuccuauccugagcauuaccaucuccgaggacggcucuaugagcauuaaaaacgaagaggaggaacagacacuuacgauccugaucagaaccgggcuccuggugauuuccggaguuuuccccgugucuaucccgauuacagcggccgcuugguaccucugggaggucaagaagcagcgggccggcgugcugugggaugucccuucucccccucccguggaaaaagccgagcuugaagacggggcuuaucgcaucaagcagagagggauucugggcuacucccaaaucggcgccgggguuuauaaagagggaaccuuucacacaauguggcaugugacccggggcgcgguccugaugcaccgcgggaagagaaucgagcccuccugggcugaugugaaaaaggaccucauuagcuacggaggcggguggaagcuggaaggagaguggaaagaaggcgaggaaguucaggugcuugcccuggagccuggcaagaauccgcgggccguccagacgaaacccgggaucuucaagaccaacacaggaaccauuggcgcugugucccucgauuuuagcccugggacaucuggaucccccaucguggacagaaaaggcaagguugucgggcuguacggaaauggcguggugacccgcagcggcgccuaugucucugcgauugcucagacagagaaguccaucgaagauaacccugagaucgaagacgauauuuuccggaaaaagagacucacgaucauggaccugcaucccggggccggaaaaaccaagcgcuaccuuccugccauugugcgggaggcuaucaaaagaggccugcgcacacugauucucgccccgacccggguuguggcugccgaaauggaggaggcgcugagagggcuucccauccgcuaucaaaccccugccauuaagacagaacacacgggacgggagaucgucgaccugaugugucaugcuaccuucacaaugagacuccugagccccgugcggguuccuaacuacaaucucaucauuauggaugaagcccacuuuaccgaccccgcuuccaucgccgcccgcggcuauauuucuacaagaguggagaugggggaggcugcgggcaucuucaugaccgccacgccgccuggaagccgggaucccuuuccccaguccaacgcuccuauuauggacgaagaaagagaaauccccgagagaagcuggaacucuggccacgaaugggucacagauuucaaggggaaaaccgugugguuuguuccuuccaucaaggccggaaacgacauugccgcuugccugcggaaaaauggcaagaaagugauccagcuuagcagaaagaccuucgauucugaguacgucaagacacgcgccaacgacugggauuuuguggugaccacagacauuagcgagaugggggcgaauuucaaagcugaacgggucaucgauccgagacgcuguaugaagcccguuauucugaccgacggagaggaacgggugauccuggccggcccuaugcccgugacgcauuccucugccgcucaaagacgcgggcggaucggcagaaacccuaaaaaugagaacgaccaguauauuuacaugggagaaccccucgagaaugaugaggacugcgcccacuggaaggaagcgaaaaugcugcuugauaacaucaauacaccggagggcauuaucccuagcauguuugaacccgagcgcgaaaaggucgacgccauugauggggaguacagacugcggggagaggcucgcaaaaccuucguggaccucaugagacggggcgaucugccuguuuggcuggccuauaagguggcugccgaagggaucaacuacgcugaccgcaagugguguuuugauggaauuaaaaauaaccagauccucgaggaaaacauggaggucgagaucuggacaaaggaaggcgagcgcaagaaacuuaaaccccgguggcuggacgccagaauuuauuccgauccucuggcgcucaaggaguucaaggaguucgccgcugggcgcaaaucucugacccuuaaucugaucacggaaaugggccggcuccccaccuuuaugacacagaaggccagaaacgcucuggacaaucuggccgugcuccauaccgccgaggcuggaggccgcgcguacaaccacgcccuuagcgagcugccggaaacacuggagacccuccugcuucugacacuccuggcuaccguuacagggggaauuuuccuguuucucauguccggcaaaagcaucgggaagaugacacuuggaaugugcugcauuaucaccgccucuauccugcuguggcacgcccaaauucagccucauuggaucgcugccuccauuauccucgaguucuuucugauugugcuucugauccccgagcccgaaaaacagcggaccccucaggauaaucaacucacauaugucgugaucgcgauucugaccgucguggccgcuacaauggccaacgagaugggcuuccuggagaagacgaagaaagaccucggccuugggagcaucaccacacaggaauccgagucuaauauucuggacaucgaucugagaccggcuagcgccuggacccucuacgcgguugccacaaccuuugugacgcccaugcugcggcacuccauugaaaacucuagcgugaaugucucccuuaccgcuaucgccaaccaggcuacaguucugaugggacucggcaagggguggccucugagcaaaauggacauuggagugccccugcucgccaucggcuguuauucucaggugaauccuaucacccuuacagcugcccugcugcuccuggucgcgcauuacgccauuaucgggcccggacuucaagcuaaggccacccgcgaggcucagaaaagagccgccgcgggcauuaugaagaacccuacgguggauggcaucacaguuauugaccuggaaccgauccccuacgauccuaaguucgagaaacagcucggacaggugaugcugcugauccucugcgucacccaagugcuuaugaugcggacaaccugggcucugugugaggcccugacccucgcuacaggacccauuuccacgcugugggaaggcaauccugggcgcuuuuggaacaccacaaucgccgucagcauggccaauauuuucagaggaucuuaucuugcuggcgccgggcugcucuuuuccaucaugaagaacaccacaagcacccggcgcggaacgggcaauauuggcgagacacugggggaaaaauggaagucuagacugaacgcgcucggaaaaagcgaguuccagaucuacaagaaauccggcauccaggagguggaccggacccuugccaaggaagggauuaagcgcggagagaccgaucaccaugcuguuucuagaggcagcgccaaacugcggugguuuguggaaagaaacauggucacacccgaggggaaggugguugaccugggaugcggccgcggcgggugguccuauuacuguggaggccucaaaaaugugcgggaagucaaggggcugaccaaaggaggcccggggcacgaggagccuauccccaugagcacauauggauggaaccuugugagacugcaauccggcguggauguuuucuucacgcccccugaaaagugcgacacccuccugugugauauuggcgagucuagccccaauccuacaaucgaagcugggcgcacccugcggguccucaaccuuguggagaauuggcugaacaauaacacacaguuuugcauuaaggugcugaauccguacaugcccuccgucaucgagaagauggaggcccuccagagacaguauggaggcgcgcugguucgcaacccucuuucucggaauagcacccacgagauguacuggguguccaacgccacggggaauaucgugucuagcgucaacaugauuuccagaaugcugaucaaucgcuucaccaugaagcauaaaaaggcuacauacgaacccgacguggaucucggaagcggcacccggaacauugggaucgagaacgaaauuccuaaucuggacaucauuggaaaaagaaucgagaagaucaagcaagaacacgagauuucuuggcauuaugaccaggaucaccccuacaaaacaugggccuaucacggcuccuacgagaccaagcagacaggcagcgcuucuuccaugguuaacggggugguccgccugcucaccaaaccgugggacgugguuccuauggugacgcagauggccaugacagauaccacccccuuuggacaacagcgggucuucaaggaaaaaguggacacaagaacgcaggagccuaaggaaggcaccaagaaacuuaugaagaucacagcugaguggcuguggaaagagcuggggaagaaaaagacaccccgcauguguacaagagaagaguuuacccggaaagugcgcagcaaugccgcgcucggagccauuuucacagaugaaaacaaguggaagucugcuagagaggccgucgaagacggccgguuuugggagcugguugauagagagcggaaucuucaucuggaagggaaaugcgagaccuguguguauaacaugaugggaaagcgcgagaagaagcucggcgaguucggcaaagcuaagggguccagagccaucugguacauguggcugggagcccgguuucuggaguucgaggcgcucggcuuucugaaugaggaccacugguucagccgcgggaacucccuuagcggaguggaaggcgaggggcugcauagacucggcuauauucugcgggaugucggaaagaaagaaggcggggcuauguacgccgacgauacggccggaugggacacccgcaucacacuugaggaccugaagaaugaagagauggugaccaaccacaugaaaggcgagcauaagaaacucgcugaagccaucuuuaagcugacauaccagaauaagguugugagaguccaacggccuacaccccgcgggacggugauggauauuaucucuagacgggaccagcgcggaagcggccagguugggacauauggccugaacaccuucacaaauauggaggcucaacucauuagacagauggaaggagagggcaucuucaaauccauucagcaccugaccgccacggaggaaaucgcggugcagaacuggcuugcccgggucgggcgcgagagacugucucggauggcuaucagcggagaugacugcgugguuaagccgauugaugacagauuugccuccgcucucaccgcccugaaugauaugggcaaagugcgcaaggacauccaacagugggaaccuucucggggguggaacgauuggacacagguccccuucugcagccaccauuuucacgagcuugugaugaaagacggaagaguccuggugguucccugucgcaaccaggaugaacucauuggccgggcgagaaucucccaaggggccggcuggucucugaaggagaccgcuugccugggaaagagcuacgcccagauguggacacucauguauuuccaucgccgggaccugagacuugcugccaaugcuauuuguuccgccgugccuagccacugggucccgaccucucgcacaaccugguccauccacgcgaaacaugaguggaugacgacagaagauaugcuggccguguggaaccggguguggauucaggagaaucccuggauggaagacaagaccccuguugagagcugggaagaggugcccuaccucggcaaaagagaggaccaguggugcgggucucugaucggacuuaccucccgcgcuacaugggccaagaacauccaaaccgccauuaaucagguccggagccugaucggcaacgaagaguauacagauuacaugccuuccaugaaaagauuucggagagaagaggaagaggcuggggugcucugguga

SEQ ID NO: 19772 - RNA, 9876 nt, Artificial Sequence
  derived and/or modified CDS sequence (opt5) from DENV-2__FJ850050__SS-prME
acagccggcgugaucgucaugcugauucccacagcuauggccuuccaccucacgacacggaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccccuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaagacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcggaacagagauucagaugagcuccggcaaucuucuguuuaccgggcaucucaaaugcagacugcggauggauaaacuucaacugaaaggaaugucuuacagcauguguaccggcaaguucaagaucgucaaagaaauugcugagacacagcacgggacgaucgugaucagaguccaguaugagggagacggcucccccugcaagauucccuucgaaaucaccgaucucgagaaacgccaugugcuggggcggcugauuacaguuaacccuaucgugaccgaaaaggacagcccggucaacauugaggcggaacccccuuuuggcgauucuuacaucauuaucggaguggagcccggccagcucaaacugaauugguucaagaagggguccagcaucggacaaauguuugagacaaccaugagaggcgccaaacgcauggcuauucuuggggacacggccugggauuucggaucucugggcgggguuuuuacaagcaucggcaaggcccuccaccagguguucggagcuauuuacggcgccgcguuuuccggggucucuuggaccaugaaaauccugauuggagugaucaucaccuggauuggcaugaacagccgguccacaagccugucugugucccuuguucucgucgggguggugacccuguaucugggagcugucgugcaggccgacagcggcuguguugugucuuggaagaauaaagaacucaagugcggguccggcaucuucauuacagauaacguccacacguggaccgagcaguacaaguuucaaccugaaagccccuccaaacuggccucugcuauccagaaggcccaugaggaaggaauuuguggcaucagaagcgugacacgccuugagaaucugauguggaaacagaucaccccggagcucaaccacauucuguccgaaaaugagguuaagcugacaaucaugaccggggacauuaaaggaaucaugcaggcuggcaagcggucucuuagaccucaacccacggaacucaaauauagcuggaagaccugggggaaggccaaaaugcuguccacagagagccauaaccagaccuuccugauugauggaccugaaacagcggagugccccaauaccaaccgcgccuggaacucucucgagguggaagacuacggcuuuggcgucuucacaaccaacaucuggcugaaacuucgggagaaacaggacguguuuugugauuccaagcugaugagcgcugccaucaaauauaauagagcuguucacgccgacaugggguacuggauugaaucugcgccuugcgauuccugggagaugcagaaggccagcuucaucgaggugauuucuugucacuggcccaagagccucacgcugugguccaacggaguccuggaaagcgagaugaucauuccgaaaaauuucgcuggcccugugucucaacauaacuaucgccccggguaccacacacagaccgccggacccuggcaucuuggcaagcucgaaauggacuuugauuucugcgaggggaccacaguggucguuaccgaagacugcggaaaccggggcccuucccugagaacgacaaccgcuagcggcaaacugaucacagagugguguugccgguccuguacccucccgccccugcgcuacagaggggaggauggaugcugguauggcauggaaauucggccucuuaaggagaaagaagagaaucuggugaacucucucgugacagccgggcacggacagaucgacaauuuuagccugggcguccuggggauggcccuuuuccucgaagagaugcugagaacccgcaucggaacgaagcaugcuauucugcucguggcgguuuccuuugugacccugaucacaggcaacaugucuuuccgggaucuuggcagagucauggugaugguuggggccaccaugacagacgauauuggaaugggcgugaccuaccuggcucuccuggccgccuuuaagguccgccccacguucgcugccgggcugcuucugagaaaacucacaagcaaggagcugaugauggcgaccaucggaauugcucuccugucccaaucuacaaucccugaaaccauccuugagcugaccgacgcccucgcccugggcaugauggugcugaaaauuguucggaauauggaaaaguaucagcuugcugugacaaucauggccauuagcuguguccccaacgcggugauccugcagaaugcuuggaaaguguccugcacgauucucgccgccgucagcguuucuccucugcuccugaccuccagccagcaaaaggcugauuggaucccccuugcccugacaaucaaggggcucaacccgaccgcuauuuuucugacaacccugucucgcacguccaaaaagagaagcuggccucuuaaugaggccaucauggcggugggaauggugucuauucuggccuccagccuccugaaaaacgacauccccaugacaggcccucucgucgcuggcgggcugcuuaccguguguuacguucugaccggacgguccgccgaccuggaacucgagcgcgcugccgaugugaagugggaggaccaggccgaaauuagcggcucuagccccauccuguccauuacaaucucugaggaugggagcauguccaucaaaaaugaagaggaggaacagacccuuacaauucugaucagaacgggacuccuggucauuucuggcguguucccgguuagcaucccuauuaccgcugcggccugguaucucugggaggugaagaaacagcgggcugggguccugugggacgugcccuccccuccgcccgucgaaaaggccgagcuugaagauggagccuaccgcaucaagcaaagaggcauccugggcuauucucagauuggggcuggaguguacaaagagggcacauuucacaccauguggcacguuacaagaggggccgugcugaugcaucgcggaaagagaaucgagccuagcugggcggacgucaaaaaggaucucauuuccuacggcgggggauggaaacuggaaggcgaguggaaggaaggcgaggaagugcagguucuugcucuggagccggggaagaacccccgggccgugcagaccaaaccuggaaucuucaagacgaauaccggcacaauuggggccgucagccucgacuuuucucccggaaccuccggcagcccuaucguggauagaaaagggaaggugguuggacuguauggcaacggcgucgugacacgcucuggggcuuacguguccgccaucgcgcaaaccgagaaaagcauugaagacaaucccgagaucgaagaugacauuuuccggaagaagagacucacaaucauggaucugcacccuggagcuggcaaaacgaagcgcuaucuuccggccauuguccgggaggccaucaaaagagggcugcgcacccugauucucgcucccacacgggugguugccgcugaaauggaggaggcccugagaggacuuccuauccgcuaccagacccccgcgaucaagaccgaacauacaggccgggagauuguggaccugaugugccacgccacguucaccaugagacuccuguccccuguccgggugcccaacuauaaccucaucauuauggacgaagcucauuuuacagauccggccucuaucgcugcccgcggguacauuagcaccagaguugagaugggcgaggccgcuggaaucuucaugacagcgaccccucccggcucccgggaccccuuuccucagagcaaugcccccaucauggaugaagaaagagaaauuccugagagaucuuggaacuccgggcacgaaugggugacggacuucaaaggaaagacagucugguuugugccgagcaucaaggcuggcaaugauauugccgccugucugcggaaaaacgggaagaaaguuauccaacuuucuagaaagaccuucgacagcgaguaugugaaaacccgcgcuaaugauugggacuuugucgugacaaccgauauuuccgagaugggagccaacuucaaggcggaacgggugaucgaccccagacgcugcaugaagccugucauccugacagauggcgaggaacggguuauucuggcugggcccaugccugugacccacucuagcgccgcccagagacgcggccggaucggaagaaaucccaaaaacgagaaugaccaguacauuuacaugggcgaaccgcucgagaacgacgaggauugugcucauuggaaggaagccaaaaugcugcuugacaauaucaacacgccugaggggauuauccccuccauguuugaaccugagcgcgaaaagguggaugcgauugacggagaguauagacugcggggcgaggcccgcaaaacauucgucgaucucaugagaagaggggaccugcccguguggcuggcuuacaagguugccgcugaaggaaucaauuaugccgaucgcaaauggugcuuugacggcaucaagaacaaucagauucucgaggaaaacaugcaagagcagaucuggaccaaggagggggaacgcaagaaacuuaaaccucgguggcuggaugcuagaauuuacucugacccccuggcccucaaggaguucaaagaguucgcggccggccgcaagagccugacacuuaaccugaucaccgagaugggacggcucccgacguuuaugacccagaaggcuagaaaugcccuggauaaccuggcugugcuccacacagccgaagccggcgggcgcgcuuauaaucaugcgcuuuccgagcugccugagacccuggaaacacuccugcuucugacccuccuggccacagucaccggaggcauuuuccuguuucucaugagcgggaaaggaaucggcaagaugacgcuuggcaugugcuguaucauuacagcuucuauccugcugugguacgcccagauucaaccccacuggaucgccgcuuccauuauccucgaguucuuucugaucgugcuucugauucccgaaccugagaaacagcggaccccgcaggacaaccagcucaccuauguugugaucgccauucugacagucguggcggccaccauggcuaaugaaaugggguuccuggagaagaccaagaaggaucucggacuuggcagcaucacgacccaagaguccgaaucuaacauucuggacaucgaccugagacccgccagcgcuuggacacucuacgccgucgcgaccacauuugugaccccuaugcugcggcacuccauugaaaauucuagcguuaacgugucccuuacggccaucgcuaaucaggccaccgugcugauggggcucggaaagggcuggccccugagcaaaauggauaucggggucccucugcucgcuauuggaugcuacucucagguuaaccccaucacacuuaccgccgcucugcugcuccugguggcccauuaugcgauuaucggcccuggccuucaggccaaggcuacacgcgaagcccagaagcgggcugccgccgggauuaugaagaauccgaccguggacggaaucacggucaucgaucuggagcccauuccuuacgaccccaaauucgaaaagcagcucggccaggugaugcugcugauccucuguguuacacaagugcuuaugaugcggaccacaugggcgcugugcgaggcucugacccucgccaccgggccuauuuccacacugugggagggaaaccccggccgcuuuuggaauacgaccaucgcugucagcauggccaacauuuucagagggucuuaucuugccggagcuggccugcucuuuuccaucaugaagaauacaaccagcacacggcgcggcaccgggaacaucggagaaacgcugggcgagaaauggaagucuagacugaaugcccucgggaaaagcgaguuccagauuuacaagaaauccggaauccaggagguggaucggacacuugcgaaggagggcauuaaacgcggggaaaccgaccaccaugccgucucuagaggaagcgcuaagcugcggugguuuguggagagaaacaugguuaccccggaaggcaagguggucgaucugggcugugggcgcggaggcugguccuauuacugcgggggacucaaaaacgugcgggagguuaagggccugacaaaagggggaccuggccacgaagaacccauccccaugagcaccuauggcuggaaucuugugagacugcaguccggggucgacguguucuucacaccucccgagaagugugauacgcuccugugcgacauuggagaaucuagcccuaacccgaccaucgaggccggccgcacacugcgggugcucaaucuuguugaaaacuggcugaauaacaauacccaauuuuguaucaaaguccugaaccccuacaugccuuccgugauugagaagauggaagcucuccagagacaguacgggggagcccuggugcgcaauccccuuucucggaacagcacacaugagauguauugggucuccaaugcgaccggcaacaucguuucuagcgugaauaugauuuccagaaugcugaucaaccgcuucacgaugaagcacaaaaaggccaccuacgagccugauguggaccucgggagcggaacacggaauauuggcaucgaaucugagauucccaaccuggauaucaucggcaaaagaauugaaaagaucaaacaggagcacgaaauuuccuggcauuaugaccaagaccacccguacaagaccugggcuuaucaugggagcuacgagacaaagcagaccggaucugccuccagcauggucaacggcgugguucgccugcucacaaaaccuugggaugugguccccauggugacccagauggcuaugacggacacaaccccuuuugggcagcaacggguuuucaaggagaaaguggauaccagaacacaggaacccaaggagggaacgaagaaacuuaugaaaaucaccgccgaauggcuguggaaagagcugggcaagaaaaagacaccucgcaugugcaccagagaggaauuuaccaagaagguccggucuaaugcugcccucggggcgauuuucaccgacgagaacaaauggaaguccgcccgcgaagcuguggaggauggaagauuuugggaacugguggaccgggagagaaaucuucaccuggagggcaagugugaaacaugcgucuauaacaugaugggcaaacgggagaagaaacucggggaguucggaaaggccaaaggcagccgcgcuaucugguacauguggcugggggccagauuucuggaguucgaagcccucggauuucugaaugaggaucacugguucucccggggcaacagccuuucugggguugagggcgaaggacugcaucgccucggcuacauccugagagacguggggaagaaggagggaggcgcgauguaugcugaugacaccgccgggugggauacgcggauuacccuugaagaccugaaaaaugaggaaauggugacaaaccacaugaagggagagcauaaaaagcucgccgaggcuaucuuuaaacugaccuaccagaauaaggucgugcgcguucaaagacccacaccgcggggcaccgugauggacauuaucagccgcagagaucagcggggguccggccaggucggaacguauggccugaacacauucaccaauauggaagcccagcucauucgccaaauggagggggaaggaaucuucaagucuauccagcaccugacagcuaccgaggagauugccgugcagaacuggcuugcgagaguuggccgggaacgccugagcagaauggccaucuccggggacgauugcguggucaaaccuauugacgaucgguuugcuucugcccucacggcucugaaugacaugggaaaggugagaaaagauauccagcaaugggagcccagccgcggcuggaacgacuggacccagguucccuucuguucccaucacuuucacgaacuugugaugaaggaugggcggguccugguggucccuugcagaaaucaggacgagcucauuggccgcgcccggaucucucagggagcgggcuggagccugaaagaaacagccugucuggggaaguccuacgcucaaauguggacccucauguauuuccauagacgcgaucugcggcuugccgcuaacgccauuugcagcgcugugccgucucacuggguucccacauccagaaccacauggagcauccaugccaagcacgaguggaugaccacggaggacaugcuggcgguguggaaccgcgucuggauccaggaaaauccuuggauggaggauaaaacacccguggaaucuugggaggaagugccuuaccucggaaagcgggaggaccagugguguggcucccugauugggcuuaccagcagagccaccugggcuaaaaacauccagacagccauuaaucaaguucgcucccugaucggaaacgaggaauauaccgacuacaugcccucuaugaagcgguuuagacgggaggaagaggaagccggcgugcucugguga

SEQ ID NO: 19773 - RNA, 9876 nt, Artificial Sequence
  derived and/or modified CDS sequence (opt5) from DENV-2__FJ639837__SS-prME
accgccggcgugaucgucaugcugauucccaccgcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacgaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggagggauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagauggugauucccaaaaacuucgccggaccggugagccagcacaacuaccgcccuggcuaucauacccaaaccgcugggcccuggcaccuuggaaagcucgaaauggauuuugacuucugugagggcacaaccgucguugugacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgucaccgccggccaugggcagaucgauaacuuuucucugggagugcugggcauggcucuuuuccucgaagagaugcugagaacgcgcauugggaccaaacacgcgauccugcucguugccgugagcuuugucacacugaucaccggaaauauguccuuccgggaccuuggcagagugaugguuauggugggcgcuacaaugaccgaugacauugggaugggagucacguaucuggcccuccuggccgcuuuuaaggugcgcccuacauucgccgcgggccugcuucugagaaaacucaccucuaaggagcugaugauggcuacaaucgggauugcccuccugagccaguccaccauccccgaaaccauucuugagcugacagaugcccucgcucugggaaugaugguucugaaaaucgugcggaacauggaaaaguaccaacuugccgucacgaucauggcgauuucuugcgugccuaaugcugugauccugcagaacgccuggaaggucagcuguaccauucucgccgcuguuuccgugagcccccugcuccugacaucuucccagcagaaagccgacuggaucccucuugcucugaccauuaagggccucaaucccacagccaucuuucugaccacgcugagccgcacaucuaaaaagagauccuggccgcuuaacgaggcgaucauggccguggggauggucagcauucuggcuucuucccuccugaaaaaugacaucccuaugaccggaccccucguggccggcggccugcuuaccguuugcuaugugcugacagggcggagcgcugaucuggaacucgagcgcgccgccgacgucaagugggaggaucaagcugaaauuuccggaagcucuccuauccugagcauuaccaucuccgaggacggcucuaugagcauuaaaaacgaagaggaggaacagacacuuacgauccugaucagaaccgggcuccuggugauuuccggaguuuuccccgugucuaucccgauuacagcggccgcuugguaccucugggaggucaagaagcagcgggccggcgugcugugggaugucccuucucccccucccguggaaaaagccgagcuugaagacggggcuuaucgcaucaagcagagagggauucugggcuacucccaaaucggcgccgggguuuauaaagagggaaccuuucacacaauguggcaugugacccggggcgcgguccugaugcaccgcgggaagagaaucgagcccuccugggcugaugugaaaaaggaccucauuagcuacggaggcggguggaagcuggaaggagaguggaaagaaggcgaggaaguucaggugcuugcccuggagccuggcaagaauccgcgggccguccagacgaaacccgggaucuucaagaccaacacaggaaccauuggcgcugugucccucgauuuuagcccugggacaucuggaucccccaucguggacagaaaaggcaagguugucgggcuguacggaaauggcguggugacccgcagcggcgccuaugucucugcgauugcucagacagagaaguccaucgaagauaacccugagaucgaagacgauauuuuccggaaaaagagacucacgaucauggaccugcaucccggggccggaaaaaccaagcgcuaccuuccugccauugugcgggaggcuaucaaaagaggccugcgcacacugauucucgccccgacccggguuguggcugccgaaauggaggaggcgcugagagggcuucccauccgcuaucaaaccccugccauuaagacagaacacacgggacgggagaucgucgaccugaugugucaugcuaccuucacaaugagacuccugagccccgugcggguuccuaacuacaaucucaucauuauggaugaagcccacuuuaccgaccccgcuuccaucgccgcccgcggcuauauuucuacaagaguggagaugggggaggcugcgggcaucuucaugaccgccacgccgccuggaagccgggaucccuuuccccaguccaacgcuccuauuauggacgaagaaagagaaauccccgagagaagcuggaacucuggccacgaaugggucacagauuucaaggggaaaaccgugugguuuguuccuuccaucaaggccggaaacgacauugccgcuugccugcggaaaaauggcaagaaagugauccagcuuagcagaaagaccuucgauucugaguacgucaagacacgcgccaacgacugggauuuuguggugaccacagacauuagcgagaugggggcgaauuucaaagcugaacgggucaucgauccgagacgcuguaugaagcccguuauucugaccgacggagaggaacgggugauccuggccggcccuaugcccgugacgcauuccucugccgcucaaagacgcgggcggaucggcagaaacccuaaaaaugagaacgaccaguauauuuacaugggagaaccccucgagaaugaugaggacugcgcccacuggaaggaagcgaaaaugcugcuugauaacaucaauacaccggagggcauuaucccuagcauguuugaacccgagcgcgaaaaggucgacgccauugauggggaguacagacugcggggagaggcucgcaaaaccuucguggaccucaugagacggggcgaucugccuguuuggcuggccuauaagguggcugccgaagggaucaacuacgcugaccgcaagugguguuuugauggaauuaaaaauaaccagauccucgaggaaaacauggaggucgagaucuggacaaaggaaggcgagcgcaagaaacuuaaaccccgguggcuggacgccagaauuuauuccgauccucuggcgcucaaggaguucaaggaguucgccgcugggcgcaaaucucugacccuuaaucugaucacggaaaugggccggcuccccaccuuuaugacacagaaggccagaaacgcucuggacaaucuggccgugcuccauaccgccgaggcuggaggccgcgcguacaaccacgcccuuagcgagcugccggaaacacuggagacccuccugcuucugacacuccuggcuaccguuacagggggaauuuuccuguuucucauguccggcaaaagcaucgggaagaugacacuuggaaugugcugcauuaucaccgccucuauccugcuguggcacgcccaaauucagccucauuggaucgcugccuccauuauccucgaguucuuucugauugugcuucugauccccgagcccgaaaaacagcggaccccucaggauaaucaacucacauaugucgugaucgcgauucugaccgucguggccgcuacaauggccaacgagaugggcuuccuggagaagacgaagaaagaccucggccuugggagcaucaccacacaggaauccgagucuaauauucuggacaucgaucugagaccggcuagcgccuggacccucuacgcgguugccacaaccuuugugacgcccaugcugcggcacuccauugaaaacucuagcgugaaugucucccuuaccgcuaucgccaaccaggcuacaguucugaugggacucggcaagggguggccucugagcaaaauggacauuggagugccccugcucgccaucggcuguuauucucaggugaauccuaucacccuuacagcugcccugcugcuccuggucgcgcauuacgccauuaucgggcccggacuucaagcuaaggccacccgcgaggcucagaaaagagccgccgcgggcauuaugaagaacccuacgguggauggcaucacaguuauugaccuggcuccgauccccuacgauccuaaguucgaaaaacagcucggacaggugaugcugcugauccucugcgucacccaagugcuuaugaugcggacaaccugggcccugugugaggcucugacccucgccacaggacccauuuccacgcugugggagggcaauccugggcgcuuuuggaacaccacaaucgccgucagcauggcuaauauuuucagaggaucuuaucuugccggcgcggggcugcucuuuuccaucaugaagaacaccacaagcacccggcgcggaacgggcaauauuggcgaaacacugggggagaaauggaagucuagacugaacgcccucggaaaaagcgaguuccagaucuacaagaaauccggcauccaggagguggaccggacccuugcuaaggaggggauuaagcgcggagaaaccgaucaccaugccguuucuagaggcagcgcuaaacugcggugguuuguggagagaaacauggucacacccgaagggaaggugguugaccugggaugcggccgcggcgggugguccuauuacuguggaggccucaaaaaugugcgggaggucaaggggcugaccaaaggaggcccggggcacgaagaaccuauccccaugagcacauauggauggaaccuugugagacugcaauccggcguggauguuuucuucacgcccccugagaagugcgacacccuccugugugauauuggcgaaucuagccccaauccuacaaucgaggccgggcgcacccugcggguccucaaccuuguggaaaauuggcugaacaauaacacacaguuuugcauuaaggugcugaauccguacaugcccuccgucaucgagaaaauggaagcgcuccagagacaguauggaggcgcccugguucgcaacccucuuucucggaauagcacccacgagauguacuggguguccaacgcuacggggaauaucgugucuagcgucaacaugauuuccagaaugcugaucaaucgcuucaccaugaagcauaaaaaggccacauacgagcccgacguggaucucggaagcggcacccggaacauugggaucgaaaacgagauuccuaaucuggacaucauuggaaaaagaaucgaaaagaucaagcaagagcacgaaauuucuuggcauuaugaccaggaucaccccuacaaaacaugggcuuaucacggcuccuacgagaccaagcagacaggcagcgccucuuccaugguuaacggggugguccgccugcucaccaaaccgugggacgugguuccuauggugacgcagauggcuaugacagauaccacccccuuuggacaacagcgggucuucaaggagaaaguggacacaagaacgcaggaaccuaaggagggcaccaagaaacuuaugaagaucacagccgaauggcuguggaaagagcuggggaagaaaaagacaccccgcauguguacaagagaggaauuuacccggaaagugcgcagcaaugcggcccucggagcuauuuucacagaugagaacaaguggaagucugccagagaagcugucgaggacggccgguuuugggaacugguugauagagagcggaaucuucaucuggaggggaaaugcgaaaccuguguguauaacaugaugggaaagcgcgagaaaaagcucggcgaguucggcaaagccaagggguccagagccaucugguacauguggcugggagcgcgguuucuggaguucgaagcucucggcuuucugaaugaggaccacugguucagccgcgggaacucccuuagcggaguggagggcgaagggcugcauagacucggcuauauucugcgggaugucgccaagaaagagggaggcgccauguacgcugacgauacggccgggugggacacccgcaucacacuugaagaccugaagaaugaggaaauggugaccaaccacaugaaaggagagcauaagaaacucgcugaggccaucuuuaagcugacauaccagaauaagguugugagaguccaacggccuacaccccgcggcacggugauggauauuaucucuagacgggaccagcgcgggagcggacagguuggcacauaugggcugaacaccuucacaaauauggaagcgcaacucauuagacagauggagggcgaaggaaucuucaaauccauucagcaccugaccgccacggaggagaucgcugugcagaacuggcuugcccgggucggccgcgaaagacugucucggauggcuaucagcggggaugacugcgugguuaagccgauugaugacagauuugccuccgcgcucaccgcccugaaugauaugggaaaagugcgcaaggacauccaacagugggagccuucucggggcuggaacgauuggacacagguccccuucugcagccaccauuuucacgaacuugugaugaaagacgggagaguccuggugguucccugucgcaaccaggaugagcucauuggacgggcuagaaucucccaaggcgccggguggucucugaaggaaaccgcuugccugggcaagagcuacgcccagauguggacacucauguauuuccaucgccgggaccugagacuugcugccaaugcgauuuguuccgccgugccuagccacugggucccgaccucucgcacaaccugguccauccacgcuaaacaugaguggaugacgacagaggauaugcuggccguguggaaccggguguggauucaggaaaaucccuggauggaggacaagaccccuguugaaagcugggaggaagugcccuaccucggaaaaagagaggaccaguggugcggcucucugaucgggcuuaccucccgcgccacaugggcuaagaacauccaaaccgccauuaaucagguccggagccugaucggaaacgaggaauauacagauuacaugccuuccaugaaaagauuucggagagaggaagaggaagcgggcgugcucugguga

SEQ ID NO: 19774 - RNA, 9876 nt, Artificial Sequence
  derived and/or modified CDS sequence (opt5) from DENV-2__FJ744706__SS-prME
accgccggagugaucgucaugcugauucccaccgcuauggccuuccaccucacgacccggaauggggagccucauaugaucguuggacggcaggaaaagggaaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcaccggcgggaaaagcgcagcgucgcucucgugccucauguuggaaugggccuggagacccggacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagggagccauaaccagaccuuccugauugauggaccugagacagccgaaugccccaauaccaaccgcgcuuggaacucucucgagguggaggacuacggcuuuggcgucuucacaaccaacaucuggcugaaacuucgggaaaaacaggacguguuuugugauuccaagcugaugagcgccgcuaucaaagacaauagagccguucacgcggauaugggguauuggauugagucugcccucaacgacacguggaagauggaaaaggcuuccuucaucgaggugaaaagcugccacuggccuaagucucauacacuguggagcaauggaguccuggaguccgaaaugauuauccccaaaaacuucgccggcccggugagccagcacaacuaccgcccuggguaucauacccaaaccgcuggacccuggcaccuuggcaagcucgagauggauuuugacuucugugaagggacaaccguggucguuacggaggauugcggaaaucggggccccucucugagaacaaccacagccuccggcaaacugauuaccgaauggugcugucggagcugcacacucccuccgcugcgcuacagaggggaggacggauguugguacggcauggagauccggccccuuaaggaaaaggaggaaaaccuggugaauagccucgugaccgccgggcauggacagauugauaacuuuucucugggcguccuggggauggcucuuuuccucgaggaaaugcugagaacgcgcaucggaaccaaacacgcgauccugcucguggccguuagcuuugugacacugauuaccggcaauauguccuuccgggaccuuggcagagucauggugaugguuggggcuacaaugaccgaugacaucggaaugggcgugacguaucuggcccuccuggccgcuuuuaagguccgcccuacauucgccgcggggcugcuucugagaaaacucaccucuaaggagcugaugauggcuacaauuggaaucgcccuccugagccaguccaccauucccgagaccauccuugaacugacagaugcccucgcucugggcaugauggugcugaaaaucguucggaacauggagaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaaggggcucaaucccacagccaucuuucugaccacgcugagccgcacaucuaaaaagagauccuggccgcuuaacgaagcgauuauggccgugggaauggugagcauccuggcuucuucccuccugaaaaaugacauuccuaugaccggcccccucgucgccggcgggcugcuuaccgugugcuauguucugacaggacggagcgcugaucuggagcucgaacgcgccgccgacgugaagugggaggaucaagcugagaucuccggcagcucuccuauucugagcaucaccauuuccgaagacgggucuaugagcaucaaaaacgaggaagaggagcagacacuuacgauccugauuagaaccggacuccuggucaucuccggcguguuccccguuucuauuccgaucacagcggccgcuugguaccucugggaagugaagaagcagcgggccgggguccugugggaugugccuucucccccucccgucgagaaagccgaacuugaggacggagcuuaucgcauuaagcagagaggcauccugggcuacucccaaaucggggccggaguguauaaagaaggcaccuuucacacaauguggcauguuaccagaggggcggugcugaugcaccgcggaaagagaauugagcccuccugggcugaugucaaaaaggaccucaucagcuacggcgggggauggaagcuggagggcgaauggaaagagggcgaagaggugcagguucuugcccuggaaccugggaagaauccgcgggccgugcagacgaaacccggaauuuucaagaccaacacaggcaccaucggggcugucucccucgauuuuagcccuggaacaucuggcucccccauuguggacagaaaagggaaggugguuggacuguacggcaauggcgucgugacccgcagcggggccuaugugucugcgaucgcucagacagagaaguccaucgaggauaacccugaaauugaggacgauaucuuccggaaaaagagacucacgauuauggaccugcaucccggagccggcaaaaccaagcgcuaccuuccugccaucguccgggaagcuauuaaaagagggcugcgcacacugauccucgccccgacccgggugguugcugccgagauggaagaggcgcugagaggacuucccauucgcuaucaaaccccugccaucaagacagagcacacgggccgggaaaucguggaccugaugugucaugcuaccuucacaaugagacuccugagccccguccgggugccuaacuacaaucucauuaucauggaugaggcccacuuuaccgaccccgcuuccauugccgcccgcggguauaucucuacaagaguugaaaugggcgaggcugcgggaauuuucaugaccgccacgccgccuggcagccgggaucccuuuccccaguccaacgcuccuaucauggacgaggaacgcgagauccccgaaagaagcuggaacucugggcacgagugggugacagauuucaagggaaaaaccgucugguuugugccuuccauuaaggccggcaacgacaucgccgcuugccugcggaaaaaugggaagaaaguuauucagcuuagcagaaagaccuucgauucugaauacgugaagacacgcgccaacgacugggauuuugucgugaccacagacaucagcgagaugggagcgaauuucaaagcugagcgggugauugauccgagacgcuguaugaagcccgucauccugaccgacggcgaagaacggguuauccuggccgggccuaugcccgugacgcauuccucugccgcucaaagacgcggccggauuggaagaaacccuaaaaaugaaaacgaccaguauaucuacaugggcgagccccucgaaaaugaugaggacugcgcccacuggaaggaggcgaaaaugcugcuugauaacauuaauacaccggaagggaucauuccuagcauguuugagcccgaacgcgagaagguggacgccaucgauggagaauacagacugcggggcgaggcucgcaaaaccuucgucgaccucaugagaagaggggaucugccuguguggcuggccuauaagguugcugccgagggaauuaacuacgcugaccgcaagugguguuuugauggcaucaaaaauaaccagauccucgaagagaacauggaaguggagauuuggacaaaggagggggaacgcaagaaacuuaaaccccgguggcuggacgccagaaucuauuccgauccucuggcgcucaaggaguucaaggaguucgccgcuggccgcaaaucucugacccuuaaucugauuacggagaugggacggcuccccaccuuuaugacacagaaggccagaaacgcucuggacaaucuggccguccuccauaccgccgaagcuggcgggcgcgcguacaaccacgcccuuagcgagcugccggagacacuggaaacccuccugcuucugacacuccuggcuaccgugacgggaggcaucuuccuguuucucauguccgggaaaggaauuggcaagaugacacuuggcaugugcugcaucaucaccgccagcauucugcugugguaugcccaaauccagccucacuggauugcugccucuaucauucucgaguucuuucugaucguucuucugauccccgaacccgagaaacagcggaccccucaggauaaucaacucacauacguggucauugcgauccugaccguggucgccgcuacaauggccaacgaaaugggguuccuggagaagacgaagaaagaccucggacuuggcuccauuaccacacaggagagcgaauccaauauccuggacauugaucugagaccggcuucugccuggacccucuaugcgguggccacaaccuuuguuacgcccaugcugcggcauagcaucgagaacuccucugugaaugugagccuuaccgcuauugccaaccaggcuacaguccugauggggcucggaaagggcuggccucuguccaaaauggacaucgggguuccccugcucgccaucggauguuacagccaggugaauccuauuacccuuacagcugcccugcugcuccugguggcgcacuacgccaucauuggccccggccuucaagcuaaggccacccgcgaagcucagaaaagagccgccgcggggaucaugaagaacccuacggucgauggaauuacagugaucgaccuggagccgauccccuaugauccuaaguucgaaaaacagcucggccagguuaugcugcugauucucugcgugacccaaguccuuaugaugcggacaaccugggcucugugugaggcccugacccucgcuacagggcccaucucuacgcugugggagggaaauccuggccgcuuuuggaacaccacaauugccguguccauggccaauaucuucagagggagcuaccuugcuggagccggccugcucuuuucuauuaugaagaacaccacauccacccggcgcggcacggggaauaucggagaaacacugggcgagaaauggaaaagcagacugaacgcgcucgggaaaucugaguuccagaucuauaagaaaagcggcauucaggaggucgaccggacccuugccaaggagggcaucaagcgcggggaaaccgaucaucacgcuguguccagaggaucugccaaacugcggugguuuguugagagaaacauggugacacccgaaggcaaggucguggaccugggcugcgggcgcggaggcuggagcuacuauugugggggacucaaaaauguucgggaggugaagggccugaccaaagggggaccgggccaugaagaaccuauucccauguccacauacggcuggaaccuugucagacugcaaagcgggguggauguguucuucacgcccccugagaagugcgacacccuccugugugauaucggagaauccucucccaauccuacaauugaggcuggccgcacccugcggguucucaaccuugucgaaaauuggcugaacaauaacacacaguuuugcaucaaggugcugaauccguauaugcccagcgugaucgagaaaauggaagcccuccagagacaguacgggggagcgcugguccgcaacccucuuuccagaaauucuacccacgagauguacuggguuagcaacgccacgggcaauauuguguccucugugaacaugaucagcagaaugcugauuaaucgcuucaccaugaagcacaaaaaggcuacauaugagcccgacgucgaucucggguccggaacccggaacaucggcauugaaagcgagaucccuaaccuggacauuaucggcaaaagaaucgaaaagauuaagcaagagcaugaaaucucuuggcacuacgaccaggaucaucccuauaaaacaugggccuaccacggguccuaugagaccaagcagacaggaagcgcuucuuccauggugaauggcguugugcgccugcucaccaaaccgugggacgucgugccuaugguuacgcagauggccaugacagauaccacccccuuugggcaacagcggguguucaaggagaaagucgacacaagaacgcaggaaccuaaggagggaaccaagaaacuuaugaagauuacagcugaauggcuguggaaagagcugggcaagaaaaagacccccagaauguguacaagagaggaauuuaccaaaaaggugcgggggaacgccgcgcucggagccaucuucacagaugagaauaaguggaaaagcgcucgcgaagccguggaggacggcagauuuugggaacuggucgaucgggagagaaaccuucaccuggagggcaagugcgaaaccuguguuuacaauaugauggggaaacgggagaagaaacucggagaguucggcaaggcuaaggggucucgcgccauuugguauauguggcugggagccagauuucuggaguucgaagcgcucggcuuucugaacgaggaccauugguucucccgggggaauagccuuuccggcguggagggagaaggccugcaccgccucggguacauccugagagaugugggcaagaaggagggcggggcuauguacgccgacgauacggccggaugggacacccggaucacacuugaagaccugaaaaacgaggaaauggucaccaaucauaugaagggcgagcacaaaaagcucgcugaggccauuuuuaagcugacauaucagaacaaagugguucgcgugcaaagaccuacaccccgggggacggucauggauaucauuagccgcagagaccagcggggcucuggacaggugggcacauacgggcugaauaccuucacaaacauggaagcucaacucauccgccagauggagggagaaggcauuuucaagagcauccagcaucugaccgccacggaggagaucgcgguucagaauuggcuugccagaguggggcgggaacgccuguccagaauggcuauuucuggagaugacugcgucgugaaaccgaucgaugaccgguuugccagcgcucucaccgcccugaacgauaugggcaagguuagaaaagacauucaacagugggagccuucccgcggguggaaugauuggacacaggugcccuucugcucucaccacuuucaugaacuugucaugaaggacggccgggugcuggucgugcccuguagaaaccaggaugagcucaucggacgcgcgcggauuagccaaggcgccggguggucccugaaggaaaccgcuugccugggaaaaucuuaugcccagauguggacacucauguacuuccacagacgcgaccugcggcuugcugccaacgcuaucuguagcgccguuccuucccauugggugccgaccagcagaacaaccuggucuauucacgcgaagcacgaguggaugacgacagaggauaugcuggccgucuggaaucgcguguggauccaggaaaaccccuggauggaggacaaaaccccuguggaauccugggaggaaguucccuaucucggcaagcgggaggaccaguggugcgggagccugaucggacuuaccucuagagcuacaugggccaaaaauauucaaaccgccaucaaccaggugcgcucccugauuggcaaugaggaauacacagauuauaugccuagcaugaagcgguuuagacgggaggaagaggaagcugggguccucugguga

SEQ ID NO: 19775 - RNA, 9876 nt, Artificial Sequence
  derived and/or modified CDS sequence (opt5) from DENV-2__FJ744707__SS-prME
accgccggcgugaucgucaugcugauucccaccgcuauggccuuccaccucacgacccggaauggggaaccucauaugaucguuggacggcaggaaaagggcaagagccugcuuuuuaagaccgaagacggggugaauaugugcacccugauggcgauugaucucggagaacugugugaggacacgaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggaucccuuuccccaguccaacgcuccuaucauggacgaagaaagagaaauccccgagagaagcuggaacucuggccacgaaugggugacagauuucaaggggaaaaccgucugguuugugccuuccauuaaggccggaaacgacaucgccgcuugccugcggaaaaauggcaagaaaguuauucagcuuagcagaaagaccuucgauucugaguacgugaagacacgcgccaacgacugggauuuugucgugaccacagacaucagcgagaugggggcgaauuucaaagcugaacgggugauugauccgagacgcuguaugaagcccgucauccugaccgacggagaggaacggguuauccuggccggcccuaugcccgugacgcauuccucugccgcucaaagacgcgggcggauuggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccccgguggcuggacgccagaaucuauuccgauccucuggcgcucaaggaguucaaggaguucgccgcugggcgcaaaucucugacccuuaaucugauuacggaaaugggccggcuccccaccuuuaugacacagaaggccagaaacgcucuggacaaucuggccguccuccauaccgccgaggcuggaggccgcgcguacaaccacgcccuuagcgagcugccggaaacacuggagacccuccugcuucugacacuccuggcuaccgugacagggggaaucuuccuguuucucauguccggcaaagggauuggaaagaugacacuuggcaugugcugcaucaucaccgccagcauucugcugugguaugcccaaauccagccucacuggauugcugccucuaucauucucgaguucuuucugaucguucuucugauccccgagcccgaaaaacagcggaccccucaggauaaucaacucacauacguggucauugcgauccugaccguggucgccgcuacaauggccaacgagaugggcuuccuggagaagacgaagaaagaccucgggcuuggauccauuaccacacaggaaagcgaguccaauauccuggacauugaucugagaccggcuucugccuggacccucuaugcgguggccacaaccuuuguuacgcccaugcugcggcauagcaucgaaaacuccucugugaaugugagccuuaccgcuauugccaaccaggcuacaguccugaugggccucgggaagggauggccucuguccaaaauggacaucggcguuccccugcucgccaucggguguuacagccaggugaauccuauuacccuuacagcugcccugcugcuccugguggcgcacuacgccaucauuggacccggccuucaagcuaaggccacccgcgaggcucagaaaagagccgccgcgggcaucaugaagaacccuacggucgaugggauuacagugaucgaccuggaaccgauccccuaugauccuaaguucgagaaacagcucggacagguuaugcugcugauucucugcgugacccaaguccuuaugaugcggacaaccugggcucugugugaggcccugacccucgcuacaggccccaucucuacgcugugggaagggaauccuggacgcuuuuggaacaccacaauugccguguccauggccaauaucuucagaggcagcuaccuugcuggggccggacugcucuuuucuauuaugaagaacaccacauccacccggcgcggcacgggcaauaucggggagacacugggagaaaaauggaaaagcagacugaacgcgcucggcaaaucugaguuccagaucuauaagaaaagcgggauucaggaggucgaccggacccuugccaaggaaggaaucaagcgcggcgagaccgaucaucacgcuguguccagagggucugccaaacugcggugguuuguugaaagaaacauggugacacccgagggaaaggucguggaccugggcugcggccgcgggggauggagcuacuauuguggcgggcucaaaaauguucgggaagugaagggacugaccaaaggcgggccgggacaugaggagccuauucccauguccacauacggcuggaaccuugucagacugcaaagcggcguggauguguucuucacgcccccugaaaagugcgacacccuccugugugauaucggggaguccucucccaauccuacaauugaagcuggacgcacccugcggguucucaaccuugucgagaauuggcugaacaauaacacacaguuuugcaucaaggugcugaauccguauaugcccagcgugaucgagaagauggaggcccuccagagacaguacggcggggcgcugguccgcaacccucuuuccagaaauucuacccacgagauguacuggguuagcaacgccacgggaaauauuguguccucugugaacaugaucagcagaaugcugauuaaucgcuucaccaugaagcacaaaaaggcuacauaugaacccgacgucgaucucggcuccgggacccggaacaucggaauugagagcgaaaucccuaaccuggacauuaucggcaaaagaaucgagaagauuaagcaagaacaugagaucucuuggcacuacgaccaggaucaucccuauaaaacaugggccuaccacggcuccuaugagaccaagcagacagggagcgcuucuuccauggugaauggaguugugcgccugcucaccaaaccgugggacgucgugccuaugguuacgcagauggccaugacagauaccacccccuuuggccaacagcggguguucaaggaaaaagucgacacaagaacgcaggagccuaaggaagggaccaagaaacuuaugaagauuacagcugaguggcuguggaaagagcugggaaagaaaaagacaccccgcauguguacaagagaagaguuuaccaaaaaggugcggagcaacgccgcgcucggcgccaucuucacagaugaaaauaaguggaaaucugcucgcgaggccguggaagacgggagauuuugggagcuggucgaucgggagagaaaccuucaccuggaaggaaagugcgagaccuguguuuacaauaugaugggcaaacgggaaaagaaacucggcgaguucgggaaggcuaagggaucccgcgccauuugguauauguggcugggcgccagauuucuggaguucgaggcgcucggguuucugaacgaggaccauugguucagccggggaaauucccuuagcggcguggaaggggagggccugcaccgccucggauacauccugagagaugugggcaaaaaggaagggggagcuauguacgccgacgauacggccggcugggacacccggaucacacuugaggaccugaaaaacgaagagauggucaccaaucauaugaagggggagcacaaaaagcucgcugaagccauuuuuaagcugacauaucagaacaaagugguucgcgugcaaagaccuacaccccggggaacggucauggauaucauuucucgcagagaccagcggggcagcggacaggugggcacauacggacugaauaccuucacaaacauggaggcucaacucauccgccagauggaaggcgaggggauuuucaaguccauccagcaucugaccgccacggaggaaaucgcgguucagaauuggcuugccagagugggacgggagcgccugucuagaauggcuauuagcggcgaugacugcgucgugaaaccgaucgaugaccgguuugccuccgcucucaccgcccugaacgauauggggaagguuagaaaagacauucaacagugggaaccuucucgcggauggaaugauuggacacaggugcccuucugcagccaccacuuucaugagcuugucaugaaggacggccgggugcuggucgcgcccuguagaaaccaggaugaacucaucgggcgcgcccggauuucccaaggcgcuggauggucucugaaggagaccgccugccugggcaaaagcuaugcucagauguggacacucauguacuuccacagacgcgaccugcggcuugccgcuaacgccaucuguuccgcggugccuagccauuggguuccgaccucuagaacaaccugguccauucacgccaagcacgaguggaugacgacagaagauaugcuggcuguguggaaucgcgucuggauccaggagaaccccuggauggaagacaaaaccccuguggagagcugggaagaggugcccuaucucgggaagcgggaggaccaguggugcggaucucugaucggccuuaccuccagagccacaugggccaaaaauauucaaaccgcuaucaaccagguucgcagccugauugggaaugaagaguacacagauuauaugccuuccaugaagcgguuuagacgggaagaggaagaggccggagugcucugguga

SEQ ID NO: 19776 - RNA, 9876 nt, Artificial Sequence
  derived and/or modified CDS sequence (opt5) from DENV-2__FJ744704__SS-prME
accgccggcgugaucgucaugcugauucccacggcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauguuuaaaaccaacacaggaaccauuggcgcugugucccuggauuucagcccugggacaucuggaucccccaucgucgaccgcaagggcaaagugguggggcucuacggaaauggcguugucacccggagcggcgccuaugugucugcgauugcucagacagagaaguccaucgaagauaacccugagaucgaagacgauauuuuuagaaagaaacgccugacgaucauggaccuucaucccggggccggaaagaccaaacgguaccugccugccauugugagagaggcuaucaagcgcggccugcggacacucauucuggccccgaccagagucguggcugccgaaauggaggaggcgcuucgcgggcugcccauccgguaucaaaccccugccauuaaaacagaacacacgggaagagagaucguugaccucaugugucaugcuaccuucacaaugcggcugcucagccccgugcgcgucccuaacuacaaucugaucauuauggaugaagcccacuucaccgaccccgcuuccaucgccgccagaggcuauauuucuacacggguggagaugggggaggcugcgggcaucuuuaugaccgccacgccgccuggaagccgcgaucccuucccccaguccaacgcuccuauuauggacgaagagagagaaauccccgagcggagcuggaacucuggccacgaauggguuacagauuuuaaggggaagaccgugugguucgucccuuccaucaaagccggaaacgacauugccgcuugccuuagaaagaauggcaaaaaggugauccagcugagccgcaaaaccuuugauucugaguacguuaagacacgggccaacgacugggauuucguggucaccacagacauuagcgagaugggggcgaauuuuaaggcugaaagagugaucgauccgcgccgguguaugaaacccgugauucugaccgacggagaggaaagagucauccucgccggcccuaugcccguuacgcauuccucugccgcucaacgccgggggagaaucggccgcaacccuaagaaugagaacgaccaguauauuuacaugggagaaccccuggagaaugaugaggacugcgcccacuggaaagaagcgaagaugcuucuggauaacaucaauacaccggagggcauuaucccuagcauguucgaacccgagagagaaaaaguggacgccauugauggggaguaccggcuccgcggagaggcuagaaagaccuuuguggaccugaugcggcgcggcgaucugccugucuggcucgccuauaaaguggcugccgaagggaucaacuacgcugacagaaagugguguuucgauggaauuaagaauaaccagauccuugaggaaaacauggagguugagaucuggacaaaagaaggcgagcggaagaaacugaagcccagauggcuggacgcccgcauuuauuccgauccucucgcgcugaaagaauuuaaggaguucgccgcugggcggaagucucuuacccugaaucucaucacggaaaugggcagacugcccaccuucaugacacagaaagcccgcaacgcucuggacaaucucgccgugcuucauaccgccgaggcuggaggccgggcguacaaccacgcccugagcgagcugccggaaacacucgagacccugcuucugcucacacugcuggcuaccgucacagggggaauuuuucucuuccuuauguccggcaaggggaucggaaaaaugacacugggcaugugcugcauuaucaccgccagcauccugcucugguaugcccaaauucagccucacuggaucgcugccucuauuauccuggaauuuuuccuuauugugcugcucauccccgagcccgaaaagcagagaaccccucaggauaaucaacugacauacguugugaucgcgauucugaccgucguggccgcuacaauggccaacgagaugggcuuucucgagaaaacgaagaaggaccuugggcugggauccaucaccacacaggaaagcgaguccaauauucuggacaucgaucuccggccggcuucugccuggacccuguaugcggucgccacaaccuucgugacgcccaugcuucgccauagcauugaaaacuccucuguuaaugugagccugaccgcuaucgccaaccaggcuacagugcucaugggccuggggaaaggauggccucuguccaagauggacauuggcgucccccuccuugccaucggguguuacagccagguuaauccuaucacccugacagcugcccugcuccugcuuguggcgcacuacgccauuaucggacccggccugcaagcuaaagccaccagagaggcucagaagcgggccgccgcgggcauuaugaaaaacccuacgguggaugggaucacagucauugaccucgaaccgauccccuaugauccuaaguuugagaagcagcugggacaggugaugcugcucauccuuugcguuacccaagugcugaugaugcgcacaaccugggcucugugugaggcccucacccuggcuacaggccccauuucuacgcuuugggaagggaauccuggaagauucuggaacaccacaaucgccgucuccauggccaauauuuuucggggcagcuaccuggcuggggccggacuccuguucucuaucaugaaaaacaccacaaauacccgcagaggcacgggcaacauuggggagacacugggagaaaaguggaaaucccggcucaacgcgcuuggcaagagcgaguuucagaucuauaaaaagucugggauccaggagguggaccgcacccuggccaaagaaggaauuaagagaggcgagaccgaucaucacgcugucagccggggguccgccaagcugagaugguucguggaacgcaauaugguuacacccgagggaaaaguggucgaccucggcugcggcagagggggauggucuuacuauuguggcgggcugaagaacgugcgggaaguuaaaggacuuaccaagggcgggccgggacaugaggagccuauccccaugagcacauacggcuggaaucuggugcgccuccaauccggcgucgauguguuuuucacgcccccugaaaaaugcgacacccugcugugugauauuggggagagcucccccaacccuacaaucgaagcuggacggacccucagagugcuuaaucugguugagaacuggcugaauaacaauacacaguucugcauuaagguccucaacccguauaugcccucugugaucgaaaagauggaggcccugcagcgcaaauacggcggggcgcuugugcggaauccucugagcagaaacuccacccacgagauguacugggucucuaaugccacgggaaacaucguuagcuccgugaauaugauuucucgcaugcucaucaaccgguuuaccaugaagcacaaaaaggcuacauaugaacccgacguggaucugggcagcgggaccagaaacauuggaaucgaguccgaaauuccuaaucuggacaucauuggcaaacgcaucgagaagaucaagcaggaacaugagacaagcuggcacuacgaccaagaucaucccuauaaaaccugggccuaccacggcucuuaugagacaaagcagaccggguccgcuagcucuauggucaacggagugguucggcuccuuacgaaaccgugggacguggucccuauggugacacagauggccaugaccgauaccacacccuucggccagcaaagaguuuuuaaggaaaaaguggacacgcgcacccaggagccuaaggaagggacaaagaaacugaugaagauuaccgcugaguggcuguggaaagagcucggaaagaaaaagacacccagaaucuguacccgggaagaguucacacgcaaagucagauccaaugccgcgcugggcgccauuuuuaccgaugaaaacaaguggaaaagcgcucgggaggccguggaagacgggagauucugggagcuuguggaucgggagcgcaaucugcaccucgaaggaaaaugcgagacgugugucuacaacaugaugggcaagagagagaagaagcugggcgaguuugggaaagcuaagggaucucgggccaucugguauauguggcugggcgcccgcuuccucgaauuugaggcgcugggguuccuuaaugaggaccauugguuuuccagagaaaacagccuguccggaguugagggcgaagggcuccaccggcugggcuacauucuucgcgaugugggaaagaaagagggcggggcuauguacgccgacgauaccgccggaugggacacaagaaucacccuggaagaccucaagaaugaggagauggugacaaaccauaugaaaggcgaacacaagaaacuggcugaggccaucuucaagcugaccuaucagaauaaggucgugcggguucagcgcccuacgcccagagggacagugauggauauuaucagccggcgcgaccaaagaggaucuggccaggucgggaccuacggccucaacacauuuaccaauauggaagcucagcugauucggcaaauggagggagagggcaucuucaaaagcauucagcaucuuacggccaccgaagagaucgcggugcagaacuggcuggcccgcguugggagagaacggcucuccagaauggcuaucucuggagaugacugcguggucaagccgauugaugaccgcuucgccagcgcucugacagcccuuaaugauaugggcaaagugcggaaggacauccagcaaugggagccuuccagaggguggaacgauuggacccagguucccuuuugcucucaccacuuccaugaacuggugaugaaagacggacgcguccucgugguccccugucggaaccaggaugagcugauuggcagagcgcgcaucagccagggggccggcuggucccugaaggagacagcuugccucggaaagucuuaugcccaaauguggacccugauguacuuucaccggagagaccuucgccuggcugccaaugcuauuuguagcgccgugccuccgcauuggguucccacaucccggaccacguggagcauccacgcgaaacacgaauggaugacaaccgaggauaugcucgccguguggaacagagucuggauucaggaaaauccuuggauggaggacaagacccccguggaaucuugggaggaggugccuuaucugggcaaacgcgaagaccaguggugcgggucccuuaucggacugacaagccgggcuaccugggccaagaacauccagacagccauuaaucaaguuagaucucucaucggcaacgaggaauacacggauuauaugcccuccaugaaacgguucagacgcgaggaagaggaggcuggggugcugugguga

SEQ ID NO: 19777 - RNA, 9876 nt, Artificial Sequence
  derived and/or modified CDS sequence (opt5) from DENV-2__FJ744745__SS-prME
acagccggagugaucgucaugcugauucccacggcuauggccuuccaccucacgaccagaaauggggagccucauaugaucguuggacggcaggaaaagggaaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugaagauggauaaacuucaacugaaggggaugucuuacagcauguguaccggaaaguucaaaaucgucaaggaaauugcggagacacagcacggcacgaucgugauccggguccaguaugagggggacggaucccccugcaaaauucccuucgaaaucaccgaucucgagaagagacaugugcugggccgccugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugcggggagcuaagagaauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgcuccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaauccggagcgucacaagacuugagaaucugauguggaagcagaucaccccggagcucaaccacauucuguccgaaaaugaggugaaacugacaaucaugaccggcgacauucgcgggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaaggugcgcccuacauuugccgcgggccuucugcucagaaaacugaccucuaaggagcucaugauggcuacaauugggaucgcccugcuuagccaguccaccauucccgaaaccauccuggagcucacagaugcccuggcucugggaaugaugguccuuaaaaucgugcggaacauggaaaaguaccaacuggccguuacgauuauggcgaucucuugcgugccuaaugcugucauucuccagaacgccuggaaggugagcuguaccauccuggccgcuguguccgucagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcgauuauggccguugggauggugagcauccucgcuucuucccugcucaaaaaugacauuccuaugaccggaccccugguggccggcggccuucugaccgucugcuaugugcugacagggcggagcgcugaucucgaacuggagcgcgccgccgacguuaagugggaggaucaagcugaaaucuccggaagcucuccuauucuuagcaucaccauuuccgaggacggcucuaugagcaucaaaaacgaagaggaggaacagacacugacgauccucauuagaaccgggcugcucgugaucuccggagucuuucccgugucuauuccgaucacagcggccgcuugguaccugugggagguuaagaagcagcgggccggcgugcuuugggaugucccuucucccccucccguggaaaaagccgagcuggaagacggggcuuaucgcauuaagcagagaggaauccugggcuacucccaaaucggcgccggggucuauaaagagggaaccuuccacacaauguggcaugugacccggggcgcgguucucaugcaccgcgggaagagaauugagcccuccugggcugaugugaaaaaggaccugaucagcuacggaggcggguggaaacuugaaggagaguggaaagaaggcgaggaaguccaggugcuggcccucgagccuggcaagaauccgcgggccguucagacgaaacccgggauuuuuaagaccaacacaggaaccaucggcgcugugucccuggauuucagcccugggacaucuggaucccccauugucgacagaaaaggcaaggugguggggcucuacggaaauggcguugucacccgcagcggcgccuaugugucugcgaucgcucagacagagaaguccaucgaagauaacccugagauugaagacgauaucuuucggaaaaagagacugacgauuauggaccuucaucccggggccggaaaaaccaagcgcuaccugccugccaucgugcgggaggcuauuaaaagaggccugcgcacacucauccuggccccgacccgggucguggcugccgaaauggaggaggcgcuuagagggcugcccauucgcuaucaaaccccugccaucaagacagaacacacgggacgggagaucguugaccucaugugucaugcuaccuucacaaugagacugcucagccccgugcgggucccuaacuacaaucugauuaucauggaugaagcccacuucaccgaccccgcuuccauugccgcccgcggcuauaucucuacaagaguggagaugggggaggcugcgggcauuuuuaugaccgccacgccgccuggaagccgggaucccuucccccaguccaacgcuccuaucauggacgaagagagagaaauccccgagagaagcuggaacucuggccacgaauggguuacagauuuuaaggggaaaaccgugugguucgucccuuccauuaaggccggaaacgacaucgccgcuugccuucggaaaaauggcaagaaagugauucagcugagcagaaagaccuuugauucugaguacguuaagacacgcgccaacgacugggauuucguggucaccacagacaucagcgagaugggggcgaauuuuaaagcugaacgggugauugauccgagacgcuguaugaagcccgugauccugaccgacggagaggaacgggucauccucgccggcccuaugcccguuacgcauuccucugccgcucaaagacgcgggcggauuggcagaaacccuaaaaaugagaacgaccaguauaucuacaugggagaaccccuggagaaugaugaggacugcgcccacuggaaggaagcgaaaaugcuucuggauaacauuaauacaccggagggcaucauuccuagcauguucgaacccgagcgcgaaaagguggacgccaucgauggggaguacagacuccggggagaggcucgcaaaaccuuuguggaccugaugagacggggcgaucugccugucuggcucgccuauaagguggcugccgaagggauuaacuacgcugaccgcaagugguguuucgauggaaucaaaaauaaccagauccuugaggaaaacauggagguugagauuuggacaaaggaaggcgagcgcaagaagcugaaaccccgguggcuggacgccagaaucuauuccgauccucucgcgcugaaggaauuuaaggaguucgccgcugggcgcaaaucucuuacccugaaucucauuacggaaaugggccggcugcccaccuucaugacacagaaggccagaaacgcucuggacaaucucgccgugcuucauaccgccgaggcuggaggccgcgcguacaaccacgcccugagcgagcugccggaaacacucgagacccugcuucugcucacacugcuggcuaccgucacagggggaaucuuucucuuccuuauguccggcaaagggauuggaaagaugacacugggcaugugcugcaucaucaccgccagcacccugcucugguaugcccaaauucagccucacuggaucgcugccucuauuauccuggaauuuuuccuuauugugcugcucauccccgagcccgaaaaacagcggacaccucaggauaaucaacugaccuacguugugaucgcgauucugacagucguggccgcuacgauggccaacgagaugggcuuucucgagaagaccaagaaagaccuugggcugggauccaucacaacccaggaaagcgaguccaauauucuggacaucgaucucagaccggcuucugccuggacacuguaugcggucgccaccacguucgugacccccaugcuucggcauagcauugaaaacuccucuguuaaugugagccugacagcuaucgccaaccaggcuaccgugcucaugggccuggggaagggauggccucuguccaaaauggacauuggcgucccccuccuugccaucggguguuacagccagguuaauccuaucacacugaccgcugcccugcuccugcuuguggcgcacuacgccauuaucggacccggccugcaagcuaaggccacgcgcgaggcucagaaaagagccgccgcgggcauuaugaagaacccuacaguggaugggaucaccgucauugaccucgaaccgauccccuaugauccuaaguuugagaaacagcugggacaggugaugcugcucauccuuugcguuacacaagugcugaugaugcggaccaccugggcucugugugaggcccucacacuggcuacgggccccauuucuacccuuugggaagggaauccuggacgcuucuggaacacaaccaucgccgucuccauggccaauauuuuuagaggcagcuaccuggcuggggccggacuccuguucucuaucaugaagaacacaaccaauacgcggcgcggcacaggcaacauuggggagacccugggagaaaaauggaaguccagacucaacgcgcuuggcaaaagcgaguuucagaucuauaagaaaucugggauccaggagguggaccggacccuggccaaggaaggaauuaagcgcggcgagacagaucaucacgcugucagcagaggguccgccaaacugcggugguucguggaaagaaauaugguuacccccgagggaaagguggucgaccucggcugcggccgcgggggauggucuuacuauuguggcgggcugaaaaacgugcgggaaguuaagggacuuacaaaaggcgggccgggacaugaggagccuauccccaugagcacguacggcuggaaucuggugagacuccaauccggcgucgauguguuuuucacacccccugaaaagugcgacacccugcugugugauauuggggagagcucccccaacccuaccaucgaagcuggacgcacacuccgggugcuuaaucugguugagaacuggcugaauaacaauacccaguucugcauuaagguccucaacccguauaugcccucugugaucgagaagauggaggcccugcagagaaaguacggcggggcgcuugugcgcaauccucugagccggaacuccacgcacgagauguacugggucucuaaugccagcggaaacaucguuuccucugugaauaugauuagcagaaugcucaucaaccgcuuuaccaugaaacacaagaaagcuacauaugaacccgacguggaucugggcuccgggacccggaacauuggaaucgagagcgaaauuccuaaucuggacaucauuggcaagagaaucgagaagaucaaacaggaacaugagacaucuuggcacuacgaccaagaucaucccuauaagaccugggccuaccacggcuccuaugagacaaaacagaccgggagcgcuucuuccauggucaacggagugguucgccuccuuacgaagccgugggacguggucccuauggugacacagauggccaugaccgauaccacacccuucggccagcaacggguuuuuaaagaaaagguggacacgagaacccaggagccuaaggaagggaccaaaaagcugaugaaaauuaccgcugaguggcuguggaaggagcucggcaaaaagaaaacaccccgcauguguaccagagaagaguucacacggaagguccgcagcaaugccgcgcugggcgccaucuuuaccgaugaaaacaaguggaaaucugcuagagaggccguggaagacucccgguucugggagcuuguggauagagagcggaaucugcaccucgaagggaagugcgagacgugugucuacaacaugaugggaaaacgcgaaaagaaacugggcgaguuuggcaaggcuaaggggagcagagccauuugguauauguggcugggagcccgguuccucgaauuugaggcgcugggcuuccuuaaugaggaccauugguuuucccgcgggaacagccugucuggaguugaaggcgaggggcuccacagacugggcuacauccuucgggaugugggcaaaaaggaaggcggggcuauguacgccgacgauaccgccggaugggacacacgcauuacccuggaggaccucaaaaaugaagagauggugacaaaccauaugaagggcgagcacaaaaagcuggcugaagccaucuucaagcugaccuaucagaauaaagucgugagaguucagcggccuacgccccgcgggacagugauggauaucauuagcagacgggaccaacgcggauccggccaggucgggaccuacggccucaacacauuuaccaauauggaggcucagcugaucagacaaauggaaggagagggcauuuucaagucuauccagcaucuuacggccaccgaggaaauugcggugcagaacuggcuggcccggguugggcgcgagagacucagccggauggcuaucuccggagaugacugcguggucaaaccgaucgaugacagauucgccucugcucugacagcccuuaaugauaugggcaaggugcgcaaagacauucagcaaugggaaccuagccggggguggaacgauuggacccagguucccuuuugcucccaccacuuccaugagcuggugaugaaggacggaagaguccucgugguccccugucgcaaccaggaugaacugaucggccgggcgagaauuucucagggggccggcuggagccugaaggagacagcuugccucggaaaauccuaugcccaaauguggacccugauguacuuucaccgccgggaccuuagacuggcugccaaugcuaucuguagcgccgugccuccgcauuggguucccacaucucgcaccacgugguccauucacgcgaagcacgaguggaugacaaccgaagauaugcucgccguguggaaccgggucuggauccaggagaauccuuggauggaagacaaaacccccguggagagcugggaagaggugccuuaucugggcaagagagaggaccaguggugcgggucucuuauuggacugacaucccgcgcuaccugggccaaaaacauccagacagccaucaaucaaguucggagccucauuggcaacgaagaguacacggauuauaugcccuccaugaagagauuccggagagaagaggaagaggcuggggugcugugguga

SEQ ID NO: 19778 - RNA, 9876 nt, Artificial Sequence
  derived and/or modified CDS sequence (opt5) from DENV-2__FJ744705__SS-prME
accgccggagugaucgucaugcugauucccacagcuauggccuuccaccugacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacgauucccccugcaagauucccuucgaaaucaccgaccucgagaaacgccaugugcugggacggcugauuacaguuaacccuaucgugaccgaaaaggauagcccggucaacauugaggccgaacccccuuuuggcgacucuuacaucauuaucgggguggagcccggccagcucaaacugaauugguucaagaagggauccagcaucggccaaauguuugagacaaccaugagaggggcuaaacgcauggccauucuuggagauacggccugggacuucggcucucucgggggaguuuuuacaagcaucggcaaggcucuccaccagguguucggggccauuuacggcgcggcuuuuuccggagucucuuggaccaugaaaauccugauuggcgugaucaucaccuggauugggaugaacagccgguccacaagccugucugugucccuuguucucgucggaguggugacccuguaucugggcgccaugguccaggccgauagcggguguaucgugucuuggaagaauaaagaacucaagugcggauccggcauuuucaucacagacaacguucacacguggaccgagcaguacaaguuucaaccugaaagccccuccaaacuggcuucugccauucagaaggcucaugaggaagggaucuguggcaucagaagcgugacacgccuugagaaucugauguggaaacagauuaccccggagcucaaccacauccuguccgaaaaugaggucaagcugacaauuaugaccggagauauccggggcauuaugcaggccgggaaaagaucucuucgcccucaacccacggaacucaaguauagcuggaaaaccuggggaaaggcgaagaugcuguccacagagagccauaaccagaccuuccugaucgacggcccugaaacaguggagugccccaauaccaaccgggccuggaacucucucgagguugaagacuacggguuuggaguguucacaaccaacaucuggcugaaacuuagagagaagcaggaugucuuuugugacuccaaacugaugagcgcugccauuaaggauaaucgcgcugugcacgccgacaugggcuauuggaucgaaucugcgcucaacgauacguggaaaauggagaaggccuccuucauugagguuaagagcugccacuggccuaaaucucauacacuguggagcaauggcgugcuggaauccgagaugaucauucccaagaacuucgcugggccggucagccagcacaacuaccggccuggauaucauacccaaaccgccggccccuggcaccuugggaaacucgaaauggacuuugaucugugugagggaacaaccgugguggucacggaagacugcggcaauagagggcccucucugcggacaaccacagcuuccggaaagcucaucaccgaguggugcugucgcagcugcacacugccuccgcuuagauaccggggcgaggauggcuguugguacgggauggaaauuagaccccugaaagagaaggaagagaaccucguuaauucccuggugaccgccggacauggccagaucgacaacuucucucugggggugcuuggaauggcccucuuucuggaagagaugcugcgcacgcggaucggcaccaagcacgcuauucuccuggucgcggugagcuucguuacacuuaucaccgggaauauguccuuuagagaucugggacgcgugauggucauggugggcgccacaaugaccgacgauauuggcauggggguuacguaucucgcucugcuggccgccuucaaagugagaccuacauuugcugccggacuucugcuccggaagcugaccucuaaagagcucaugauggcgacaaucggcauugcucugcuuagccaguccaccauccccgaaaccauccuggagcucacagacgcccuggcccuggggaugaugguccuuaagauugugcgcaacauggaaaaauaccaacuggcuguuacgaucauggccauuucuugcgugccuaaugcggucauccuccagaacgcuuggaaggugagcuguaccauucuggccgccguguccgucagcccccuccugcuuacaucuucccagcagaaggcugacuggaucccucuggcccucaccaucaaaggacugaaucccacagcuauuuuccugaccacgcuuagcagaacaucuaagaaacgguccuggccgcugaacgaggccaucauggcgguuggcauggugagcauucucgccucuucccugcucaagaaugauaucccuaugaccgggccccugguggcuggaggccuucugaccgucugcuaugugcugacaggccgcagcgccgaccucgaacuggagagagcugccgauguuaaaugggaggaccaagccgaaauuuccgggagcucuccuauccuuagcauuaccaucuccgaggauggaucuaugagcaucaagaacgaagaggaggaacagacacugacgauucucauccggaccggccugcucgugauuuccggggucuuucccgugucuaucccgauuacagcugcggccugguaccugugggagguuaaaaagcagcgcgcuggagugcuuugggacgucccuucucccccucccguggaaaaggccgagcuggaagauggcgccuauagaaucaaacagcgggggauccugggauacucccaaauuggcgcuggcgucuauaaggaggggaccuuccacacaauguggcaugugacccgcggagccguucucaugcacagaggcaaacggaucgagcccuccugggcggacgugaagaaagaucugauuagcuacgggggaggcuggaaacuugaaggggaguggaaggaaggagaggaaguccaggugcuggcucucgagccuggcaaaaauccgagagccguucagacgaagcccggcaucuuuaaaaccaacacagggaccauuggagccgugucccuggacuucagcccuggcacaucugggucccccaucgucgaucgcaagggaaaaguggugggccucuacgggaauggaguugucacccggagcggcgcuuaugugucugccaucgcgcagacagagaaguccauugaagacaacccugagaucgaagaugacauuuuuagaaagaaacgccugacgaucauggaccuucaucccggcgcugggaagaccaaacgguaccugccugccauugugagagaggccaucaagcgcggacugcggacacucauucuggcuccgaccagagucguggccgcugaaauggaggaggcccuucgcggccugcccauccgguaucaaaccccugcgaucaaaacagaacacacggggagagagauuguugaucucaugugucaugccaccuucacaaugcggcugcucagccccgugcgcgucccuaacuacaaucugaucauuauggacgaagcucacuucaccgaucccgccuccaucgcugccagaggauauauuucuacacggguggagaugggcgaggccgcugggaucuuuaugaccgcgacgccgccuggcagccgcgaccccuucccccaguccaacgccccuaucauggaugaagagagagaaauucccgagcggagcuggaacucuggacacgaauggguuacagacuuuaagggcaagaccgugugguucgucccuuccaucaaagcugggaacgauauugccgccugccuuagaaagaauggcaagaaggugauccagcugagccgcaaaaccuuugacucugaguacguuaagacacgggcuaacgauugggacuucguggucaccacagauauuagcgagaugggcgccaauuuuaaggcggaaagagugaucgacccgcgccgguguaugaaacccgugauccugaccgacggggaggaaagagucauucucgcuggaccuaugcccguuacgcauuccucugccgcccaacgccggggcagaaucgggcgcaacccuaagaaugagaacgaucaguauauuuacaugggcgaaccccuggagaaugacgaggauugcgcucacuggaaagaagccaagaugcuucuggacaacaucaauacaccggagggaauuaucccuagcauguucgaacccgagagagaaaaaguggaugcgauugacggcgaguaccggcuccgcggggaggccagaaagaccuuuguggaucugaugcggcgcggagaccugccugucuggcucgcuuauaaaguggccgcugaaggcaucaacuacgccgauagaaagugguguuucgacgggaucaagaauaaccagauucuugaggaaaacauggagguugagaucuggacaaaagaaggagagcggaagaaacugaagcccagauggcuggaugcucgcauuuauuccgacccucucgcccugaaagaauuuaaggaguucgcggccggccggaagucucuuacccugaaucucaucacggaaauggggagacugcccaccuucaugacacagaaagcucgcaacgcccuggauaaucucgcugugcuucauaccgccgaggccggcggacgggcuuacaaccacgcgcugagcgagcugccggaaacacucgagacccugcuucugcucacacugcuggccaccgucacgggcgggauuuuucucuuccuuauguccggaaagggcaucgggaaaaugacacugggaaugugcugcaucauuaccgcuagcauccugcucugguaugcccaaauucagccucacuggaucgccgcuucuauuauccuggaauuuuuccuuaucgugcugcucauucccgagcccgaaaagcagagaaccccucaggacaaucaacugacauacguugugaucgccauucugaccgucguggcggccacaauggcuaacgagaugggcuuucucgagaaaacgaagaaggaccuuggccugggguccaucaccacacaggaaagcgaguccaauauucuggauaucgaccuccggccggccucugcuuggacccuguaugccgucgcgacaaccuucgugacgcccaugcuucgccauagcauugaaaacuccucuguuaaugugagccugaccgccaucgcuaaccaggccacagugcucaugggacugggcaaaggguggccucuguccaagauggauaucggagucccccuccuugcuauuggcuguuacagccagguuaauccuaucacccugacagccgcucugcuccugcuuguggcccacuacgcgauuaucgggcccggacugcaagccaaagcuaccagagaggcccagaagcgggcugccgccggcauuaugaaaaacccuacgguggacggcaucacagucaucgaucucgaaccgauucccuaugacccuaaguuugagaagcagcugggacaggugaugcugcucauccuuugcguuacccaagugcugaugaugcgcacaaccugggcgcugugugaggcucucacccuggccacaggacccauuucuacgcuuugggaaggcaauccugggagauucuggaacaccacaaucgcugucuccauggccaauauuuuucggggaagcuaccuggccggcgcugggcuccuguucucuaucaugaaaaacaccacaaauacccgcagaggaacgggcaacaucggcgagacacugggggaaaaguggaaaucccggcucaacgcccuuggaaagagcgaguuucagauuuauaaaaagucuggcauccaggagguggaucgcacccuggcgaaagaagggauuaagagaggagagaccgaccaucacgccgucagccggggcuccgcuaagcugagaugguucguggaacgcaauaugguuacacccgaggggaaaguggucgaucucggaugcggccggggcggguggucuuacuauuguggaggccugaagaacgugagagaaguuaaagggcuuaccaagggaggcccggggcaugaggagccuauccccaugagcacauacggauggaaucuggugcgccuccaauccggcgucgacguguuuuucacgcccccugaaaaaugcgauacccugcugugugacauuggcgagagcucccccaacccuacaaucgaagccgggcggacccucagagugcuuaaucugguugagaacuggcugaauaacaauacacaguucugcaucaagguccucaacccguauaugcccucugugauugaaaagauggaggcucugcagcgcaaauacggaggcgcccuugugcggaauccucugagcagaaacuccacccacgagauguacugggucucuaaugcgacggggaacaucguuagcuccgugaauaugauuucucgcaugcucaucaaccgguuuaccaugaagcacaaaaaggccacauaugaacccgauguggaccugggaagcggcaccagaaacauugggaucgaguccgaaauuccuaaucuggacaucaucggaaaacgcauugagaagaucaagcaggaacaugagacaagcuggcacuacgaucaagaccaucccuauaaaaccugggcuuaccacggcucuuaugagacaaagcagaccggcuccgccagcucuauggucaacggggugguucggcuccuuacgaaaccgugggauguggucccuauggugacacagauggcuaugaccgacaccacacccuucggacagcaaagaguuuuuaaggaaaaaguggauacgcgcacccaggagccuaaggaaggcacaaagaaacugaugaagauuaccgccgaguggcuguggaaagagcucgggaagaaaaagacacccagaauguguacccgggaagaguucacacgcaaagucagauccaaugcugcccugggagcgaucuuuaccgacgaaaacaaguggaaaagcgcccgggaggcuguggaagauggcagauucugggagcuuguggaccgggagcgcaaucugcaccucgaagggaaaugcgagacgugugucuacaacaugaugggaaagagagagaagaagcugggcgaguuuggcaaagccaaggggucucgggcuauuugguauauguggcugggagcccgcuuccucgaauuugaggcccugggcuuccuuaaugaggaucauugguuuuccagagggaacagccuguccggaguugaaggcgaggggcuccaccggcugggcuacauccuucgcgacgugggaaagaaagaaggcggggcgauguacgcugaugacaccgccggaugggacacaagaaucacccuggaggaucucaagaaugaagagauggugacaaaccauaugaaaggcgagcacaagaaacuggccgaagcuauuuucaagcugaccuaucagaauaaggucgugcggguucagcgcccuacgcccagagggacagugauggacaucauuagccggcgcgaucaaagaggaucuggccaggucgggaccuacggccucaacacauuuaccaauauggaggcccagcugauccggcaaauggaaggagagggcauuuucaaaagcauccagcaucuuacggcuaccgaggaaaucgccgugcagaacuggcuggcgcgcguugggagagagcggcucuccagaauggccauuucuggagacgauugcguggucaagccgaucgacgaucgcuucgcuagcgcccugacagcucuuaaugacaugggcaaagugcggaaggauauucagcaaugggaaccuuccagaggguggaacgacuggacccagguucccuuuugcucucaccacuuccaugagcuggugaugaaagauggacgcguccucgugguccccugucggaaccaggacgaacugaucggcagagcccgcauuagccagggggcgggcuggucccugaaggagacagccugccucggaaagucuuaugcucaaauguggacccugauguacuuucaccggagagaucuucgccuggccgcuaaugccaucuguagcgcugugccuccgcauuggguucccacaucccggaccacguggagcauucacgccaaacacgaguggaugacaaccgaagacaugcucgcgguguggaacagagucuggauccaggagaauccuuggauggaagacaagacccccguggagucuugggaagaggugccuuaucugggcaaacgcgaggaucaguggugcgggucccuuaucggacugacaagccgggccaccugggcuaagaacauucagacagccaucaaucaaguuagaucucucauuggcaacgaagaguacacggacuauaugcccuccaugaaacgguucagacgcgaagaggaagaggccggggugcugugguga

SEQ ID NO: 19779 - RNA, 9876 nt, Artificial Sequence
  derived and/or modified CDS sequence (opt5) from DENV-2__FJ744744__SS-prME
accgccggagugaucgucaugcugauucccaccgcuauggccuuccaccucacgaccagaaauggggagccucauaugaucguuggacggcaggaaaagggaaaaagccugcuuuuuaagaccgaggacggggugaauaugugcacccugauggcgauugaucucggagaacugugugaggacacgaucaccuacaaaugcccgcuucugcgccaaaaugaacccgaggauauugacuguuggugcaauuccacaucuaccugggugacguauggcaccuguacaaccacaggggagcacagacgggaaaagcgcagcguugcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugaagauggauaaacuucaacugaaggggaugucuuacagcauguguaccggaaaguucaaaaucgucaaggaaauugcggagacacagcacggcacgaucgugauccggguccaguaugagggggacggaucccccugcaaaauucccuucgaaaucaccgaucucgagaagagacaugugcugggccgccugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugcggggagcuaagagaauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgcuccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaauccggagcgucacaagacuugagaaucugauguggaagcagaucaccccggagcucaaccacauucuguccgaaaaugaggugaaacugacaaucaugaccggcgacauucgcgggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaaggugcgcccuacauuugccgucggccuucugcucagaaaacugaccucuaaggagcucaugauggcgacaauugggaucgcucugcuuagccaguccaccauucccgaaaccauccuggagcucacagaugcccuggcccugggaaugauggugcuuaaaaucguucggaacauggaaaaguaccaacuggcugugacgauuauggccaucucuugcgucccuaaugcggugauucuccagaacgcuuggaaggugagcuguaccauccuggccgucguuuccgugagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcuauuauggccguggggauggucagcauccucgcgucuucccugcucaaaaaugacauuccuaugaccggaccccugguggccggcggccuucugaccguuugcuaugugcugacagggcggagcgcugaucucgaacuggagcgcgccgcugacgucaagugggaggaucaagccgaaaucuccggaagcucuccuauucuuagcaucaccauuuccgaggacggcucuaugagcaucaaaaacgaagaggaggaacagacacugacgauccucauuagaaccgggcugcucgugaucuccggaguuuuucccgugucuauuccgaucacagccgcugcgugguaccugugggaggucaagaagcagcgggccggcgugcuuugggaugucccuucucccccucccguggaaaaagcugagcuggaagacggggccuaucgcauuaagcagagaggaauccugggcuacucccaaaucggcgccgggguuuauaaagagggaaccuuccacacaauguggcaugugacccggggcgcuguccucaugcaccgcgggaagagaauugagcccuccugggccgaugugaaaaaggaccugaucagcuacggaggcggguggaaacuugaaggagaguggaaagaaggcgaggaaguucaggugcuggcgcucgagccuggcaagaauccgcgggcuguccagacgaaacccgggauuuuuaagaccaacacaggaaccaucggcgccgugucccuggauuucagcccugggacaucuggaucccccauuguggacagaaaaggcaagguugucgggcucuacggaaauggcguggugacccgcagcggcgccuaugucucugcuaucgcccagacagagaaguccaucgaagauaacccugagauugaagacgauaucuuucggaaaaagagacugacgauuauggaccuucaucccggggcgggaaaaaccaagcgcuaccugccugcuaucgugcgggaggccauuaaaagaggccugcgcacacucauccuggccccgacccggguuguggcugccgaaauggaggaggcucuuagagggcugcccauucgcuaucaaaccccugccaucaagacagaacacacgggacgggagaucgucgaccucaugugucaugcgaccuucacaaugagacugcucagccccgugcggguuccuaacuacaaucugauuaucauggaugaagcccacuucaccgaccccgcuuccauugccgcucgcggcuauaucucuacaagaguggagaugggggaggccgccggcauuuuuaugaccgcuacgccgccuggaagccgggaucccuucccccaguccaacgcgccuaucauggacgaagagagagaaauccccgagagaagcuggaacucuggccacgaaugggucacagauuuuaaggggaaaaccgugugguucguuccuuccauuaaggccggaaacgacaucgcugccugccuucggaaaaauggcaagaaagugauucagcugagcagaaagaccuuugauucugaguacgucaagacacgcgccaacgacugggauuucguggugaccacagacaucagcgagaugggggcuaauuuuaaagccgaacgggucauugauccgagacgcuguaugaagcccguuauccugaccgacggagaggaacgggugauccucgcgggcccuaugcccgugacgcauuccucugcugcccaaagacgcgggcggauuggcagaaacccuaaaaaugagaacgaccaguauaucuacaugggagaaccccuggagaaugaugagaacugcgcccacuggaaggaagcuaaaaugcuucuggacaauauuaacacaccggagggcaucauuccuagcauguucgaacccgagcgcgaaaaggucgaugccaucgacggggaguacagacuccggggagaggcgcgcaaaaccuuuguggaucugaugagacggggcgaccugccuguuuggcucgccuauaagguggcugccgaagggauuaauuacgcugaucgcaagugguguuucgacggaaucaaaaacaaccagauccuugaggaaaauauggaggucgagauuuggacaaaggaaggcgagcgcaagaagcugaaaccccgguggcuggaugccagaaucuauuccgacccucucgcucugaaggaauuuaaggaguucgccgcggggcgcaaaucucuuacccugaaccucauuacggaaaugggccggcugcccaccuucaugacacagaaggccagaaaugcucuggauaaccucgccgugcuucauaccgcugaggccggaggccgcgccuacaaucacgcucugagcgagcugccggaaacacucgagacccugcuucugcucacacugcuggcgaccguuacagggggaaucuuucucuuccuuauguccggcaaagggauuggaaagaugacacugggcaugugcugcaucaucaccgccagcauucugcucugguaugcucaaauccagccucacuggauugccgccucuaucauucuggaauuuuuccuuaucgugcugcucauccccgagcccgaaaaacagcggaccccucaggacaaccaacugacauacgucgugauugcuauccugaccgucguggccgcgacaauggccaaugagaugggcuuucucgagaagacgaagaaagaucuugggcugggauccauuaccacacaggaaagcgaguccaacauccuggacauugaccucagaccggcuucugccuggacccuguaugcuguugccacaaccuucgugacgcccaugcuucggcauagcaucgaaaauuccucugugaacgucagccugaccgcgauugccaaucaggcuacaguucucaugggccuggggaagggauggccucuguccaaaauggauaucggcgugccccuccuugccaucggguguuacagccaggugaacccuauuacccugacagcugcccugcuccugcuugucgcucacuacgccaucauuggacccggccugcaagcgaaggccacccgcgaggcucagaaaagagccgcugccggcaucaugaagaauccuacgguggacgggauuacaguuaucgaucucgaaccgauccccuaugacccuaaguuugagaaacagcugggacaggugaugcugcucauucuuugcgucacccaagugcugaugaugcggacaaccugggcccugugugaggcgcucacccuggcuacaggccccaucucuacgcuuugggaagggaacccuggacgcuucuggaauaccacaauugccgucuccauggcuaacaucuuuagaggcagcuaccuggccggggccggacuccuguucucuauuaugaagaauaccacaaacacccggcgcggcacgggcaacaucggggagacacugggagaaaaauggaaguccagacucaaugcucuuggcaaaagcgaguuucagaucuauaagaaaucugggauucaggagguggaucggacccuggccaaggaaggaaucaagcgcggcgagaccgaccaucacgcgguuagcagaggguccgccaaacugcggugguucguggaaagaaacauggucacacccgagggaaaggugguugaucucggcugcggccgcgggggauggucuuacuauuguggcgggcugaaaaaugugcgggaagucaagggacuuaccaaaggcgggccgggacaugaggagccuauucccaugagcacauacggcuggaaccuggugagacuccaauccggcguggacgucuuuuucacgcccccugaaaagugcgauacccugcugugugacaucggggagagcucccccaauccuacaauugaagcuggacgcacccuccggguccuuaaccugguggagaauuggcugaacaauaacacacaguucugcaucaaggugcucaauccguauaugcccucugucaucgagaagauggaggcccugcagagaaaguacggcggggcucuuguucgcaacccucugagccggaauagcacccacgagauguacugggugucuaacgccagcggaaauauuguguccucugucaacaugaucagcagaaugcucauuaaccgcuuuacgaugaaacacaagaaagcgaccuaugaacccgauguggaccugggcuccgggacacggaauaucggaauugagagcgaaaucccuaaccuggauauuaucggcaagagaaucgagaagauuaaacaggaacaugagaccucuuggcacuacgaccaagaccaucccuauaagacaugggccuaccacggcuccuaugagaccaaacagacagggagcgcuucuuccaugguuaauggagugguccgccuccuuaccaagccgugggaugugguuccuauggugacgcagauggccaugacagacaccacccccuucggccagcaacgggucuuuaaagaaaagguggauacaagaacgcaggagccuaaggaagggaccaaaaagcugaugaaaaucacagcugaguggcuguggaaggagcucggcaaaaagaaaacaccccgcauguguacaagagaagaguucacccggaaggugcgcagcaacgccgcucugggcgccauuuuuacagacgaaaauaaguggaaaucugcgagagaggccgucgaagauucccgguucugggagcuuguugacagagagcggaaccugcaccucgaagggaagugcgagaccuguguguacaauaugaugggaaaacgcgaaaagaaacugggcgaguuuggcaaggcuaaggggagcagagccaucugguauauguggcugggagcucgguuccucgaauuugaggcccugggcuuccuuaacgaggaucauugguuuucccgcgggaauagccugucuggaguggaaggcgaggggcuccacagacugggcuacauucuucgggacgucggcaaaaaggaaggcggggccauguacgcggaugacacggcuggaugggauacccgcaucacacuggaggaccucaaaaacgaagagauggugaccaaucauaugaagggcgagcacaaaaagcuggccgaagccaucuucaagcugacauaucagaacaaaguugugagaguccagcggccuacaccccgcgggacggugauggacauuaucagcagacgggaucaacgcggauccggccagguugggacauacggccucaauaccuuuacaaacauggaggcucagcugauuagacaaauggaaggagagggcaucuucaagucuauucagcaucuuaccgccacggaggaaaucgcugugcagaauuggcuggcccgggucgggcgcgagagacucagccggauggcgaucuccggagacgauugcgugguuaaaccgauugacgauagauucgccucugcucugaccgcccuuaacgacaugggcaaggugcgcaaagauauccagcaaugggaaccuagccggggguggaacgacuggacacagguccccuuuugcucccaccacuuccaugagcuggugaugaaggauggaagaguccucgugguucccugucgcaaucaggacgaacugauuggccgggcuagaaucucucagggggccggcuggagccugaaggagaccgcgugccucggaaaauccuaugcccaaauguggacacugauguacuuucaccgccgggaucuuagacuggcugccaacgcuauuuguagcgccgugccuccgcauuggguccccaccucucgcacaaccugguccauccacgcuaagcacgaguggaugacgacagaagacaugcucgccguguggaaucggguguggauucaggagaacccuuggauggaagauaaaacccccguugagagcugggaagaggugccuuaucugggcaagagagaggaccaguggugcgggucucuuaucggacugaccucccgcgcgacaugggccaaaaauauccagaccgcuauuaaccaaguccggagccucaucggcaaugaagaguacacagacuauaugcccuccaugaagagauuccggagagaagaggaagaggccggggugcugugguga

SEQ ID NO: 19780 - RNA, 9876 nt, Artificial Sequence
  derived and/or modified CDS sequence (opt5) from DENV-2__GQ868646__SS-prME
accgccggagugaucgucaugcugauucccacagcuauggccuuccaccucacgaccagaaauggggaaccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauagcacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccaaauuuacgugcaagaaaaauauggaagggaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugcagacugcggauggauaaacuucaacugaaggggaugucuuacagcauguguaccggaaaguucaaaaucgucaaggaaauugcggagacacagcacggcacgaucgugaucagaguccaguaugagggggacggaucccccugcaaaauucccuucgaaaucaccgaucucgagaagcgccaugugcugggccggcugauuacaguuaacccuaucgugaccgaaaaagacagcccggucaacauugaggccgaacccccuuuuggggauucuuacaucauuaucggcguggagcccggacagcucaagcugaauugguucaagaaaggcuccagcaucgggcaaauguuugagacaaccaugagaggagcuaagcgcauggccauucuuggcgacacggccugggauuucgggucucugggaggcguuuuuacaagcaucgggaaagcucuccaccagguguucggcgccauuuacggagcggcuuuuuccggcgucucuuggaccaugaagauccugauuggggugaucaucaccuggauuggaaugaacagccgguccacaagccugucugugucccuuguucucgucggcguggugacccuguaucugggggccaugguccaggccgacagcggaugugugguuucuuggaaaaauaaggaacucaagugcggcuccgggaucuucauuacagauaacgugcacacguggaccgagcaguacaaauuucaaccugaaagccccuccaagcuggcuucugccauccagaaagcucaugaggaaggcauuuguggaaucagaagcgucacacgccuugagaaucugauguggaagcagaucaccccggagcucaaccacauucuguccgaaaaugaggugaaacugacaaucaugaccggcgacauucgggggaucaugcaggccggaaagagaucucuucgcccucaacccacggaacucaaauauagcuggaagaccuggggcaaggcgaaaaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagacaaacaggaugucuuuugugacuccaagcugaugagcgccgcuaucaaagauaaucgcgccgugcacgcggacaugggcuauuggauugagucugcccucaacgauacguggaagauggaaaaggcuuccuucaucgagguuaaaagcugccacuggccuaagucucauacacuguggagcaauggggugcuggaguccgaaaugauuauccccaaaaacuucgccggaccggucagccagcacaacuaccggccuggcuaucauacccaaaccgcugggcccuggcaccuuggaaagcucgagauggacuuugaucugugugaaggcacaaccgugguggucacggaggacugcgggaauagaggacccucucugcggacaaccacagccuccggcaaacucauuaccgaauggugcugucgcagcugcacacugccuccgcuuagauaccggggcgaggauggguguugguacggaauggagaucagaccccugaaggaaaaggaggaaaaccucguuaauucccuggugaccgccggccaugggcagauugacaacuucucucugggagugcuuggcauggcucuccugcuggaggaaaugcuccgcacgcggaucgggaccaaacacgcgauccugcuugucgccgugagcuuuguuacacugauuaccggaaauauguccuucagagaucucggccgcgugauggucauggugggcgcuacaaugaccgacgauaucgggaugggaguuacguaucuggcccugcuugccgcuuuuaaggugagaccuacauucgccgcgggccugcuccugcggaaacucaccucuaaggagcugaugauggcuacaauugggaucgcccuucugagccaguccaccauucccgagaccauccucgaacugacagacgcccuggcucuuggaaugaugguccugaaaaucgugcgcaacauggagaaguaccaacucgccguuacggugauggcgauuucuugcgucccuaaugcugugauccugcagaacgccuggaaggugagcuguaccauucucgccgcugucuccguuagcccccugcuucugacaucuucccagcagaaagccgacuggaucccucucgcucugaccauuaagggccugaaucccacagccaucuuucuuaccacgcugagcagaacaucuaaaaagcgguccuggccgcucaacgaagcgaucauggccguggggauggugagcauucuggcuucuucccuccugaaaaaugauaucccuaugaccggaccccuugucgccggcggccugcugaccgugugcuauguucucacagggcgcagcgcugaccuggagcuugaaagagccgccgaugugaagugggaggaccaagcugagauuuccggaagcucuccuauccugagcauuaccaucuccgaagauggcucuaugagcauuaaaaacgaggaagaggagcagacacucacgauccugauccggaccgggcuccuggucauuuccggaguguuccccguuucuaucccgauuacagcggccgcuugguaccuuugggaagugaagaagcagcgcgccggcguccugugggacgugccuucucccccucccgucgagaaagccgaacuggaggauggggcuuauagaaucaagcagcggggcauucucggcuacucccaaaucggcgccgggguguauaaagaaggaaccuuucacacaauguggcauguuacccgcggcgcggugcugaugcacagagggaagcggaucgagcccuccugggcugacgucaaaaaggaucuuauuagcuacggaggcggguggaagcuggagggagaauggaaagagggcgaagaggugcagguucucgcccuggaaccuggcaagaauccgagagccgugcagacgaaacccgggaucuucaagaccaacacaggaaccauuggcgcugucucccucgacuuuagcccugggacaucuggaucccccaucguggaucgcaaaggcaaggugguugggcuguacggaaauggcgucgugacccggagcggcgccuaugugucugcgauugcucagacagagaaguccaucgaggacaacccugaaaucgaggaugacauuuuccgcaagaagcgccuuacgaucauggaccugcaucccggggccggaaaaaccaagcgguaccugccugccauugucagagaagcuaucaaacgcggccuccggacacugauucuugccccgaccagagugguugcugccgagauggaagaggcgcugcgcgggcuccccauccgguaucaaaccacagccauuaagacggagcacaccggaagagaaaucguggaucugaugugucaugcuacauuuaccaugcggcuccugagcccuguccgcgugcccaacuacaaucuuaucauuauggacgaggcccacuucacagauccugcuuccaucgccgccagaggcuauauuucuacccggguugaaaugggggaggcugcgggcaucuucaugacggccacacccccgggaagccgcgacccuuuuccccaguccaacgcucccauuauggaugaggaaagagagaucccugaacggagcuggaacucuggccacgagugggugaccgacuucaaggggaaaaccgucugguuugugcccuccaucaaggccggaaacgauauugccgcuugccugcgcaagaauggcaagaaaguuauccagcugagccgcaagacauucgacucugaauacgugaagacccgggccaacgauugggacuuugucgugacaaccgauauuagcgagaugggggcgaauuucaaagcugagagagugaucgacccucgccgguguaugaagccggucauucucacggacggagaagagagaguuauccuggccggccccaugccugugacacauuccucugccgcucaacgccgggggagaaucggccgcaaccccaaaaaugaaaacgaucaguauauuuacaugggagagccucuugaaaaugacgaggauugcgcccacuggaaggaggcgaaaaugcugcucgacaacaucaauacccccgaaggcauuaucccgagcauguuugagccugaaagagagaagguggaugccauugacggggaauaccggcugcgcggagaggcuagaaaaacauucgucgaucugaugcggcgcggcgaccuccccguguggcuugccuauaagguugcugccgaggggaucaacuacgcugauagaaagugguguuuugacggaauuaaaaauaaccagauccuggaagagaacauggaaguggagaucuggaccaaggagggcgaacggaaaaagcugaaaccuagauggcucgaugcccgcauuuauuccgacccccuggcgcuuaaggaguucaaggaauuugccgcugggcggaaaucucugacgcucaaucugaucaccgagaugggcagacugccuacauucaugacccagaaggcccgcaacgcucucgauaaucuugccguccugcauacagccgaagcuggaggccgggcguacaaccacgcccugagcgagcuccccgagacccuggaaacacuucugcuccugacccugcucgcuacggugacagggggaauuuuccuuuuucugauguccggcaaagggaucggaaagaugacccugggcaugugcugcauuaucaccgccagcauccuccugugguaugcccaaauucagccgcacuggaucgcugccucuauuauccuugaguucuuucugauuguucuccugaucccugaacccgagaaacagagaacaccccaggacaaucaacugaccuacguggucaucgcgauucucacaguggucgccgcuacgauggccaacgaaaugggcuuccuugagaagaccaagaaagaccuggggcugggauccaucacaacccaggagagcgaauccaauauucucgauaucgaccugcggccugcuucugccuggacacuuuaugcgguggccaccacguuuguuaccccgaugcugcgccauagcauugagaacuccucugugaaugugagccucacagcuaucgccaaccaggcuaccguccugaugggccuggggaagggauggccccucuccaaaauggauauuggcguuccucuucuggccaucggguguuacagccaggugaaucccaucacacugaccgcugcccuccugcuucugguggcgcacuacgccauuaucggaccuggccuccaagcuaaggccacgagagaagcucagaaacgggccgccgcgggcauuaugaagaaccccacagucgacgggaucaccgugauugaucuggagccuaucccguaugaccccaaguucgaaaaacagcugggacagguuaugcuccuuauccugugcgugacacaaguccugaugaugcgcaccaccugggcucucugugaggcccugacacuugcuacgggcccuauuucuacccugugggaggggaaucccggaagauuuuggaacacaaccaucgccguguccauggccaauauuuuccggggcagcuaccucgcuggggccggacugcuguuuucuaucaugaagaacacaaccaauacgcgcagaggcacaggcaacauuggggaaacccucggagagaaauggaagucccggcuuaacgcgcugggcaaaagcgaguuccagaucuauaagaaaucugggauccaggaggucgaucgcacccuggccaaggagggaauuaagagaggcgaaacagaccaucacgcugugagccggggguccgccaaacucagaugguuuguugagcgcaauauggugaccccugaaggaaaggucguggaucugggcugcggcagagggggauggucuuacuauuguggcgggcuuaaaaacguucgggaggugaagggacugacaaaaggcgggcccggacaugaagaaccgaucccuaugagcacguacggcuggaaucucguccgccugcaauccggcguggacguguucuuuaccccucccgagaagugcgauacacugcucugugacauuggggaaagcucccccaaccccaccaucgaggcuggacggacacuuagaguucugaaucuggucgaaaacuggcucaauaacaauacccaguucugcauuaaggugcugaacccuuauaugccgucugugaucgagaaaauggaagcccuucagcgcaaguacggcggggcgcugguccggaauccccucagcagaaacuccacgcacgagauguacuggguuucuaaugccaccggaaacaucgugagcuccgugaauaugauuucucgcaugcugaucaaccgguucacaaugaaacacaagaaagcuaccuaugagccugaugucgaccugggcagcgggacaagaaacauuggaaucgaauccgagauucccaaucucgacaucauuggcaagcgcaucgaaaagaucaaacaggagcaugaaaccagcuggcacuacgaucaagaccauccuuauaagacaugggccuaccacggcucuuaugagaccaaacagacgggguccgcuagcucuauggugaacggaguugugcggcuucugacaaagcccugggaugucgugccgaugguuacccagauggccaugaccgacacaacgccuuuuggccagcaaagaguguucaaagagaaggucgauacccgcacacaggaacccaaggaggggaccaaaaagcugaugaaaauuacagcugaauggcucuggaaggagcugggaaaagagaagaccccuagaauguguacacgggaagaguuuacccgcaaagugagauccaaugccgcgcuuggcgccaucuucacggacgaaaacaaguggaaaagcgcucgggaggccguggaagaugggagauuuugggagcuggucgaccgggagcgcaaucuccaccuggaaggaaaaugcgagaccuguguuuacaacaugaugggcaagagagagaagaagcugggcgaguucgggaaagcuaagggaucucgggccauuugguauauguggcucggcgcccgcuuucuggaguucgaggcgcuuggguuucugaaugaggaucauugguucuccagaggaaacagccucuccggcguggaaggggagggccugcaccggcuuggauacauccugcgcgacgugggcaagaaagaagggggagcuauguacgccgaugacacagccggcugggacaccagaauuacacucgaggaucugaagaaugaagagauggucaccaaccauaugaaaggggagcacaagaaacuggcugaagccaucuuuaagcucacguaucagaauaaggugguucgggugcagcgccccacaccuagaggaaccgucauggacaucauuagccggcgcgaucaaagaggcucuggacaggugggcacauacggacugaacaccuucacgaauauggaggcucagcuuauccggcaaauggaaggcgaggggauuuuuaaaagcauccagcaucugaccgccacagaggaaauugcgguucagaacuggcucgcccgcgugggaagagagcggcuguccagaauggcuaucucuggcgacgauugcgucgugaagcccaucgacgaucgcuucgccagcgcucuuaccgcccugaaugacauggggaaaguucggaaggauauucagcaaugggaaccguccagaggauggaacgacuggacacaggugccuuucugcucucaccacuuucaugagcucgucaugaaagauggccgcgugcuggucgugcccugucggaaccaggacgaacugaucgggagagcgcgcauuagccagggcgccggauggucccucaaggagaccgcuugccugggcaagucuuaugcccaaauguggacacuuauguacuuccaccggagagaucugcgccucgcugccaaugcuaucuguagcgccguucccucccauugggugccuaccagccggacgacauggucuauucacgcgaaacacgaguggaugaccaccgaagacaugcuggccgucuggaacagaguguggauccaggagaauccguggauggaagacaagacacccguggaguccugggaagagguuccuuaucuugggaaacgcgaggaucaguggugcggaagccugauuggccucaccucucgggcuacaugggccaagaacauccagacggccaucaaucaagugagaucccugauugggaacgaagaguacaccgacuauaugcccagcaugaaacgguuuagacgcgaagaggaagaggcuggaguccugugguga

SEQ ID NO: 19781 - RNA, 9876 nt, Artificial Sequence
  derived and/or modified CDS sequence (opt5) from DENV-2__FJ906961__SS-prME
accgccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagagcaggacaaacgcuuuaucugcaagcauuccaugguggauagaggcuggggcaacggguguggacuguucggcaaggggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaagcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaagcuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagccucauaaccagaccuuccugauugaugggcccgaaacagccgagugcccuaauaccaaccgggcuuggaauagccucgagguugaagacuacggauuuggcguguucacaaccaacaucuggcugaaacuuagagagaagcaggaagucuuuugugacucuaaacugauguccgccgcuaucaaggauaaucgcgccgugcacgcggacaugggcuauuggauugagagcgcccucaacgauacguggaaaauggagaaggcuucuuucaucgaaguuaaguccugccacuggcccaaaagccauacacuguggucuaauggggugcuggagagcgaaaugauuaucccgaagaacuucgccggaccugucucccagcacaacuaccggcccggcuaucauacccaaaccgcugggcccuggcaccuuggaaaacucgagauggacuuugaucugugugaaggcacaaccgugguggucacggaggacugcgggaauagaggaccuagccugcggacaaccacagccucuggcaagcucauuaccgaguggugcugucgcuccugcacacugccgccccuuagauaccggggcgaagauggguguugguacggaauggagaucagaccucugaaagaaaaggaggaaaaccucguuaauagccuggugaccgccggccaugggcagauugacaacuucucccugggagugcuuggcauggcucucuuucuggaggagaugcugcgcacgcggaucgggaccaagcacgcgauccuccuggucgccgugucuuucguuacacuuauuaccggaaauaugagcuuuagagaucugggccgcgugauggucauggugggcgcuacaaugaccgacgauaucgggaugggaguuacguaucucgcccugcuggccgcuuucaaagugagacccacauuugccgcgggccuucugcuccggaagcugaccuccaaagaacucaugauggcuacaauugggaucgcccugcuuucucagagcaccauuccugagaccauccuggaacucacagacgcccuggcucugggaaugaugguccuuaagaucgugcgcaacauggagaaauaccaacuggccguuacgauuauggcgaucuccugcgugcccaaugcugucauucuccagaacgccuggaaggugucuuguaccauccuggccgcugugagcgucuccccucuccugcuuacaagcucucagcagaaggccgauuggauuccccuggcucucaccaucaaaggccugaauccgacagccaucuuccugaccacgcuuuccagaacaagcaagaaacggucuuggccucugaacgaagcgauuauggccguugggaugguguccauccucgcuagcucucugcucaagaaugacauucccaugaccggaccucugguggccggcggccuucugaccgucugcuaugugcugacagggcgcuccgcugaccucgagcuggagagagccgccgauguuaaaugggaagaccaagcugagaucagcggauccagccccauucuuucuaucaccauuagcgaagauggcuccaugucuaucaagaacgaggaggaagagcagacacugacgauccucauucggaccgggcugcucgugaucagcggagucuuuccgguguccauuccuaucacagcggccgcuugguaccugugggaaguuaaaaagcagcgcgccggcgugcuuugggacguccccucuccuccccccguggagaaggccgaacuggaggauggggcuuauagaauuaaacagcggggaauccugggcuacagccaaaucggcgccggggucuauaaggagggaaccuuccacacaauguggcaugugacccgcggcgcgguucucaugcacagagggaaacggauugaaccuuccugggcugacgugaagaaagaucugaucucuuacggaggcggguggaagcuugagggagaauggaaggagggcgaagagguccaggugcuggcccucgagccgggcaaaaaucccagagccguucagacgaagccugggauuuuuaaaaccaacacaggaaccaucggcgcugugagccuggacuucucccccgggacaagcggaucuccuauugucgaucgcaagggcaaagugguggggcucuacggaaauggcguugucacccgguccggcgccuaugugagcgcgaucgcucagacagaaaagucuaucgaggacaaccccgaaauugaggaugacaucuuuagaaagaaacgccugacgauuauggaucuucauccuggggccggaaagaccaaacgguaccugccggccaucgugagagaagcuauuaagcgcggccugcggacacucauccuggcccccaccagagucguggcugccgagauggaggaagcgcuucgcgggcugccuauucgguaucaaaccacagccaucaaaacggagcacaccggaagagaaaucguugaccucaugugucaugcuacauucaccaugcggcugcucucccccgugcgcgucccuaacuacaaucugauuaucauggacgaggcccacuucacagaucccgcuagcauugccgccagaggcuauaucuccacccggguggagaugggggaagcugcgggcauuuuuaugacggccacaccgccuggaucucgcgaccccuucccccagagcaacgcuccuaucauggaugaggaaagagagauccccgaacgguccuggaauagcggccacgaguggguuaccgacuuuaaggggaagaccgugugguucgucccuucuauuaaagccggaaacgauaucgccgcuugccuuagaaagaauggcaaaaaggugauucagcugucccgcaaaacauuugacagcgaguacguuaagacccgggccaacgauugggacuucguggucacaaccgauaucucugaaaugggggcgaauuuuaaggcugagagagugauugacccgcgccgguguaugaaacccgugauccugacggauggagaagagagagucauccucgccggcccuaugcccguuacacauagcuccgccgcucaacgccgggggagaauuggccgcaacccuaagaaugaaaacgaccaguauaucuacaugggagagccccuggagaaugacgaagauugcgcccacuggaaagaggcgaagaugcuucuggacaacauuaauaccccggaaggcaucauuccuucuauguucgagcccgaaagagagaaaguggaugccaucgacggggaguaccggcuccgcggagaagcuagaaagacauuuguggaucugaugcggcgcggcgaccugccugucuggcucgccuauaaaguggcugccgaggggauuaacuacgcugauagaaagugguguuucgacggaaucaagaauaaccagauccuugaagagaacauggagguugaaauuuggaccaaagagggcgaacggaagaaacugaagcccagauggcuggaugcccgcaucuauagcgacccucucgcgcugaaagaguuuaaggaauucgccgcugggcggaagucccuuacgcugaaucucauuaccgagaugggcagacugcccacauucaugacccagaaagcccgcaacgcucuggauaaucucgccgugcuucauacagccgaggcuggaggccgggcguacaaccacgcccugucugaacugccggagacccucgaaacacugcuucugcucacccugcuggcuacggucacagggggaaucuuucucuuccuuaugagcggcaaggggauuggaaaaaugacccugggcaugugcugcaucaucaccgccuccauucugcucugguaugcccaaauccagccucacuggauugcugccagcaucauucuggaguuuuuccuuaucgugcugcucauccccgaacccgagaagcagagaacaccucaggacaaucaacugaccuacguugugauugcgauccugacagucguggccgcuacgauggccaacgagaugggcuuucucgaaaaaaccaagaaggaucuugggcugggaucuauuacaacccaggaguccgaaagcaauauccuggacauugaccuccggccggcuuccgccuggacacuguaugcggucgccaccacguucgugacccccaugcuucgccauucuaucgagaacagcuccguuaaugugucucugacagcuauugccaaccaggcuaccgugcucaugggccuggggaaaggauggccucugagcaagauggauaucggcgucccccuccuugccaucggguguuacucccagguuaauccuauuacacugaccgcugcccugcuccugcuuguggcgcacuacgccaucauuggacccggccugcaagcuaaagccacgagagaagcucagaagcgggccgccgcgggcaucaugaaaaacccuacaguggacgggauuaccgucaucgaucucgagccgauccccuaugacccuaaguuugagaagcagcugggacaggugaugcugcucauucuuugcguuacacaagugcugaugaugcgcaccaccugggcucugugugaagcccucacacuggcuacgggccccaucagcacccuuugggaggggaauccuggaagauucuggaacacaaccauugccgucucuauggccaauaucuuucggggcuccuaccuggcuggggccggacuccuguucagcauuaugaaaaacacaaccaauacgcgcagaggcacaggcaacaucggggaaacccugggagagaaguggaaaucucggcucaacgcgcuuggcaaguccgaguuucagaucuauaaaaagagcgggauucaggaaguggaucgcacccuggccaaagagggaaucaagagaggcgaaacagaccaucacgcugucucucgggggagcgccaagcugagaugguucguggagcgcaauaugguuacccccgaaggaaaaguggucgaucucggcugcggccgggggggaugguccuacuauuguggcgggcugaagaacgugagagagguuaaaggacuuacaaagggcgggccgggacaugaggaaccuauucccaugucuacguacggcuggaaucuggugcgccuccaaagcggcgucgacguguuuuucacccccccugagaaaugcgauacacugcugugugacaucggggaauccagccccaacccuaccauugaggcuggacggacacucagagugcuuaaucugguugaaaacuggcugaauaacaauacccaguucugcaucaagguccucaacccguauaugcccuccgugaucgagaagauggaggcccugcagcgcaaauacggcggggcgcuugugcggaauccucugucuagaaacagcacgcacgaaauguacugggucuccaaugccaccggaaacauuguuucuagcgugaauaugaucucccgcaugcucauuaaccgguuuacaaugaagcacaaaaaggcuaccuaugagcccgauguggaccugggcucugggacaagaaacaucggaauugaaagcgagaucccuaaucuggauauuaucggcaaacgcaucgaaaagauuaagcaggagcaugagaccuccuggcacuacgaccaagaccaucccuauaaaacaugggccuaccacggcagcuaugaaaccaagcagacggggucugcuuccagcauggucaacggagugguucggcuccuuacaaaaccgugggauguggucccuauggugacccagauggccaugaccgacacaacgcccuucggccagcaaagaguuuuuaaggagaaaguggauacccgcacacaggaaccuaaggaggggaccaagaaacugaugaagaucacagcugaguggcuguggaaagaacucggaaagaaaaagacccccagaauguguacacgggaggaauucacccgcaaagucagaucuaaugccgcgcugggcgccauuuuuacggacgagaacaaguggaaguccgcucgggaagccguggaggaugggagauucugggagcuuguggaccgggaacgcaaucugcaccucgagggaaaaugcgaaaccugugucuacaacaugaugggcaagagagagaaaaagcugggcgaauuugggaaagcuaagggaagccgggccaucugguauauguggcugggcgcccgcuuccucgaguuugaggcgcugggguuccuuaaugaagaucauugguuuucuagaggaaacucccugagcggcguugagggggaaggccuccaccggcugggauacauucuucgcgacgugggcaagaaagaggggggagcuauguacgccgaugacacagccggcugggauaccagaaucacacuggaagaccucaagaaugaggagauggugaccaaccauaugaaaggggaacacaagaaacuggcugaggccaucuucaagcugacguaucagaauaaggucgugcggguucagcgcccuacacccagaggaaccgugauggacauuaucucccggcgcgaucaaagaggcagcgggcaggucggcacauacggacucaacaccuuuacgaauauggaagcucagcugauucggcaaauggagggcgaggggaucuucaaaucuauucagcaucuuaccgccacagaagagaucgcggugcagaacuggcuggcccgcguuggaagagaacggcucagcagaauggcuaucuccggcgacgauugcguggucaagccgauugacgaucgcuucgccucugcucugaccgcccuuaaugacauggggaaagugcggaaggauauccagcaaugggagccuagcagaggauggaacgacuggacacagguucccuuuugcucccaccacuuccaugaacuggugaugaaagauggccgcguccucgugguccccugucggaaccaggacgagcugauugggagagcgcgcaucucucagggcgccggauggagccugaaggagaccgcuugccucggcaaguccuaugcccaaauguggacacugauguacuuucaccggagagaucuucgccuggcugccaaugcuauuuguucugccgugccuagccauuggguuccgaccucccggacgacauggagcauccacgcgaaacacgaauggaugaccaccgaggacaugcucgccguguggaacagagucuggauucaggaaaaucccuggauggaggauaagacaccuguggaaucuugggaggaggugcccuaucuggggaaacgcgaagaccaguggugcggaucccuuaucggccugaccagccgggcuacaugggccaagaacauccagacggccauuaaucaaguuagaucucucaucgggaacgaggaauacaccgacuauaugccuuccaugaaacgguucagacgcgaggaagaggaggcuggagugcugugguga

SEQ ID NO: 19782 - RNA, 9876 nt, Artificial Sequence
  derived and/or modified CDS sequence (opt5) from DENV-2__FJ906962__SS-prME
accgccggcgugaucgugaugcugauucccaccgcuauggccuuccaccucacgaccagaaauggggaaccucauaugaucguuggacggcaggaaaagggcaagagccugcuuuuuaagacggaggacggggugaauaugugcacccugauggcgauugaucucggagaacugugugaggacacaaucaccuacaagugcccccuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugagaucaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguggaagacuacggauuuggcguuuucacaaccaacaucuggcugaaacuuagagagaagcaggacguguuuugugauuccaaacugaugagcgccgcuauuaaggacaaucgcgccguccacgcggauaugggcuauuggaucgaaucugcccucaacgacacguggaaaauggagaaggcuuccuucauugaggucaagagcugccacuggccuaaaucucauacacuguggagcaaugggguucuggaauccgagaugaucauucccaagaacuucgccggaccggugagccagcacaacuaccggccuggcuaucauacccaaaccgcugggcccuggcaccuuggaaaacucgaaauggauuuugaccugugugagggcacaaccgucguggugacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucgucaauucccugguuaccgccggccaugggcagaucgauaacuucucucugggagugcuuggcauggcucucuuucuggaagagaugcugcgcacgcggaucgggaccaagcacgcgauucuccugguggccgucagcuucgugacacuuaucaccggaaauauguccuuuagagaccugggccgcguuauggugauggucggcgcuacaaugaccgaugacauugggaugggagugacguaucucgcccugcuggccgcuuucaaaguuagaccuacauuugccgcgggccuucugcuccggaagcugaccucuaaagagcucaugauggcuacaaucgggauugcccugcuuagccaguccaccauccccgaaaacauccuggagcucaccgaugcccuggcucugggaaugauggugcuuaagauuguccgcaauauggaaaaauaccaacuggccgugacaaucauggcgauuucuugcguuccuaacgcugugauccuccagaaugccuggaaggucagcuguacgauucuggccgcuguguccgugagcccccuccugcuuaccucuucccagcagaaggccgacuggaucccucuggcucucacaaucaaaggccugaaccccaccgccauuuuccugacaacccuuagcagaacgucuaagaaacgguccuggccgcugaaugaggcgaucauggccgucgggaugguuagcauucucgcuucuucccugcucaagaacgacaucccuaugacaggaccccugguggccggcggccuucugaccgugugcuauguccugaccgggcgcagcgcugaucucgaacuggagagagccgccgacgugaaaugggaggaucaagcugaaauuuccggaagcucuccuauccuuagcauuacaaucuccgaggacggcucuaugagcaucaagaaugaagaggaggaacagacccugacaauucucauccggacggggcugcucguuauuuccggaguguuucccgucucuaucccgauuaccgcggccgcuugguaccugugggaggugaaaaagcagcgcgccggcguucuuugggaugugccuucucccccucccgucgaaaaggccgagcuggaagacggggcuuauagaaucaaacagcggggaauccugggcuacucccaaauuggcgccgggguguauaaggagggaacauuccacaccauguggcaugucacacgcggcgcggugcucaugcacagagggaaacggaucgagcccuccugggcugauguuaagaaagaccugauuagcuacggaggcggguggaaacuugaaggagaguggaaggaaggcgaggaagugcagguccuggcccucgagccuggcaaaaacccgagagccgugcagaccaagcccgggaucuuuaaaacgaauaccggaacaauuggcgcuguuucccuggauuucagcccugggaccucuggaucccccaucguggaccgcaagggcaaagucguggggcucuacggaaacggcgugguuacacggagcggcgccuaugucucugcgaucgcucagaccgagaaguccauugaagauaacccugagaucgaagacgauauuuuuagaaagaaacgccugacaaucauggaccuucaucccggggccggaaagacgaaacgguaccugccugccauugugagagaggcuaucaagcgcggccugcggacccucauucuggccccgacaagaguggucgcugccgaaauggaggaggcgcuucgcgggcugcccauccgguaucaaaccaccgccaucaaaacagaacacacgggaagagagauuguggaccucaugugucaugcuaccuucacaaugcggcugcucagcccuguucgcgugcccaauuacaaccugaucauuauggaugaagcccacuucaccgacccugcuuccaucgccgccagaggcuauauuucuacacgggucgagaugggggaggcugcgggcaucuuuaugaccgccacgcccccgggaagccgcgauccuuucccccaguccaaugcucccaucauggacgaagagagagaaauuccugagcggagcuggaacucuggccacgaaugggugacagauuuuaaggggaagaccguuugguucgugcccuccaucaaagccggaaaugacauugccgcuugccuuagaaagaacggcaaaaaggucauccagcugagccgcaaaaccuuugauucugaguacgugaagacacgggccaaugacugggauuucguugugaccacagacauuagcgagaugggggcgaacuuuaaggcugaaagagucaucgauccucgccgguguaugaaaccggugauccugaccgacggagaggaaagagugauucucgccggccccaugccugucacgcauuccucugccgcucaacgccgggggagaaucggccgcaaucccaagaacgagaaugaccaguauauuuacaugggagaaccucuggagaacgaugaggacugcgcccacuggaaagaagcgaagaugcuucuggauaauaucaacacacccgagggcauuaucccgagcauguucgaaccugagagagaaaaaguugacgccauugauggggaguaccggcuccgcggagaggcuagaaagaccuuuguggaccugaugcggcgcggcgaucugcccguguggcucgccuauaaagucgcugccgaagggaucaauuacgcugacagaaagugguguuucgauggaaucaagaacaaccagauucuugaggaaaauauggagguggagaucuggacaaaagaaggcgagcggaagaaacugaagccuagauggcuggacgcccgcauuuauuccgauccccucgcgcugaaagaauuuaaggaguucgccgcugggcggaagucucuuacccugaaccucaucacggaaaugggcagacugccuaccuucaugacacagaaagcccgcaaugcucuggacaaccucgccguucuucauaccgccgaggcuggaggccgggcguacaaucacgcccugagcgagcugcccgaaacacucgagacccugcuucugcucacacugcuggcuaccgugacagggggaauuuuucucuuccuuauguccggcaaggggaucggaaaaaugacacugggcaugugcugcaucauuaccgccagcauccugcucugguaugcccaaauucagccgcacuggaucgcugccucuauuauccuggaauuuuuccuuaucguccugcucauuccugagcccgaaaagcagagaacaccccaggauaaccaacugacauacgugguuaucgcgauucugaccguggucgccgcuacaauggccaaugagaugggcuuucucgagaaaacgaagaaggaccuugggcugggauccaucaccacacaggaaagcgaguccaacauucuggacaucgaucuccggccugcuucugccuggacccuguaugcgguggccacaaccuucgucacgccgaugcuucgccauagcauugaaaauuccucugugaacguuagccugaccgcuaucgccaaucaggcuacagugcucaugggccuggggaaaggauggccccuguccaagauggacaucggcgugccucuccuugccauuggguguuacagccaggucaaccccaucacccugacagcugcccugcuccugcuuguugcgcacuacgccauuaucggaccuggccugcaagcuaaagccaccagagaggcucagaagcgggccgccgcgggcauuaugaaaaaucccacgguggaugggaucacagugaucgaccucgaaccuauuccguaugaucccaaguuugagaagcagcugggacaggucaugcugcucauccuuugcgugacccaaguucugaugaugcgcacaaccugggcucugugugaggcccucacccuggcuacaggcccuauuucuacgcuuugggaagggaaccccggaagauucuggaauaccacaaucgccguguccauggccaacauuuuucggggcagcuaccuggcuggggccggacuccuguucucuaucaugaaaaauaccacaaacacccgcagaggcacgggcaacaucggggagacacugggagaaaaguggaaaucccggcucaaugcgcuuggcaagagcgaguuucagauuuauaaaaagucugggauccaggaggucgaccgcacccuggccaaagaaggaauuaagagaggcgagaccgaucaucacgcugugagccggggguccgccaagcugagaugguucgucgaacgcaacauggugacaccugagggaaaaguuguggaccucggcugcggcagagggggauggucuuacuauuguggcgggcugaagaauguccgggaagugaaaggacuuaccaagggcgggcccggacaugaggagccgaucccuaugagcacauacggcuggaaccugguucgccuccaauccggcguggaugucuuuuucacgccgcccgaaaaaugcgacacccugcugugugauauuggggagagcuccccuaaucccacaaucgaagcuggacggacccucagagugcuuaaccugguggagaauuggcugaacaauaacacacaguucugcaucaagguucucaauccuuauaugccgucugucauugaaaagauggaggcccugcagcgcaaauacggcggggcgcuugugcggaacccccugagcagaaauuccacccacgagauguacugggugucuaacgccacgggaaauaucgucagcuccguuaacaugauuucucgcaugcucaucaaccgguuuaccaugaagcacaaaaaggcuacauaugaaccugacguggaucugggcagcgggaccagaaauauuggaaucgaguccgaaauucccaaccuggacaucaucggcaaacgcauugagaagaucaagcaggaacaugagacaagcuggcacuacgaccaagaucauccuuauaaaaccugggccuaccacggcucuuaugagacaaagcagaccggguccgcuagcucuauggugaauggagucgugcggcuccuuacgaaacccugggacguugugccgauggucacacagauggccaugaccgauaccacaccuuucggccagcaaagaguguuuaaggaaaaaguugacacgcgcacccaggagcccaaggaagggacaaagaaacugaugaagauuaccgcugaguggcuguggaaagagcucggaaagaaaaagacaccuagaauguguacccgggaagaguucacacgcaaagugagauccaacgccgcgcugggcgccaucuuuaccgaugaaaauaaguggaaaagcgcucgggaggccgucgaagacgggagauucugggagcuuguggaucgggagcgcaaccugcaccucgaaggaaaaugcgagacguguguguacaauaugaugggcaagagagagaagaagcugggcgaguuugggaaagcuaagggaucucgggccauuugguauauguggcugggcgcccgcuuccucgaauuugaggcgcugggguuccuuaacgaggaccauugguuuuccagaggaaauagccuguccggcgucgaaggggagggccuccaccggcugggauacauccuucgcgauguuggcaagaaagaagggggagcuauguacgccgacgauaccgccggcugggacacaagaaucacccuggaggaccucaagaacgaagagauggugacaaaucauaugaaaggggagcacaagaaacuggcugaagccauuuucaagcugaccuaucagaacaaggugguccgggugcagcgccccacgccuagaggaacaguuauggauaucauuagccggcgcgaccaaagaggcucuggacaggugggcaccuacggacucaauacauuuaccaacaucgaggcucagcugauucggcaaauggaaggcgaggggaucuucaaaagcauccagcaucuuacggccaccgaggaaauugcgguccagaauuggcuggcccgcgugggaagagagcggcucuccagaauggcuaucucuggcgaugacugcguugugaagcccauugaugaccgcuucgccagcgcucugacagcccuuaacgauauggggaaaguccggaaggacauccagcaaugggaaccguccagaggauggaacgauuggacccaggugccuuuuugcucucaccacuuccaugagcugguuaugaaagacggccgcgugcucgucgugcccugucggaaucaggaugaacugauugggagagcgcgcaucagccagggcgccggauggucccugaaggagacagcuugccucggcaagucuuaugcccaaauguggacccugauguacuuucaccggagagaccuucgccuggcugccaacgcuauuuguagcgccguccccucccauugggugccuacaagccggaccacguggucuauccacgcgaaacacgaguggaugacaaccgaagauaugcucgccguuuggaauagaguguggauccaggagaacccguggauggaagacaagacccccgucgaguccugggaagaggugccuuaucuggggaaacgcgaggaccaguggugcggaagccuuauuggccugacaucucgggcuaccugggccaagaauauccagacagccauuaaccaagugagaucccucaucgggaaugaagaguacacggauuauaugcccagcaugaaacgguucagacgcgaagaggaagaggcuggaguucugugguga

SEQ ID NO: 19783 - RNA, 9876 nt, Artificial Sequence
  derived and/or modified CDS sequence (opt5) from DENV-2__FJ850053__SS-prME
accgccggcgugaucgucaugcugauucccacagcuauggccuuccaccucacgaccagaaacggggaaccucauaugaucguuggacggcaggaaaagggcaagagccugcuuuuuaagaccgaggacggggugaauaugugcacccugauggcgauugaucucggagaacugugugaggacacaaucaccuacaaaugcccccuucugcgccaaaacgaacccgaggauauugacuguuggugcaauuccacaucuaccugggugacguauggcaccuguacaaccacaggggagcaccggcgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagccucauaaccagaccuuccugauugaugggcccgaaacagccgagugcccuaauaccaaccgggcuuggaauagccucgagguugaagacuacggauuuggcguguucacaaccaacaucuggcugaaacuuagagagaagcaggacgucuuuugugauucuaaacugauguccgccgcuaucaaggacaaucgcgccgugcacgcggauaugggcuauuggauugaaagcgcccucaacgacacguggaaaauggagaaggcuucuuucaucgagguuaaguccugccacuggcccaaaagccauacacuguggucuaauggggugcuggaaagcgagaugauuaucccgaagaacuucgccggaccugucucccagcacaacuaccggcccggcuaucauacccaaaccgcugggcccuggcaccuuggaaaacucgaaauggauuuugaccugugugagggcacaaccgugguggucacggaagauugcgggaauagaggaccuagccugcggacaaccacagccucuggcaagcucauuaccgaguggugcugucgcuccugcacacugccgccccuuagauaccggggcgaggacggguguugguacggaauggaaaucagaccucugaaagagaaggaagagaaccucguuaauagccuggugaccgccggccaugggcagauugauaacuucucccugggagugcuuggcauggcucucuuucuggaagagaugcugcgcacgcggaucgggaccaagcacgcgauccuccuggucgccgugucuuucguuacacuuauuaccggaaauaugagcuuuagagaccugggccgcgugauggucauggugggcgcuacaaugaccgaugacaucgggaugggaguuacguaucucgcccugcuggccgcuuucaaagugagacccacauuugccgcgggccuucugcuccggaagcugaccuccaaagagcucaugauggcuacaauugggaucgcccugcuuucucagagcaccauuccugaaaccauccuggagcucacagaugcccuggcucugggaaugaugguccuuaagaucgugcgcaacauggaaaaauaccaacuggccguuacgauuauggcgaucuccugcgugcccaaugcugucauucuccagaacgccuggaaggugucuuguaccauccuggccgcugugagcgucuccccucuccugcuuacaagcucucagcagaaggccgacuggauuccccuggcucucaccaucaaaggccugaauccgacagccaucuuccugaccacgcuuuccagaacaagcaagaaacggucuuggccucugaacgaggcgauuauggccguugggaugguguccauccucgcuagcucucugcucaagaaugacauucccaugaccggaccucugguggccggcggccuucugaccgucugcuaugugcugacagggcgcuccgcugaucucgaacuggagagagccgccgacguuaaaugggaggaucaagcugaaaucagcggauccagccccauucuuucuaucaccauuagcgaggacggcuccaugucuaucaagaacgaagaggaggaacagacacugacgauccucauucggaccgggcugcucgugaucagcggagucuuuccgguguccauuccuaucacagcggccgcuugguaccugugggagguuaaaaagcagcgcgccggcgugcuuugggauguccccucuccuccgcccguggaaaaggccgagcuggaagacggggcuuauagaauuaaacagcggggaauccugggcuacagccaaaucggcgccggggucuauaaggagggaaccuuccacacaauguggcaugugacccgcggcgcgguucucaugcacagagggaaacggauugagccuuccugggcugaugugaagaaagaccugaucucuuacggaggcggguggaaacuugaaggagaguggaaggaaggcgaggaaguccaggugcuggcccucgagccgggcaaaaaucccagagccguucagacgaagccugggauuuuuaaaaccaacacaggaaccaucggcgcugugagccuggauuucucccccgggacaagcggaucuccuauugucgaccgcaagggcaaagugguggggcucuacggaaauggcguugucacccgguccggcgccuaugugagcgcgaucgcucagacagagaagucuaucgaagauaaccccgagauugaagacgauaucuuuagaaagaaacgccugacgauuauggaccuucauccuggggccggaaagaccaaacgguaccugccggccaucgugagagaggcuauuaagcgcggccugcggacacucauccuggcccccaccagagucguggcugccgaaauggaggaggcgcuucgcgggcugccuauucgguaucaaaccacagccaucaaaacggaacacaccggaagagagaucguugaccucaugugucaugcuacauucaccaugcggcugcucucccccgugcgcgucccuaacuacaaucugauuaucauggaugaagcccacuucacagaccccgcuagcauugccgccagaggcuauaucuccacccggguggagaugggggaggcugcgggcauuuuuaugacggccacaccgccuggaucucgcgaucccuucccccagagcaacgcuccuaucauggacgaagagagagaaauccccgagcgguccuggaauagcggccacgaauggguuaccgauuuuaaggggaagaccgugugguucgucccuucuauuaaagccggaaacgacaucgccgcuugccuuagaaagaauggcaaaaaggugauucagcugucccgcaaaacauuugauagcgaguacguuaagacccgggccaacgacugggauuucguggucacaaccgacaucucugagaugggggcgaauuuuaaggcugaaagagugauugauccgcgccgguguaugaaacccgugauccugacggacggagaggaaagagucauccucgccggcccuaugcccguuacacauagcuccgccgcucaacgccgggggagaauuggccgcaacccuaagaaugagaacgaccaguauaucuacaugggagaaccccuggagaaugaugaggacugcgcccacuggaaagaagcgaagaugcuucuggauaacauuaauaccccggagggcaucauuccuucuauguucgaacccgagagagaaaaaguggacgccaucgauggggaguaccggcuccgcggagaggcuagaaagacauuuguggaccugaugcggcgcggcgaucugccugucuggcucgccuauaaaguggcugccgaagggauuaacuacgcugacagaaagugguguuucgauggaaucaagaauaaccagauccuugaggaaaacauggagguugagauuuggaccaaagaaggcgagcggaagaaacugaagcccagauggcuggacgcccgcaucuauagcgauccucucgcgcugaaagaauuuaaggaguucgccgcugggcggaagucccuuacgcugaaucucauuaccgaaaugggcagacugcccacauucaugacccagaaagcccgcaacgcucuggacaaucucgccgugcuucauacagccgaggcuggaggccgggcguacaaccacgcccugucugagcugccggaaacccucgagacacugcuucugcucacccugcuggcuacggucacagggggaaucuuucucuuccuuaugagcggcaaggggauuggaaaaaugacccugggcaugugcugcaucaucaccgccuccauucugcucugguaugcccaaauccagccucacuggauugcugccagcaucauucuggaauuuuuccuuaucgugcugcucauccccgagcccgaaaagcagagaacaccucaggauaaucaacugaccuacguugugauugcgauccugacagucguggccgcuacgauggccaacgagaugggcuuucucgagaaaaccaagaaggaccuugggcugggaucuauuacaacccaggaauccgagagcaauauccuggacauugaucuccggccggcuuccgccuggacacuguaugcggucgccaccacguucgugacccccaugcuucgccauucuaucgaaaacagcuccguuaaugugucucugacagcuauugccaaccaggcuaccgugcucaugggccuggggaaaggauggccucugagcaagauggacaucggcgucccccuccuugccaucggguguuacucccagguuaauccuauuacacugaccgcugcccugcuccugcuuguggcgcacuacgccaucauuggacccggccugcaagcuaaagccacgagagaggcucagaagcgggccgccgcgggcaucaugaaaaacccuacaguggaugggauuaccgucaucgaccucgaaccgauccccuaugauccuaaguuugagaagcagcugggacaggugaugcugcucauucuuugcguuacacaagugcugaugaugcgcaccaccugggcucugugugaggcccucacacuggcuacgggccccaucagcacccuuugggaagggaauccuggaagauucuggaacacaaccauugccgucucuauggccaauaucuuucggggcuccuaccuggcuggggccggacuccuguucagcauuaugaaaaacacaaccaauacgcgcagaggcacaggcaacaucggggagacccugggagaaaaguggaaaucucggcucaacgcgcuuggcaaguccgaguuucagaucuauaaaaagagcgggauucaggagguggaccgcacccuggccaaagaaggaaucaagagaggcgagacagaucaucacgcugucucucgggggagcgccaagcugagaugguucguggaacgcaauaugguuacccccgagggaaaaguggucgaccucggcugcggcagagggggaugguccuacuauuguggcgggcugaagaacgugagagaaguuaaaggacuuacaaagggcgggccgggacaugaggagccuauucccaugucuacguacggcuggaaucuggugcgccuccaaagcggcgucgauguguuuuucacacccccugaaaaaugcgacacacugcugugugauaucggggaguccagccccaacccuaccauugaagcuggacggacacucagagugcuuaaucugguugagaacuggcugaauaacaauacccaguucugcaucaagguccucaacccguauaugcccuccgugaucgaaaagauggaggcccugcagcgcaaauacggcggggcgcuugugcggaauccucugucuagaaacagcacgcacgagauguacugggucuccaaugccaccggaaacauuguuucuagcgugaauaugaucucccgcaugcucauuaaccgguuuacaaugaagcacaaaaaggcuaccuaugaacccgacguggaucugggcucugggacaagaaacaucggaauugagagcgaaaucccuaaucuggacauuaucggcaaacgcaucgagaagauuaagcaggaacaugagaccuccuggcacuacgaccaagaucaucccuauaaaacaugggccuaccacggcagcuaugagaccaagcagacggggucugcuuccagcauggucaacggagugguucggcuccuuacaaaaccgugggacguggucccuauggugacccagauggccaugaccgauacaacgcccuucggccagcaaagaguuuuuaaggaaaaaguggacacccgcacacaggagccuaaggaagggaccaagaaacugaugaagaucacagcugaguggcuguggaaagagcucggaaagaaaaagacccccagaauguguacacgggaagaguucacccgcaaagucagaucuaaugccgcgcugggcgccauuuuuacggaugaaaacaaguggaaguccgcucgggaggccguggaagacgggagauucugggagcuuguggaucgggagcgcaaucugcaccucgaaggaaaaugcgagaccugugucuacaacaugaugggcaagagagagaagaagcugggcgaguuugggaaagcuaagggaagccgggccaucugguauauguggcugggcgcccgcuuccucgaauuugaggcgcugggguuccuuaaugaggaccauugguuuucuagaggaaacucccugagcggcguugaaggggagggccuccaccggcugggauacauucuucgcgaugugggcaagaaagaagggggagcuauguacgccgacgauacagccggcugggacaccagaaucacacuggaggaccucaagaaugaagagauggugaccaaccauaugaaaggggagcacaagaaacuggcugaagccaucuucaagcugacguaucagaauaaggucgugcggguucagcgcccuacacccagaggaaccgugauggauauuaucucccggcgcgaccaaagaggcagcgggcaggucggcacauacggacucaacaccuuuacgaauauggaggcucagcugauucggcaaauggaaggcgaggggaucuucaaaucuauucagcaucuuaccgccacagaggaaaucgcggugcagaacuggcuggcccgcguuggaagagagcggcucagcagaauggcuaucuccggcgaugacugcguggucaagccgauugaugaccgcuucgccucugcucugaccgcccuuaaugauauggggaaagugcggaaggacauccagcaaugggaaccuagcagaggauggaacgauuggacacagguucccuuuugcucccaccacuuccaugagcuggugaugaaagacggccgcguccucgugguccccugucggaaccaggaugaacugauugggagagcgcgcaucucucagggcgccggauggagccugaaggagaccgcuugccucggcaaguccuaugcccaaauguggacacugauguacuuucaccggagagaccuucgccuggcugccaaugcuauuuguucugccgugccuagccauuggguuccgaccucccggacgacauggagcauccacgcgaaacacgaguggaugaccaccgaagauaugcucgccguguggaacagagucuggauucaggagaaucccuggauggaagacaagacaccuguggagucuugggaagaggugcccuaucuggggaaacgcgaggaccaguggugcggaucccuuaucggccugaccagccgggcuacaugggccaagaacauccagacggccauuaaucaaguuagaucucucaucgggaacgaagaguacaccgauuauaugccuuccaugaaacgguucagacgcgaagaggaagaggcuggagugcugugguga

SEQ ID NO: 19784 - RNA, 9876 nt, Artificial Sequence
  derived and/or modified CDS sequence (opt5) from DENV-2__JN819420__SS-prME
accgccggagugaucgugaugcugauucccaccgcuauggccuuccaccucacgacccggaauggggaaccucauaugaucguuggacggcaggaaaagggcaaaagccugcuuuuuaagacagaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagcgcgcuuccuucaucgaggucaagagcugccacuggccuaaaucucauacacuguggagcaaugggguccuggaauccgagaugauuauccccaagaacuucgccggaccggugagccagcacaacuaccggccuggcuaucauacccaaaccgcugggcccuggcaccuuggaaaacucgaaauggauuuugacuucugugagggcacaaccguggucguuacggaagauugcgggaauagaggacccucucugcggacaaccacagccuccggcaagcugauuaccgaguggugcugucgcagcugcacacucccuccgcugagauaccggggcgaggacggguguugguacggaauggaaaucagaccccuuaaagagaaggaagagaaccuggugaauagccucgugaccgccggccaugggcagauugauaacuuuucucugggaguccugggcauggcucuuuuccucgaagagaugcugcgcacgcggaucgggaccaagcacgcgauccugcucguggccguuagcuuugugacacugauuaccggaaauauguccuucagagaccuuggccgcgucauggugaugguuggcgcuacaaugaccgaugacaucgggaugggagugacguaucuggcccuccuggccgcuuuuaaagucagaccuacauucgccgcgggccugcuucugcggaagcucaccucuaaagagcugaugauggcuacaauugggaucgcccuccugagccaguccaccauucccgaaaccauccuugagcugacagaugcccucgcucugggaaugauggugcugaagaucguucgcaacauggaaaaauaccaacuugccgugacgauuauggcgaucucuugcgucccuaaugcugugauucugcagaacgccuggaaggugagcuguaccauccucgccgcugucuccguuagcccccugcuccugacaucuucccagcagaaggccgacuggauuccucuugcucugaccaucaaaggccucaaucccacagccaucuuucugaccacgcugagcagaacaucuaagaaacgguccuggccgcuuaacgaggcgauuauggccguggggauggugagcauccuggcuucuucccuccugaagaaugacauuccuaugaccggaccccucgucgccggcggccugcuuaccgugugcuauguucugacagggcgcagcgcugaucuggaacucgagagagccgccgacgugaaaugggaggaucaagcugaaaucuccggaagcucuccuauucugagcaucaccauuuccgaggacggcucuaugagcaucaagaacgaagaggaggaacagacacuuacgauccugauucggaccgggcuccuggucaucuccggaguguuccccguuucuauuccgaucacagcggccgcuugguaccucugggaggugaaaaagcagcgcgccggcguccugugggaugugccuucucccccucccgucgaaaaggccgagcuugaagacggggcuuauagaauuaaacagcggggaauccugggcuacucccaaaucggcgccgggguguauaaggagggaaccuuucacacaauguggcauguuacccgcggcgcggugcugaugcacagagggaaacggauugagcccuccugggcugaugucaagaaagaccucaucagcuacggaggcggguggaagcuggaaggagaguggaaggaaggcgaggaagugcagguucuugcccuggagccuggcaaaaauccgagagccgugcagacgaagcccgggauuuucaaaaccaacacaggaaccaucggcgcugucucccucgauuuuagcccugggacaucuggaucccccauuguggaccgcaagggcaaagugguugggcuguacggaaauggcgucgugacccggagcggcgccuaugugucugcgaucgcucagacagagaaguccaucgaagauaacccugagauugaagacgauaucuucagaaagaaacgccucacgauuauggaccugcaucccggggccggaaagaccaaacgguaccuuccugccaucgucagagaggcuauuaagcgcggccugcggacacugauccucgccccgaccagagugguugcugccgaaauggaggaggcgcugcgcgggcuucccauucgguaucaaaccccugccaucaaaacagaacacacgggaagagagaucguggaccugaugugucaugcuaccuucacaaugcggcuccugagccccguccgcgugccuaacuacaaucucauuaucauggaugaagcccacuuuaccgaccccgcuuccauugccgccagaggcuauaucucuacacggguugagaugggggaggcugcgggcauuuucaugaccgccacgccgccuggaagccgcgaucccuuuccccaguccaacgcuccuaucauggacgaagagagagaaauccccgagcggagcuggaacucuggccacgaaugggugacagauuucaaggggaagaccgucugguuugugccuuccauuaaagccggaaacgacaucgccgcuugccugagaaagaauggcaaaaagguuauucagcuuagccgcaaaaccuucgauucugaguacgugaagacacgggccaacgacugggauuuugucgugaccacagacaucagcgagaugggggcgaauuucaaggcugaaagagugauugauccgcgccgguguaugaaacccgucauccugaccgacuccgaggaaagaguuauccuggccggaccuaugcccgugacgcauucuagcgccgcucaacgccggggcagaauugggcgcaacccuaagaaugagaacgaccaguauaucuacaugggcgaaccccucgagaaugaugaggacugcgcccacuggaaagaagcgaagaugcugcuugauaacauuaauacaccggagggaaucauuccuuccauguuugaacccgagagagaaaaaguggacgccaucgauggcgaguaccggcugcgcggggaggcuagaaagaccuucgucgaccucaugcggcgcggagaucugccuguguggcuggccuauaaaguugcugccgaaggcauuaacuacgcugacagaaagugguguuuugaugggaucaagaauaaccagauccucgaggaaaacauggagguggagauuuggacaaaagaaggagagcggaagaaacuuaagcccagauggcuggacgcccgcaucuauucugauccucuggcgcucaaagaguucaaggaguucgccgcuggcagaaagagccugacccuuaaucugauuacggaaauggggagacuccccaccuuuaugacacagaaagcccgcaacgcucuggacaaucuggccguccuccauaccgccgaggcuggcggacgggcguacaaccacgcccuuuccgagcugccggaaacacuggagacccuccugcuucugacacuccuggcuaccgugacgggcgggaucuuccuguuucucaugagcggaaagggcauugggaaaaugacacuuggaaugugcugcaucaucaccgccucuauucugcugugguaugcccaaauccagccucacuggauugcugccuccaucauucucgaguucuuucugaucguucuucugauccccgagcccgaaaagcagagaaccccucaggauaaucaacucacauacguggucauugcgauccugaccguggucgccgcuacaauggccaacgagaugggcuuccuggagaaaacgaagaaggaccucggccuugggagcauuaccacacaggaauccgagucuaauauccuggacauugaucugcggccggcuagcgccuggacccucuaugcgguggccacaaccuuuguuacgcccaugcugcgccauuccaucgaaaacucuagcgugaaugugucccuuaccgcuauugccaaccaggcuacaguccugaugggacucggcaaaggguggccucugagcaagauggacaucggaguuccccugcucgccaugggcuguuacucucaguucaaaccuaucacccuuacagcugcccugcugcuccugguggcgcacuacgccauuaucgggcccggacuucaagcuaaggccaccagagaggcucagaaacgggccgccgcgggcauuaugaagaauccuacgguggauggcaucacagucauugaccuggaaccgauccccuaugauccuaaguuugagaaacagcucggacaggugaugcugcugauccucugcguuacccaagugcuuaugaugcgcacaaccugggcucugugugaggcccugacccucgcuacaggacccauuuccacgcugugggaaggcaacccugggagauucuggaauaccacaaucgccgucagcauggccaacauuuuucggggaucuuaccuugcuggcgccgggcuccuguucuccaucaugaagaauaccacaagcacccgcagaggaacgggcaacauuggcgagacacugggggaaaaauggaagucucggcugaaugcgcucggaaaaagcgaguuucagaucuauaagaaauccggcauccaggagguggaccgcacccuugccaaggaagggauuaagagaggagagaccgaucaucacgcugucucucggggcagcgccaaacugagaugguucguggaacgcaacaugguuacacccgaggggaagguggucgaccugggaugcggccggggcgggugguccuacuauuguggaggccucaaaaacgugagagaaguuaaggggcugaccaaaggaggcccggggcaugaggagccuauccccaugagcacauacggauggaaucuugugcgccugcaauccggcgucgauguguucuuuacgcccccugaaaagugcgacacccuccugugugauauuggcgagucuagccccaacccuacaaucgaagcugggcggacccugagagugcucaaucuuguugagaacuggcugaauaacaauacacaguucugcauuaagguccugaacccguauaugcccuccgugaucgagaagauggaggcccuccagcgccaguacggaggcgcgcuggugcggaauccucuuucuagaaacagcacccacgagauguacugggucuccaaugccacggggaacaucguuucuagcgugaauaugauuucccgcaugcugaucaaccgguuuaccaugaagcacaaaaaggcuacauaugaacccgacguggaucucggaagcggcaccagaaauauugggaucgagucugaaauuccuaaccuggacaucauuggaaaacgcaucgagaagaucaagcaagaacaugagauuuccuggcacuacgaccaggaucaucccuauaaaacaugggccuaccacggcagcuaugagaccaagcagacaggcucugcuuccagcauggucaacggggugguucggcugcucaccaaaccgugggacguggucccuauggugacgcagauggccaugacagauaccacccccuucggacaacagagaguuuuuaaggaaaaaguggacacacgcacgcaggagccuaaggaaggcaccaagaaacuuaugaagaucacagcugaguggcuguggaaagagcuggggaagaaaaagacccccagaauguguacacgggaagaguucaccaaaaagguccgcucuaaugccgcgcucggagccauuuuuacagaugaaaacaaguggaaauccgcuagagaggccguggaagacggccgguucugggagcugguggauagagagcggaaucuucaccuggaagggaagugcgagaccugugucuacaacaugaugggaaaacgcgaaaagaaacucggcgaguuuggcaaggcuaaggggagcagagccaucugguauauguggcugggagcccgguuccuggaauuugaggcgcucggcuuccugaaugaggaccauugguuuucccgcgggaacagccuuucuggaguugaaggcgaggggcugcacagacucggcuacauucugcgggaugugggcaagaaggaaggcggggcuauguacgccgacgauacggccggaugggacacccgcaucacacuugaggaccugaaaaaugaagagauggugaccaaccauaugaagggcgagcacaaaaagcucgcugaagccaucuucaagcugacauaucagaauaaagucgugagaguucaacggccuacaccccgcgggacggugauggauauuaucagcagacgggaccagcgcggauccggccaggucgggacauacggccugaacaccuucacaaauauggaggcucaacucauuagacagauggaaggagagggcaucuuuaagucuauucagcaucugaccgccacggaggaaaucgcggugcagaacuggcuugcccggguugggcgcgagagacugagccggauggcuaucuccggagaugacugcguggucaaaccgauugaugacagauucgccucugcucucaccgcccugaaugauaugggcaaggugcgcaaagacauccaacagugggaaccuagccggggguggaacgauuggacacagguucccuuuugcucccaccacuuccaugagcuugugaugaaggacggaagaguccuggugguccccugucgcaaucaggaugaacucauuggccgggcgagaaucucucaaggggccggcuggagccugaaggagaccgcuugccugggaaaauccuaugcccagauguggacacucauguacuuucaccgccgggaccugagacuugcugccaacgcuauuuguagcgccgugccuucucauuggguuccgaccucccgcacaaccuggagcauccacgcgaagcacgaguggaugacgacagaagauaugcuggccguguggaaccgggucuggauucaggagaaucccuggauggaagacaaaaccccuguggagucuugggaagaggugcccuaucucggcaagagagaggaccaguggugcgggucccugaucggacuuaccagccgcgcuacaugggccaaaaacauccaaaccgccauuaaucagguucggucccugaucggcaacgaagaguacacagauuauaugccuucuaugaagagauuccggagagaagaggaagaggcuggggugcucugguga

SEQ ID NO: 19785 - RNA, 9876 nt, Artificial Sequence
  derived and/or modified CDS sequence (opt5) from DENV-2__FJ850118__SS-prME
accgccggcgugaucgucaugcugauucccacggcuauggccuuccaccucacgaccagaaauggggaaccucauaugaucguuggacggcaggaaaagggcaagagccugcuuuuuaagacagaggacggggugaauaugugcacccugauggcgauugaucucggagaacugugugaggacacaaucaccuacaagugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggcuaugggcagauugauaacuucucucugggagugcuuggcauggcucucuuucuggaagagaugcugcgcacgcggaucgggaccaagcaugcgauccuccuggucgccgugagcuucguuacacuuauuaccggaaauauguccuuuagagaccugggccgcgugauggucauggugggcgcuacaaugaccgaugacaucgggaugggaguuacguaccucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaucaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuacgugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaucugugggagguuaaaaagcagcgcgccggcgugcuuugggaugucccuucucccccucccguggaaaaggccgagcuggaagacggggcuuacagaauuaaacagcggggaauccugggcuauucccaaaucggcgccggggucuacaaggagggaaccuuccacacaauguggcacgugacccgcggcgcgguucucaugcauagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuauggaaauggcguugucacccggagcggcgccuacgugucugcgaucgcucagacagagaaguccaucgaagauaacccugagauugaagacgauaucuuuagaaagaaacgccugacgauuauggaccuucaccccggggccggaaagaccaaacgguaucugccugccaucgugagagaggcuauuaagcgcggccugcggacacucauccuggccccgaccagagucguggcugccgaaauggaggaggcgcuucgcgggcugcccauucgguaccaaaccccugccaucaaaacagaacauacgggaagagagaucguugaccucaugugucacgcuaccuucacaaugcggcugcucagccccgugcgcgucccuaacuauaaucugauuaucauggaugaagcccauuucaccgaccccgcuuccauugccgccagaggcuacaucucuacacggguggagaugggggaggcugcgggcauuuuuaugaccgccacgccgccuggaagccgcgaucccuucccccaguccaacgcuccuaucauggacgaagagagagaaauccccgagcggagcuggaacucuggccacgaauggguuacagauuuuaaggggaagaccgugugguucgucccuuccauuaaagccggaaacgacaucgccgcuugccuuagaaagaauggcaaaaaggugauucagcugagccgcaaaaccuuugauucugaguauguuaagacacgggccaacgacugggauuucguggucaccacagacaucagcgagaugggggcgaauuuuaaggcugaaagagugauugauccgcgccgguguaugaaacccgugauccugaccgacggagaggaaagagucauccucgccggcccuaugcccguuacgcacuccucugccgcucaacgccgggggagaauuggccgcaacccuaagaaugagaacgaccaguacaucuacaugggagaaccccuggagaaugaugaggacugcgcccauuggaaagaagcgaagaugcuucuggauaacauuaauacaccggagggcaucauuccuagcauguucgaacccgagagagaaaaaguggacgccaucgauggggaguaucggcuccgcggagaggcuagaaagaccuuuguggaccugaugcggcgcggcgaucugccugucuggcucgccuacaaaguggcugccgaagggauuaacuaugcugacagaaagugguguuucgauggaaucaagaauaaccagauccuugaggaaaacauggagguugagauuuggacaaaagaaggcgagcggaagaaacugaagcccagauggcuggacgcccgcaucuacuccgauccucucgcgcugaaagaauuuaaggaguucgccgcugggcggaagucucuuacccugaaucucauuacggaaaugggcagacugcccaccuucaugacacagaaagcccgcaacgcucuggacaaucucgccgugcuucacaccgccgaggcuggaggccgggcguauaaccaugcccugagcgagcugccggaaacacucgagacccugcuucugcucacacugcuggcuaccgucacagggggaaucuuucucuuccuuauguccggcaaggggauuggaaaaaugacacugggcaugugcugcaucaucaccgccagcauucugcucugguacgcccaaauccagccucacuggauugcugccucuaucauucuggaauuuuuccuuaucgugcugcucauccccgagcccgaaaagcagagaaccccucaggauaaucaacugacauauguugugauugcgauccugaccgucguggccgcuacaauggccaacgagaugggcuuucucgagaaaacgaagaaggaccuugggcugggauccauuaccacacaggaaagcgaguccaauauccuggacauugaucuccggccggcuucugccuggacccuguacgcggucgccacaaccuucgugacgcccaugcuucgccacagcaucgaaaacuccucuguuaaugugagccugaccgcuauugccaaccaggcuacagugcucaugggccuggggaaaggauggccucuguccaagauggacaucggcgucccccuccuugccaucggguguuacagccagguuaauccuauuacccugacagcugcccugcuccugcuuguggcgcauuaugccaucauuggacccggccugcaagcuaaagccaccagagaggcucagaagcgggccgccgcgggcaucaugaaaaacccuacgguggaugggauuacagucaucgaccucgaaccgauccccuacgauccuaaguuugagaagcagcugggacaggugaugcugcucauucuuugcguuacccaagugcugaugaugcgcacaaccugggcucugugugaggcccucacccuggcuacaggccccaucucuacgcuuugggaagggaauccuggaagauucuggaacaccacaauugccgucuccauggccaauaucuuucggggcagcuaucuggcuggggccggacuccuguucucuauuaugaaaaacaccacaaauacccgcagaggcacgggcaacaucggggagacacugggagaaaaguggaaaucccggcucaacgcgcuuggcaagagcgaguuucagaucuacaaaaagucugggauucaggagguggaccgcacccuggccaaagaaggaaucaagagaggcgagaccgaucaccaugcugucagccggggguccgccaagcugagaugguucguggaacgcaauaugguuacacccgagggaaaaguggucgaccucggcugcggcagagggggauggucuuauuacuguggcgggcugaagaacgugcgggaaguuaaaggacuuaccaagggcgggccgggacacgaggagccuauucccaugagcacauauggcuggaaucuggugcgccuccaauccggcgucgauguguuuuucacgcccccugaaaaaugcgacacccugcugugugauaucggggagagcucccccaacccuacaauugaagcuggacggacccucagagugcuuaaucugguugagaacuggcugaauaacaauacacaguucugcaucaagguccucaacccguacaugcccucugugaucgaaaagauggaggcccugcagcgcaaauacggcggggcgcuugugcggaauccucugagcagaaacuccacccaugagauguauugggucucuaaugccacgggaaacauuguuagcuccgugaauaugaucucucgcaugcucauuaaccgguuuaccaugaagcacaaaaaggcuacauacgaacccgacguggaucugggcagcgggaccagaaacaucggaauugaguccgaaaucccuaaucuggacauuaucggcaaacgcaucgagaagauuaagcaggaacacgagacaagcuggcauuaugaccaagaucaccccuacaaaaccugggccuaucauggcucuuacgagacaaagcagaccggguccgcuagcucuauggucaacggagugguucggcuccuuacgaaaccgugggacguggucccuauggugacacagauggccaugaccgauaccacacccuucggccagcaaagaguuuuuaaggaaaaaguggacacgcgcacccaggagccuaaggaagggacaaagaaacugaugaagaucaccgcugaguggcuguggaaagagcucggaaagaaaaagacacccagaauguguacccgggaagaguucacacgcaaagucagauccaaugccgcgcugggcgccauuuuuaccgaugaaaacaaguggaaaagcgcucgggaggccguggaagacgggagauucugggagcuuguggaucgggagcgcaaucugcaccucgaaggaaaaugcgagacgugugucuauaacaugaugggcaagagagagaagaagcugggcgaguuugggaaagcuaagggaucucgggccaucugguacauguggcugggcgcccgcuuccucgaauuugaggcgcugggguuccuuaaugaggaccacugguuuuccagaggaaacagccuguccggcguugaaggggagggccuccaucggcugggauacauucuucgcgaugugggcaagaaagaagggggagcuauguaugccgacgauaccgccggcugggacacaagaaucacccuggaggaccucaagaaugaagagauggugacaaaccacaugaaaggggagcauaagaaacuggcugaagccaucuucaagcugaccuaccagaauaaggucgugcggguucagcgcccuacgcccagaggaacagugauggauauuaucagccggcgcgaccaaagaggcucugggcaggucggcaccuauggacucaacacauuuaccaauauggaggcucagcugauucggcaaauggaaggcgaggggaucuucaaaagcauucagcaccuuacggccaccgaggaaaucgcggugcagaacuggcuggcccgcguuggaagagagcggcucuccagaauggcuaucucuggcgaugacugcguggucaagccgauugaugaccgcuucgccagcgcucugacagcccuuaaugauauggggaaagugcggaaggacauccagcaaugggaaccuuccagaggauggaacgauuggacccagguucccuuuugcucucaucacuuccacgagcuggugaugaaagacggccgcguccucgugguccccugucggaaccaggaugaacugauugggagagcgcgcaucagccagggcgccggauggucccugaaggagacagcuugccucggcaagucuuacgcccaaauguggacccugauguauuuucaucggagagaccuucgccuggcugccaaugcuauuuguagcgccgugccuccgcacuggguucccacaucccggaccacguggagcauccaugcgaaacacgaguggaugacaaccgaagauaugcucgccguguggaacagagucuggauucaggagaauccuuggauggaagacaagacccccguggagucuugggaagaggugccuuaccuggggaaacgcgaggaccaguggugcggaucccuuaucggccugacaagccgggcuaccugggccaagaacauccagacagccauuaaucaaguuagaucucucaucgggaacgaagaguauacggauuacaugcccuccaugaaacgguucagacgcgaagaggaagaggcuggagugcugugguga

SEQ ID NO: 19786 - RNA, 9876 nt, Artificial Sequence
  derived and/or modified CDS sequence (opt5) from DENV-2__JN819416__SS-prME
acagccggagugaucgucaugcugauucccacggcuauggccuuccaccucacgaccagaaauggggagccucauaugaucguuggacggcaggaaaagggaaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaaggugcgcccuacauuugccgcgggccuucugcucagaaaacugaccucuaaggagcucaugauggcuacaauugggaucgcccugcuuagccaguccaccauucccgaaaccauccuggagcucacagaugcccuggcucugggaaugaugguccuuaaaaucgugcggaacauggaaaaguaccaacuggccguuacgauuauggcgaucucuugcgugccuaaugcugucauucuccagaacgccuggaaggugagcuguaccauccuggccgcuguguccgucagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcgauuauggccguugggauggugagcauccucgcuucuucccugcucaaaaaugacauuccuaugaccggaccccugguggccggcggccuucugaccgucugcuaugugcugacagggcggagcgcugaucucgaacuggagcgcgccgccgacguuaagugggaggaucaagcugaaaucuccggaagcucuccuauucuuagcaucaccauuuccgaggacggcucuaugagcaucaaaaacgaagaggaggaacagacacugacgauccucauuagaaccgggcugcucgugaucuccggagucuuucccgugucuauuccgaucacagcggccgcuugguaccugugggagguuaagaagcagcgggccggcgugcuuugggaugucccuucucccccucccguggaaaaagccgagcuggaagacggggcuuaucgcauuaagcagagaggaauccugggcuacucccaaaucggcgccggggucuauaaagagggaaccuuccacacaauguggcaugugacccggggcgcgguucucaugcaccgcgggaagagaauugagcccuccugggcugaugugaaaaaggaccugaucagcuacggaggcggguggaaacuugaaggagaguggaaagaaggcgaggaaguccaggugcuggcccucgagccuggcaagaauccgcgggccguucagacgaaacccgggauuuuuaagaccaacacaggaaccaucggcgcugugucccuggauuucagcccugggacaucuggaucccccauugucgacagaaaaggcaaggugguggggcucuacggaaauggcguugucacccgcagcggcgccuaugugucugcgaucgcucagacagagaaguccaucgaagauaacccugagauugaagacgauaucuuucggaaaaagagacugacgauuauggaccuucaucccggggccggaaaaaccaagcgcuaccugccugccaucgugcgggaggcuauuaaaagaggccugcgcacacucauccuggccccgacccgggucguggcugccgaaauggaggaggcgcuuagagggcugcccauucgcuaucaaaccccugccaucaagacagaacacacgggacgggagaucguugaccucaugugucaugcuaccuucacaaugagacugcucagccccgugcgggucccuaacuacaaucugauuaucauggaugaagcccacuucaccgaccccgcuuccauugccgcccgcggcuauaucucuacaagaguggagaugggggaggcugcgggcauuuuuaugaccgccacgccgccuggaagccgggaucccuucccccaguccaacgcuccuaucauggacgaagagagagaaauccccgagagaagcuggaacucuggccacgaauggguuacagauuuuaaggggaaaaccgugugguucgucccuuccauuaaggccggaaacgacaucgccgcuugccuucggaaaaauggcaagaaagugauucagcugagcagaaagaccuuugauucugaguacguuaagacacgcgccaacgacugggauuucguggucaccacagacaucagcgagaugggggcgaauuuuaaagcugaacgggugauugauccgagacgcuguaugaagcccgugauccugaccgacggagaggaacgggucauccucgccggcccuaugcccguuacgcauuccucugccgcucaaagacgcgggcggauuggcagaaacccuaaaaaugagaacgaccaguauaucuacaugggagaaccccuggagaaugaugaggacugcgcccacuggaaggaagcgaaaaugcuucuggauaacauuaauacaccggagggcaucauuccuagcauguucgaacccgagcgcgaaaagguggacgccaucgauggggaguacagacuccggggagaggcucgcaaaaccuuuguggaccugaugagacggggcgaucugccugucuggcucgccuauaagguggcugccgaagggauuaacuacgcugaccgcaagugguguuucgauggaaucaaaaauaaccagauccuugaggaaaacauggagguugagauuuggacaaaggaaggcgagcgcaagaagcugaaaccccgguggcuggacgccagaaucuauuccgauccucucgcgcugaaggaauuuaaggaguucgccgcugggcgcaaaucucuuacccugaaucucauuacggaaaugggccggcugcccaccuucaugacacagaaggccagaaacgcucuggacaaucucgccgugcuucauaccgccgaggcuggaggccgcgcguacaaccacgcccugagcgagcugccggaaacacucgagacccugcuucugcucacacugcuggcuaccgucacagggggaaucuuucucuuccuuauguccggcaaagggauuggaaagaugacacugggcaugugcugcaucaucaccgccagcauucugcucugguaugcccaaauccagccucacuggauugcugccucuaucauucuggaauuuuuccuuaucgugcugcucauccccgagcccgaaaaacagcggaccccucaggauaaucaacugacauacguugugauugcgauccugaccgucguggccgcuacaauggccaacgagaugggcuuucucgagaagacgaagaaagaccuugggcugggauccauuaccacacaggaaagcgaguccaauauccuggacauugaucucagaccggcuucugccuggacccuguaugcggucgccacaaccuucgugacgcccaugcuucggcauagcaucgaaaacuccucuguuaaugugagccugaccgcuauugccaaccaggcuacagugcucaugggccuggggaagggauggccucuguccaaaauggacaucggcgucccccuccuugccaucggguguuacagccagguuaauccuauuacccugacagcugcccugcuccugcuuguggcgcacuacgccaucauuggacccggccugcaagcuaaggccacccgcgaggcucagaaaagagccgccgcgggcaucaugaagaacccuacgguggaugggauuacagucaucgaccucgaaccgauccccuaugauccuaaguuugagaaacagcugggacaggugaugcugcucauucuuugcguuacccaagugcugaugaugcggacaaccugggcucugugugaggcccucacccuggcuacaggccccaucucuacgcuuugggaagggaauccuggacgcuucuggaacaccacaauugccgucuccauggccaauaucuuuagaggcagcuaccuggcuggggccggacuccuguucucuauuaugaagaacaccacaaauacccggcgcggcacgggcaacaucggggagacacugggagaaaaauggaaguccagacucaacgcgcuuggcaaaagcgaguuucagaucuauaagaaaucugggauucaggagguggaccggacccuggccaaggaaggaaucaagcgcggcgagaccgaucaucacgcugucagcagaggguccgccaaacugcggugguucguggaaagaaauaugguuacacccgagggaaagguggucgaccucggcugcggccgcgggggauggucuuacuauuguggcgggcugaaaaacgugcgggaaguuaagggacuuaccaaaggcgggccgggacaugaggagccuauucccaugagcacauacggcuggaaucuggugagacuccaauccggcgucgauguguuuuucacgcccccugaaaagugcgacacccugcugugugauaucggggagagcucccccaacccuacaauugaagcuggacgcacccuccgggugcuuaaucugguugagaacuggcugaauaacaauacacaguucugcaucaagguccucaacccguauaugcccucugugaucgagaagauggaggcccugcagagaaaguacggcggggcgcuugugcgcaauccucugagccggaacuccacccacgagauguacugggucucuaaugccacgggaaacauuguuagcuccgugaauaugaucucuagaaugcucauuaaccgcuuuaccaugaaacacaagaaagcuacauaugaacccgacguggaucugggcagcgggacccggaacaucggaauugaguccgaaaucccuaaucuggacauuaucggcaagagaaucgagaagauuaaacaggaacaugagacaagcuggcacuacgaccaagaucaucccuauaagaccugggccuaccacggcucuuaugagacaaaacagaccggguccgcuagcucuauggucaacggagugguucgccuccuuacgaagccgugggacguggucccuauggugacacagauggccaugaccgauaccacacccuucggccagcaacggguuuuuaaagaaaagguggacacgagaacccaggagccuaaggaagggaccaagaagcugaugaaaaucaccgcugaguggcuguggaaggagcucggcaaaaagaaaacaccccgcauguguaccagagaagaguucacacggaagguccgcuccaaugccgcgcugggcgccauuuuuaccgaugaaaacaaguggaaaagcgcuagagaggccguggaagacucucgguucugggagcuuguggauagagagcggaaucugcaccucgaagggaagugcgagacgugugucuacaacaugaugggaaaacgcgaaaagaaacugggcgaguuuggcaaggcuaagggguccagagccaucugguauauguggcugggagcccgguuccucgaauuugaggcgcugggcuuccuuaaugaggaccauugguuuagccgcgggaacucccugagcggaguugaaggcgaggggcuccacagacugggcuacauucuucgggaugugggcaaaaaggaaggcggggcuauguacgccgacgauaccgccggaugggacacacgcaucacccuggaggaccucaaaaaugaagagauggugacaaaccauaugaagggcgagcacaaaaagcuggcugaagccaucuucaagcugaccuaucagaauaaagucgugagaguucagcggccuacgccccgcgggacagugauggauauuaucucuagacgggaccaacgcggaagcggccaggucgggaccuacggccucaacacauuuaccaauauggaggcucagcugauuagacaaauggaaggagagggcaucuucaaguccauucagcaucuuacggccaccgaggaaaucgcggugcagaacuggcuggcccggguugggcgcgagagacucucucggauggcuaucagcggagaugacugcguggucaaaccgauugaugacagauucgccuccgcucugacagcccuuaaugauaugggcaaggugcgcaaagacauccagcaaugggaaccuucucggggguggaacgauuggacccagguucccuuuugcagccaccacuuccaugagcuggugaugaaggacggaagaguccucgugguccccugucgcaaccaggaugaacugauuggccgggcgagaaucucccagggggccggcuggucucugaaggagacagcuugccucggaaaaagcuaugcccaaauguggacccugauguacuuucaccgccgggaccuuagacuggcugccaaugcuauuuguuccgccgugccuccgcauuggguucccacaagccgcaccacguggucuauccacgcgaagcacgaguggaugacaaccgaagauaugcucgccguguggaaccgggucuggauucaggagaauccuuggauggaagacaaaacccccguggaguccugggaagaggugccuuaucugggcaagagagaggaccaguggugcgggagccuuaucggacugacaucucgcgcuaccugggccaaaaacauccagacagccauuaaucaaguucggucccucaucggcaacgaagaguacacggauuauaugcccagcaugaagagauuccggagagaagaggaagaggcuggggugcugugguga

SEQ ID NO: 19787 - RNA, 9876 nt, Artificial Sequence
  derived and/or modified CDS sequence (opt5) from DENV-2__FJ850119__SS-prME
acagccggagugaucgucaugcugauucccacggcuauggccuuccaccucacgaccagaaauggggagccucauaugaucguuggacggcaggaaaagggcaaaagccugcuuuuuaagacagaggacgggauuaauaugugcacccugauggcgaucgaucucggagaacugugugaggacacaauuaccuacaaaugcccgcuucugcgccaaaaugaacccgaggauaucgacuguuggugcaauagcacaucuaccugggugacguauggcaccuguacaaccacaggggagcacagacgggaaaagcgcagcguggcucucgucccucaugugggaaugggccuggagaccagaacggaaacauggauguccucugagggcgccuggaaacacguucagcggaucgagaccuggauucugcgccaucccggguucacaaucauggccgcuauucucgccuacaccaucggaaccacacacuuucagagagcucugauuuucauccuucugacggccguggcgccuagcaugaccaugcggugcauuggcaucuccaaccgcgauuuugucgaaggggugucuggaggcagcuggguugacaucgugcucgagcacggguccugugucacaaccauggccaagaauaagcccacacuggauuucgaacuuauuaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgugacaugcgccauguuuacgugcaaaaagaauauggaagggaaagucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucaucggcgucgagcccggacagcucaaacugaauugguucaagaagggcuccagcauugggcaaauguuugagacaaccaugagaggagcuaaacgcauggccauccuuggcgacacggccugggauuucgggucucugggaggcguguuuacaagcauugggaaggcucuccaccagguuuucggcgccaucuacggagcggcuuuuuccggcgugucuuggaccaugaaaauucugaucggggucaucauuaccuggaucggaaugaacagccgguccacaagccugucugugucccuugugcucguuggcgucgugacccuguaucugggggccauggugcaggccgacagcggaugugucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugaccugugugagggcacaaccgucguggugacggaagauugcgggaaucggggacccucucugagaacaaccacagccuccggcaaacucaucaccgaguggugcugucggagcugcacacugccuccgcuucgcuacagaggcgaggacggguguugguacggaauggaaauucggccccugaaggagaaggaagagaaccucgucaauucccugguuaccgccggccaugggcagaucgauaacuucucucugggagugcuuggcauggcucucuuucuggaagagaugcugagaacgcgcaucgggaccaaacacgcgauucuccugguggccgucagcuucgugacacuuaucaccggaaauauguccuuucgggaccugggcagaguuauggugauggucggcgcuacaaugaccgaugacauugggaugggagugacguaucucgcccugcuggccgcuuucaagguucgcccuacauuugccgcgggccuucugcucagaaaacugaccucuaaggagcucaugauggcuacaaucgggauugcccugcuuagccaguccaccauccccgaaaccauccuggagcucacagaugcccuggcucugggaaugauggugcuuaaaauuguccggaacauggaaaaguaccaacuggccgugacgaucauggcgauuucuugcguuccuaaugcugugauccuccagaacgccuggaaggucagcuguaccauucuggccgcuguguccgugagcccccuccugcuuacaucuucccagcagaaagccgacuggaucccucuggcucucaccaucaagggccugaaucccacagccauuuuccugaccacgcuuagccgcacaucuaaaaagagauccuggccgcugaacgaggcgaucauggccgucgggaugguuagcauucucgcuucuucccugcucaaaaaugacaucccuaugaccggaccccugguggccggcggccuucugaccgugugcuauguccugacagggcggagcgcugaucucgaacuggagcgcgccgccgacgugaagugggaggaucaagcugaaauuuccggaagcucuccuauccuuagcauuaccaucuccgaggacggcucuaugagcaucaaaaacgaagaggaggaacagacacugacgauucucaucagaaccgggcugcucguuauuuccggaguguuucccgucucuaucccgauuacagcggccgcuugguaccugugggaggugaagaagcagcgggccggcguucuuugggaugugccuucucccccucccgucgaaaaagccgagcuggaagacggggcuuaucgcaucaagcagagaggaauccugggcuacucccaaauuggcgccgggguguauaaagagggaaccuuccacacaauguggcaugucacccggggcgcggugcucaugcaccgcgggaagagaaucgagcccuccugggcugauguuaaaaaggaccugauuagcuacggaggcggguggaaacuugaaggagaguggaaagaaggcgaggaagugcagguccuggcccucgagccuggcaagaauccgcgggccgugcagacgaaacccgggaucuuuaagaccaacacaggaaccauuggcgcuguuucccuggauuucagcccugggacaucuggaucccccaucguggacagaaaaggcaaggucguggggcucuacggaaauggcgugguuacccgcagcggcgccuaugucucugcgaucgcucagacagagaaguccauugaagauaacccugagaucgaagacgauauuuuucggaaaaagagacugacgaucauggaccuucaucccggggccggaaaaaccaagcgcuaccugccugccauugugcgggaggcuaucaaaagaggccugcgcacacucauucuggccccgacccggguggucgcugccgaaauggaggaggcgcuuagagggcugcccauccgcuaucaaaccccugccaucaagacagaacacacgggacgggagauuguggaccucaugugucaugcuaccuucacaaugagacugcucagccccguucgggugccuaacuacaaucugaucauuauggaugaagcccacuucaccgaccccgcuuccaucgccgcccgcggcuauauuucuacaagagucgagaugggggaggcugcgggcaucuuuaugaccgccacgccgccuggaagccgggaucccuucccccaguccaacgcuccuaucauggacgaagagagagaaauucccgagagaagcuggaacucuggccacgaaugggugacagauuuuaaggggaaaaccguuugguucgugccuuccaucaaggccggaaacgacauugccgcuugccuucggaaaaauggcaagaaagucauccagcugagcagaaagaccuuugauucugaguacgugaagacacgcgccaacgacugggauuucguugugaccacagacauuagcgagaugggggcgaauuuuaaagcugaacgggucaucgauccgagacgcuguaugaagcccgugauccugaccgacggagaggaacgggugauucucgccggcccuaugcccgucacgcauuccucugccgcucaaagacgcgggcggaucggcagaaacccuaaaaaugagaacgaccaguauauuuacaugggagaaccccuggagaaugaugaggacugcgcccacuggaaggaagcgaaaaugcuucuggauaacaucaauacaccggagggcauuaucccuagcauguucgaacccgagcgcgaaaagguugacgccauugauggggaguacagacuccggggagaggcucgcaaaaccuuuguggaccugaugagacggggcgaucugccuguguggcucgccuauaaggucgcugccgaagggaucaacuacgcugaccgcaagugguguuucgauggaaucaaaaauaaccagauucuugaggaaaacauggagguggagaucuggacaaaggaaggcgagcgcaagaagcugaaaccccgguggcuggacgccagaauuuauuccgauccucucgcgcugaaggaauuuaaggaguucgccgcugggcgcaaaucucuuacccugaaucucaucacggaaaugggccggcugcccaccuucaugacacagaaggccagaaacgcucuggacaaucucgccguucuucauaccgccgaggcuggaggccgcgcguacaaccacgcccugagcgagcugccggaaacacucgagacccugcuucugcucacacugcuggcuaccgugacagggggaauuuuucucuuccuuauguccggcaaagggaucggaaagaugacacugggcaugugcugcaucauuaccgccagcauccugcucugguaugcccaaauucagccucacuggaucgcugccucuauuauccuggaauuuuuccuuaucguccugcucauucccgagcccgaaaaacagcggaccccucaggauaaucaacugacauacgugguuaucgcgauucugaccguggucgccgcuacaauggccaacgagaugggcuuucucgagaagacgaagaaagaccuugggcugggauccaucaccacacaggaaagcgaguccaauauucuggacaucgaucucagaccggcuucugccuggacccuguaugcgguggccacaaccuucgucacgcccaugcuucggcauagcauugaaaacuccucugugaauguuagccugaccgcuaucgccaaccaggcuacagugcucaugggccuggggaagggauggccucuguccaaaauggacaucggcgugccccuccuugccauuggguguuacagccaggucaauccuaucacccugacagcugcccugcuccugcuuguugcgcacuacgccauuaucggacccggccugcaagcuaaggccacccgcgaggcucagaaaagagccgccgcgggcauuaugaagaacccuacgguggaugggaucacagugaucgaccucgaaccgauucccuaugauccuaaguuugagaaacagcugggacaggucaugcugcucauccuuugcgugacccaaguucugaugaugcggacaaccugggcucugugugaggcccucacccuggcuacaggccccauuucuacgcuuugggaagggaauccuggacgcuucuggaacaccacaaucgccguguccauggccaauauuuuuagaggcagcuaccuggcuggggccggacuccuguucucuaucaugaagaacaccacaaauacccggcgcggcacgggcaacaucggggagacacugggagaaaaauggaaguccagacucaacgcgcuuggcaaaagcgaguuucagauuuauaagaaaucugggauccaggaggucgaccggacccuggccaaggaaggaauuaagcgcggcgagaccgaucaucacgcugugagcagaggguccgccaaacugcggugguucgucgaaagaaauauggugacacccgagggaaagguuguggaccucggcugcggccgcgggggauggucuuacuauuguggcgggcugaaaaacguccgggaagugaagggacuuaccaaaggcgggccgggacaugaggagccuauccccaugagcacauacggcuggaaucugguuagacuccaauccggcguggaugucuuuuucacgcccccugaaaagugcgacacccugcugugugauauuggggagagcucccccaacccuacaaucgaagcuggacgcacccuccgggugcuuaaucugguggagaacuggcugaauaacaauacacaguucugcaucaagguucucaacccguauaugcccucugucauugagaagauggaggcccugcagagaaaguacggcggggcgcuugugcgcaauccucugagccggaacuccacccacgagauguacugggugucuaaugccacgggaaacaucgucagcuccguuaauaugauuucuagaaugcucaucaaccgcuuuaccaugaaacacaagaaagcuacauaugaacccgacguggaucugggcagcgggacccggaacauuggaaucgaguccgaaauuccuaaucuggacaucaucggcaagagaauugagaagaucaaacaggaacaugagacaagcuggcacuacgaccaagaucaucccuauaagaccugggccuaccacggcucuuaugagacaaaacagaccggguccgcuagcucuauggugaacggagucgugcgccuccuuacgaagccgugggacguugugccuauggucacacagauggccaugaccgauaccacacccuucggccagcaacggguguuuaaagaaaagguugacacgagaacccaggagccuaaggaagggaccaagaagcugaugaaaauuaccgcugaguggcuguggaaggagcucggcaaaaagaaaacaccccgcauguguaccagagaagaguucacacggaaggugcgcuccaaugccgcgcugggcgccaucuuuaccgaugaaaacaaguggaaaagcgcuagagaggccgucgaagacgggcgguucugggagcuuguggauagagagcggaaucugcaccucgaaggaaagugcgagacguguguguacaacaugaugggcaaacgcgaaaagaaacugggcgaguuugggaaggcuaagggaucuagagccauuugguauauguggcugggcgcccgguuccucgaauuugaggcgcugggguuccuuaaugaggaccauugguuuucccgcggaaacagccuguccggcgucgaaggggagggccuccacagacugggauacauccuucgggauguuggcaaaaaggaagggggagcuauguacgccgacgauaccgccggcugggacacacgcaucacccuggaggaccucaaaaaugaagagauggugacaaaccauaugaagggggagcacaaaaagcuggcugaagccauuuucaagcugaccuaucagaauaaaguggucagagugcagcggccuacgccccgcggaacaguuauggauaucauuagcagacgggaccaacgcggcucuggacaggugggcaccuacggacucaacacauuuaccaauauggaggcucagcugaucagacaaauggaaggcgaggggauuuucaagagcauccagcaucuuacggccuccgaggaaaccgcgguccagaacuggcuggcccgggugggacgcgagagacucucucggauggcuaucagcggcgaugacugcguugugaaaccgauugaugacagauucgccuccgcucugacagcccuuaaugauauggggaagguccgcaaagacauccagcaaugggaaccuucucggggauggaacgauuggacccaggugcccuuuugcagccaccacuuccaugagcugguuaugaaggacggcagagugcucgucgugcccugucgcaaccaggaugaacugauugggcgggcgagaaucucccagggcgccggauggucucugaaggagacagcuugccucggcaaaagcuaugcccaaauguggacccugauguacuuucaccgccgggaccuuagacuggcugccaaugcuauuuguuccgccgucccuccgcauugggugcccacaagccgcaccacguggucuauccacgcgaagcacgaguggaugacaaccgaagauaugcucgccguuuggaaccggguguggauucaggagaauccuuggauggaagacaaaacccccgucgaguccugggaagaggugccuuaucuggggaagagagaggaccaguggugcggaagccuuaucggccugacaucucgcgcuaccugggccaaaaacauccagacagccauuaaucaagugcggucccucaucgggaacgaagaguacacggauuauaugcccagcaugaagagauuccggagagaagaggaagaggcuggaguucugugguga

SEQ ID NO: 19788 - RNA, 9876 nt, Artificial Sequence
  derived and/or modified CDS sequence (opt5) from DENV-2__FJ850064__SS-prME
acagccggagugaucgucaugcugauucccacggcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugcuacaaccaugagaggagccaaacgcauggccauucuuggcgacacggcuugggauuucgggucucugggaggcguuuuuacaagcaucgggaaggcccuccaccagguguucggcgcgauuuacggagcugccuuuuccggcgucucuuggaccaugaaaauccugauuggggugaucaucaccuggauuggaaugaacagccgguccacaagccugucugugucccuuguucucgucggcguggugacccuguaucugggggccaugguccaggcugacagcggaugugugguuucuuggaagaauaaagagcucaagugcggcuccgggaucuucauuacagauaacgugcacacguggaccgaacaguacaaguuucaaccugagagccccuccaaacuggccucugcuauccagaaggcccaugaagagggcauuuguggaaucagaagcgucacacgccuugaaaaucugauguggaaacagaucaccccggagcucaaccacauucuguccgagaaugaagugaagcugacaaucaugaccggcgacauuaaagggaucaugcaggcgggaaagcggucucuuagaccucaacccacggagcucaaauauagcuggaagaccuggggcaaggccaaaaugcuguccacagaaagccauaaccagaccuuccugauugaugggccugagacagcugaaugccccaauaccaaccgcgccuggaacucucucgagguugaggacuacggauuuggcguguucacaaccaacaucuggcugaaacuucgggaaaaacaggacgucuuuugugauuccaagcugaugagcgcugccaucaaagacaauagagcggugcacgccgauaugggcuauuggauugagucugcucucaacgacacguggaagauggaaaaggccuccuucaucgagguuaaaagcugccacuggccuaagucucauacacuguggagcaauggggugcuggaguccgaaaugauuauccccaaaaacuucgcuggaccggucagccagcacaacuaccgcccuggcuaucauacccaaaccgccgggcccuggcaccuuggaaagcucgagauggauuuugaccugugugaaggcacaaccgugguggucacggaggauugcgggaaucggggacccucucugagaacaaccacagccuccggcaaacucauuaccgaauggugcugucggagcugcacacugccuccgcuucgcuacagaggcgaggacggguguugguacggaauggagauccggccccugaaggaaaaggaggaaaaccucguuaauucccuggugaccgcuggccaugggcagauugauaacuucucucugggagugcuuggcauggcgcucuuucuggaggaaaugcugagaacgcgcaucgggaccaaacacgccauccuccuggucgcugugagcuucguuacacuuauuaccggaaauauguccuuucgggaccugggcagagugauggucauggugggcgccacaaugaccgaugacaucgggaugggaguuacguaucucgcccugcuggcugccuucaaggugcgcccuacauuugcggcuggccuucugcucagaaaacugaccucuaaggagcucaugauggccacaauugggaucgcccugcuuagccaguccaccauucccgagaccauccuggaacucacagaugcucuggcccugggaaugaugguccuuaaaaucgugcggaacauggagaaguaccaacuggcgguuacgauuauggcuaucucuugcgugccuaaugccgucauucuccagaacgccuggaaggugagcuguaccauccuggcugccguguccgucagcccccuccugcuuacaucuucccagcagaaagcugacuggauuccucuggcccucaccaucaagggccugaaucccacagcgaucuuccugaccacgcuuagccgcacaucuaaaaagagauccuggccgcugaacgaagccauuauggcuguugggauggugagcauccucgccucuucccugcucaaaaaugacauuccuaugaccggaccccugguggcuggcggccuucugaccgucugcuaugugcugacagggcggagcgccgaucucgagcuggaacgcgccgcugacguuaagugggaggaucaagcggagaucuccggaagcucuccuauucuuagcaucaccauuuccgaagacggcucuaugagcaucaaaaacgaggaagaggagcagacacugacgauccucauuagaaccgggcugcucgugaucuccggagucuuucccgugucuauuccgaucacagccgcugccugguaccugugggaaguuaagaagcagcgggccggcgugcuuugggaugucccuucucccccucccguggagaaagcugaacuggaggacggggccuaucgcauuaagcagagaggaauccugggcuacucccaaaucggcgcgggggucuauaaagaaggaaccuuccacacaauguggcaugugacccggggcgcuguucucaugcaccgcgggaagagaauugagcccuccugggccgaugugaaaaaggaccugaucagcuacggaggcggguggaaacuugagggagaauggaaagagggcgaagagguccaggugcuggcccucgaaccuggcaagaauccgcgggcuguucagacgaaacccgggauuuuuaagaccaacacaggaaccaucggcgccgugucccuggauuucagcccugggacaucuggaucccccauugucgacagaaaaggcaaggugguggggcucuacggaaauggcguugucacccgcagcggcgcguaugugucugcuaucgcccagacagagaaguccaucgaggauaacccugaaauugaggacgauaucuuucggaaaaagagacugacgauuauggaccuucaucccggggccggaaaaaccaagcgcuaccugccugcuaucgugcgggaagccauuaaaagaggccugcgcacacucauccuggcuccgacccgggucguggccgcggagauggaagaggcccuuagagggcugcccauucgcuaucaaaccccugcuaucaagacagagcacacgggacgggaaaucguugaccucaugugucaugccaccuucacaaugagacugcucagccccgugcgggucccuaacuacaaucugauuaucauggaugaggcucacuucaccgaccccgccuccauugccgcucgcggcuauaucucuacaagaguggaaaugggggaggcggccggcauuuuuaugaccgcuacgccgccuggaagccgggaucccuucccccaguccaacgccccuaucauggacgaggaacgcgagauccccgaaagaagcuggaacucuggccacgaguggguuacagauuuuaaggggaaaaccgugugguucgucccuuccauuaaggccggaaacgacaucgcugccugccuucggaaaaauggcaagaaagugauucagcugagcagaaagaccuuugauucugaauacguuaagacacgcgcgaacgacugggauuucguggucaccacagacaucagcgagaugggggcuaauuuuaaagccgagcgggugauugauccgagacgcuguaugaagcccgugauccugaccgacggagaagaacgggucauccucgccggcccuaugcccguuacgcauuccucugcugcccaaagacgcgggcggauuggcagaaacccuaaaaaugaaaacgaccaguauaucuacaugggagagccccuggaaaaugaugaggacugcgcgcacuggaaggaggccaaaaugcuucuggauaacauuaauacaccggaaggcaucauuccuagcauguucgagcccgaacgcgagaagguggacgcuaucgauggggaauacagacuccggggagaggcccgcaaaaccuuuguggaccugaugagacggggcgaucugccugucuggcucgcuuauaagguggccgcugaggggauuaacuacgccgaccgcaagugguguuucgauggaaucaaaaauaaccagauccuugaagagaacauggaaguugagauuuggacaaaggagggcgaacgcaagaagcugaaaccccgguggcuggacgcgagaaucuauuccgauccucucgcccugaaggaguuuaaggaguucgcugccgggcgcaaaucucuuacccugaaucucauuacggagaugggccggcugcccaccuucaugacacagaaggcuagaaacgcccuggacaaucucgccgugcuucauaccgcugaagcgggaggccgcgccuacaaccacgcucugagcgagcugccggagacacucgaaacccugcuucugcucacacugcuggccaccgucacagggggaaucuuucucuuccuuauguccggcaaagggauuggaaagaugacacugggcaugugcugcaucaucaccgccagcauucugcucugguaugcucaaauccagccucacuggauugccgcgucuaucauucuggaguuuuuccuuaucgugcugcucauccccgaacccgagaaacagcggaccccucaggauaaucaacugacauacguugugauugccauccugaccgucguggcugccacaauggcuaacgaaaugggcuuucucgagaagacgaagaaagaccuugggcugggauccauuaccacacaggagagcgaauccaauauccuggacauugaucucagaccggccucugcguggacccuguaugccgucgcuacaaccuucgugacgcccaugcuucggcauagcaucgagaacuccucuguuaaugugagccugaccgccauugcuaaccaggccacagugcucaugggccuggggaagggauggccucuguccaaaauggacaucggcgucccccuccuugcuaucggguguuacagccagguuaauccuauuacccugacagccgcgcugcuccugcuuguggcccacuacgcuaucauuggacccggccugcaagccaaggcuacccgcgaagcccagaaaagagccgcggcuggcaucaugaagaacccuacgguggaugggauuacagucaucgaccucgagccgauccccuaugauccuaaguuugaaaaacagcugggacaggugaugcugcucauucuuugcguuacccaagugcugaugaugcggacaaccugggcccugugugaggcucucacccuggccacaggccccaucucuacgcuuugggaggggaauccuggacgcuucuggaacaccacaauugccgucuccauggcuaauaucuuuagaggcagcuaccuggccggggcgggacuccuguucucuauuaugaagaacaccacaaauacccggcgcggcacgggcaacaucggggaaacacugggagagaaauggaaguccagacucaacgcccuuggcaaaagcgaauuucagaucuauaagaaaucugggauucaggagguggaccggacccuggcuaaggagggaaucaagcgcggcgaaaccgaucaucacgccgucagcagaggguccgcuaaacugcggugguucguggagagaaauaugguuacacccgaaggaaagguggucgaccucggcugcggccgcgggggauggucuuacuauuguggcgggcugaaaaacgugcgggagguuaagggacuuaccaaaggcgggccgggacaugaggaaccuauucccaugagcacauacggcuggaaucuggugagacuccaauccggcgucgauguguuuuucacgcccccugagaagugcgacacccugcugugugauaucggggaaagcucccccaacccuacaauugaggccggacgcacccuccgggugcuuaaucugguugaaaacuggcugaauaacaauacacaguucugcaucaagguccucaacccguauaugcccucugugaucgagaaaauggaagcgcugcagagaaaguacggcggggcccuugugcgcaauccucugagccggaacuccacccacgagauguacugggucucuaaugcuacgggaaacauuguuagcuccgugaauaugaucucuagaaugcucauuaaccgcuuuaccaugaaacacaagaaagccacauaugagcccgacguggaucugggcagcgggacccggaacaucggaauugaauccgaggucccuaaucuggacaucauuggcaagagaaucgaaaagaucaaacaggagcaugaaacaagcuggcacuacgaccaagaucaucccuauaagaccugggcuuaccacggcucuuaugagacaaaacagaccggguccgccagcucuauggugaacggaguugugcgccuccuuacgaagccgugggacgucgugccuaugguuacacagauggcuaugaccgauaccacacccuucggccagcaacggguguuuaaagagaaggucgacacgagaacccaggaaccuaaggaggggaccaagaagcugaugaaaauuaccgccgaauggcuguggaaggagcucggcaagaagaaaacaccccgcauguguaccagagaggaguucacacggaaggugcgcuccaaugcggcccugggcgcuaucuuuaccgaugagaacaaguggaaaagcgccagagaagcuguggaggacgggcgguucugggaacuugucgauagagagcggaaucugcaccucgagggaaagugcgaaacguguguuuacaacaugaugggcaaacgcgagaagaaacugggcgaauuugggaaggccaagggaucuagagccauuugguauauguggcugggcgcgcgguuccucgaguuugaagcucugggguuccuuaaugaggaccauugguuuucccgcggaaacagccuguccggcguggagggggaaggccuccacagacugggauacauccuucgggaugugggcaaaaaggaagggggagccauguacgccgacgauaccgcuggcugggacacacgcauuacccuggaagaccucaaaaaugaggaaauggucacaaaccauaugaagggggagcacaaaaagcuggccgaggcuaucuucaagcugaccuaucagaauaaagugguuagagugcagcggccuacgccccgcggaacagucauggauaucauuagcagacgggaccaacgcggcucuggacaggugggcaccuacggacucaacacauuuaccaauauggaagcccagcugaucagacaaauggagggcgaagggauuuucaagagcauccagcaucuuacggcgaccgaggagauugccguucagaacuggcuggcucgggugggacgcgaaagacucucccggauggccaucucuggcgaugacugcgucgugaaaccgaucgaugacagauucgcuagcgcccugacagcgcuuaaugauauggggaagguucgcaaagacauucagcaaugggagccuucccggggauggaacgauuggacccaggugcccuuuugcucucaccacuuccaugaacuggucaugaaggacggcagagugcucgucgugcccugucgcaaccaggaugagcugaucgggcgggccagaauuagccagggcgcuggauggucccugaaggaaacagccugccucggcaaaucuuaugcucaaauguggacccugauguacuuucaccgccgggaccuuagacuggccgcuaaugccaucuguagcgcgguuccuccgcauugggugcccacaucccgcaccacguggagcauucacgccaagcacgaguggaugacaaccgaggauaugcucgcugucuggaaccggguguggauccaggaaaauccuuggauggaggacaaaacccccguggaaucuugggaggaaguuccuuaucuggggaagagagaggaccaguggugcggaucccuuauuggccugacaagccgcgccaccugggccaaaaacauccagacagcuaucaaucaagugcggucucucauugggaacgaggaauacacggauuauaugcccuccaugaagagauuccggagagaggaagaggaagccggaguccugugguga

SEQ ID NO: 19789 - RNA, 9876 nt, Artificial Sequence
  derived and/or modified CDS sequence (opt5) from DENV-2__FJ850065__SS-prME
accgccggagugaucgucaugcugauucccacagcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcacagaagcuaagcucaccaacaccacaaccgagagccgguguccgacacaaggagagcccucucugaaugaggaacaggacaaacgcuuuauuugcaagcauuccaugguggauagaggcuggggcaacggguguggacuguucggcaaagggggaaucgucacgugcgccauguuuaccugcaaaaagaauauggaaggcaaaguugugcagccugagaaccucgaauacacaauugugaucacaccccacagcggggaggagcaugcggucggaaaugacacaggcaagcacggcaaagaaauuaagaucaccccucagucuuccaucacggaggccgaacugaccggguauggaacagugaccauggaguguagcccccggacaggccuugauuucaacgaaaugguucugcuccaaauggaggacaaggcuuggcuggugcaccgccagugguuucuugaucugccgcucccuuggcugcccggggccgacacccagggaucuaauuggauucagaaggagacgcuggucacauucaagaacccucaugcuaaaaagcaagacgugguugugcucggcucccaggaaggggccaugcacaccgcccugacaggcgcuaccgagauccagaugagcuccggaaaucuucuguuuaccggccaucucaaaugcagacugcggauggauaaacuucaacugaaagggaugucuuacagcauguguacaggaaaguucaagauugucaaagaaaucgcggagacgcagcacggcaccauugugaucagaguccaguaugagggggacggaucccccugcaagauccccuucgaaauuacagaucucgagaaacgccaugugcugggccggcugaucaccguuaacccuauugugacagaaaaggacagcccggucaacaucgaggccgaacccccuuuuggggauucuuacauuaucauuggcguggagcccggacagcucaaacugaauugguucaagaagggcuccagcaucgggcaaauguuugagaccacgaugagaggagcuaaacgcauggccauccuuggcgacacagccugggauuucgggucucugggaggcguuuuuaccagcauugggaaggcucuccaccagguguucggcgccaucuacggagcggcuuuuuccggcgucucuuggaccaugaaaauucugaucggggugauuaucacauggaucggaaugaacagccgguccaccagccugucugugucccuuguucucgucggcguggugacacuguaucugggggccaugguccaggccgacagcggaugugugguuucuuggaagaauaaagaacucaagugcggcuccgggauuuucaucacggauaacgugcacaccuggacagagcaguacaaguuucaaccugaaagccccuccaaacuggcuucugccauucagaaggcucaugaggaaggcaucuguggaauuagaagcgucacccgccuugagaaucugauguggaaacagaucacaccggagcucaaccacauccuguccgaaaaugaggugaagcugaccauuaugacgggcgacaucaaagggauuaugcaggccggaaagcggucucuuagaccucaacccaccgaacucaaauauagcuggaagacauggggcaaggcgaaaaugcuguccaccgagagccauaaccagacauuccugaucgaugggccugaaaccgccgagugccccaauacaaaccgcgcuuggaacucucucgagguugaagacuacggauuuggcguguucaccacgaacauuuggcugaaacuucgggagaaacaggacgucuuuugugauuccaagcugaugagcgccgcuaucaaagacaauagagccgugcacgcggauaugggcuauuggaucgaaucugcccucaacgacacauggaagauggagaaggcuuccuucauugagguuaaaagcugccacuggccuaagucucauacccuguggagcaauggggugcuggaauccgagaugaucauucccaaaaacuucgccggaccggucagccagcacaacuaccgcccuggcuaucauacccaaacagcugggcccuggcaccuuggaaagcucgaaauggauuuugaccugugugagggcaccacggugguggucacagaagauugcgggaaucggggacccucucugagaaccacaaccgccuccggcaaacucaucacagaguggugcugucggagcugcacccugccuccgcuucgcuacagaggcgaggacggguguugguacggaauggaaauucggccccugaaggagaaggaagagaaccucguuaauucccuggugacggccggccaugggcagaucgauaacuucucucugggagugcuuggcauggcucucuuucuggaagagaugcugagaacccgcauugggacaaaacacgcgauccuccuggucgccgugagcuucguuacccuuaucacaggaaauauguccuuucgggaccugggcagagugauggucauggugggcgcuaccaugacggaugacauugggaugggaguuacauaucucgcccugcuggccgcuuucaaggugcgcccuaccuuugccgcgggccuucugcucagaaaacugacaucuaaggagcucaugauggcuaccaucgggauugcccugcuuagccaguccaccauccccgaaacaauucuggagcucacggaugcccuggcucugggaaugaugguccuuaaaaucgugcggaacauggaaaaguaccaacuggccguuaccaucauggcgauuucuugcgugccuaaugcugucauccuccagaacgccuggaaggugagcuguacaauucuggccgcuguguccgucagcccccuccugcuuaccucuucccagcagaaagccgacuggaucccucuggcucucacaauuaagggccugaaucccaccgccaucuuccugacgacacuuagccgcaccucuaaaaagagauccuggccgcugaacgaggcgaucauggccguugggauggugagcauucucgcuucuucccugcucaaaaaugacaucccuaugaccggaccccugguggccggcggccuucugacagucugcuaugugcugaccgggcggagcgcugaucucgaacuggagcgcgccgccgacguuaagugggaggaucaagcugaaauuuccggaagcucuccuauccuuagcauuacaaucuccgaggacggcucuaugagcauuaaaaacgaagaggaggaacagacgcugaccauccucaucagaacagggcugcucgugauuuccggagucuuucccgugucuaucccgauuaccgcggccgcuugguaccugugggagguuaagaagcagcgggccggcgugcuuugggaugucccuucucccccucccguggaaaaagccgagcuggaagacggggcuuaucgcaucaagcagagaggcauucugggauacucccaaaucggcgccggggucuauaaagagggaacauuccacaccauguggcaugugacgcggggcgcgguucucaugcaccgcgggaagagaaucgagcccuccugggcugaugugaaaaaggaccugauuagcuacggaggcggguggaaacuugaaggagaguggaaagaaggcgaggaaguccaggugcuggcccucgagccuggcaagaauccgcgggccguucagaccaaacccgggaucuuuaagacaaacaccggaacaauuggcgcugugucccuggauuucagcccugggaccucuggaucccccaucgucgacagaaaaggcaaggugguggggcucuacggaaauggcguugucacacgcagcggcgccuaugugucugcgauugcucagacggagaaguccaucgaagauaacccugagaucgaagaggacauuuuucggaaaaagagacugaccaucauggaucuucaucccggggccggaaaaacaaagcgcuaccugccugccauugugcgggaagcuaucaaaagaggccugcgcacccucauucuggccccgacccgggucguggcugccgagauggaggaagcgcuuagagggcugcccauccgcuaucaaaccccugccauuaagacggagcacaccggacgggaaaucguugaccucaugugucaugcuacauucaccaugagacugcucagccccgugcgggucccuaacuacaaucugaucauuauggacgaggcccacuucacagaucccgcuuccaucgccgcccgcggcuauauuucuaccagaguggagaugggggaagcugcgggcaucuuuaugacggccacaccgccuggaagccgggaccccuucccccaguccaacgcuccuauuauggaugaggaacgcgagauccccgaaagaagcuggaacucuggccacgaguggguuaccgacuuuaaggggaaaaccgugugguucgucccuuccaucaaggccggaaacgauauugccgcuugccuucggaaaaauggcaagaaagugauccagcugagcagaaagacauuugacucugaguacguuaagacccgcgccaacgauugggacuucguggucacaaccgauauuagcgaaaugggggcgaauuuuaaagcugagcgggugaucgacccgagacgcuguaugaagcccgugauucugacggauggagaagaacgggucauccucgccggcccuaugcccguuacacauuccucugccgcucaaagacgcgggcggaucggcagaaacccuaaaaaugaaaacgaccaguauauuuacaugggagagccccuggagaaugacgaagauugcgcccacuggaaggaggcgaaaaugcuucuggacaacaucaauaccccggaaggcauuaucccuagcauguucgagcccgaacgcgagaagguggaugccauugacggggaguacagacuccggggagaagcucgcaaaacauuuguggaucugaugagacggggcgaccugccugucuggcucgccuauaagguggcugccgaggggaucaacuacgcugaucgcaagugguguuucgacggaauuaaaaauaaccagauccuugaagagaacauggagguugaaaucuggaccaaggagggcgaacgcaagaagcugaaaccccgguggcuggaugccagaauuuauuccgacccucucgcgcugaaggaguuuaaggaguucgccgcugggcgcaaaucucuuacgcugaaucucaucaccgagaugggccggcugcccacauucaugacccagaaggccagaaacgcucuggauaaucucgccgugcuucauacagccgaggcuggaggccgcgcguacaaccacgcccugagcgaacugccggagacccucgaaacacugcuucugcucacccugcuggcuacggucacagggggaauuuuucucuuccuuauguccggcaaagggaucggaaagaugacccugggcaugugcugcauuaucaccgccagcauccugcucugguaugcccaaauucagccucacuggaucgcugccucuauuauccuggaguuuuuccuuauugugcugcucauccccgaacccgagaaacagcggacaccucaggacaaucaacugaccuacguugugaucgcgauucugacagucguggccgcuacgauggccaacgagaugggcuuucucgaaaagaccaagaaagaucuugggcugggauccaucacaacccaggagagcgaauccaauauucuggacaucgaccucagaccggcuucugccuggacacuguaugcggucgccaccacguucgugacccccaugcuucggcauagcauugagaacuccucuguuaaugugagccugacagcuaucgccaaccaggcuaccgugcucaugggccuggggaagggauggccucuguccaaaauggauauuggcgucccccuccuugccaucggguguuacagccagguuaauccuaucacacugaccgcugcccugcuccugcuuguggcgcacuacgccauuaucggacccggccugcaagcuaaggccacgcgcgaagcucagaaaagagccgccgcgggcauuaugaagaacccuacaguggacgggaucaccgucauugaucucgagccgauccccuaugacccuaaguuugagaaacagcugggacaggugaugcugcucauccuuugcguuacacaagugcugaugaugcggaccaccugggcucugugugaagcccucacacuggcuacgggccccauuucuacccuuugggaggggaauccuggacgcuucuggaacacaaccaucgccgucuccauggccaauauuuuuagaggcagcuaccuggcuggggccggacuccuguucucuaucaugaagaacacaaccaauacgcggcgcggcacaggcaacauuggggaaacccugggagagaaauggaaguccagacucaacgcgcuuggcaaaagcgaguuucagaucuauaagaaaucugggauccaggaaguggaucggacccuggccaaggagggaauuaagcgcggcgaaacagaccaucacgcugucagcagaggguccgccaaacugcggugguucguggagagaaauaugguuacccccgaaggaaagguggucgaucucggcugcggccgcgggggauggucuuacuauuguggcgggcugaaaaacgugcgggagguuaagggacuuacaaaaggcgggccgggacaugaggaaccuauccccaugagcacguacggcuggaaucuggugagacuccaauccggcgucgacguguuuuucacacccccugagaagugcgauacccugcugugugacauuggggaaagcucccccaacccuaccaucgaggcuggacgcacacuccgggugcuuaaucugguugaaaacuggcugaauaacaauacccaguucugcauuaagguccucaacccguauaugcccucugugaucgagaaaauggaggcccugcagagaaagcacggcggggcgcuugugcgcaauccucugagccggaacuccacgcacgaaauguacugggucucuaaugccaccggaaacaucguuagcuccgugaauaugauuucuagaaugcucaucaaccgcuuuacaaugaaacauaagaaagcuaccuacgagcccgauguggaccugggcagcgggacacggaacauuggaaucgaauccgagauuccuaaucuggauaucauuggcaagagaaucgaaaagaucaaacaggagcacgagaccagcuggcauuaugaccaagaccaccccuacaagacaugggccuaucacggcucuuacgaaaccaaacagacgggguccgcuagcucuauggucaacggagugguucgccuccuuacaaagccgugggauguggucccuauggugacccagauggccaugaccgacacaacgcccuucggccagcaacggguuuuuaaagagaagguggauaccagaacacaggaaccuaaggaggggaccaaaaagcugaugaaaauuacagcugaguggcuguggaaggaacucggcaagaagaaaacccccagaauguguacaagagaggaguucacccggaagguccgcuccaaugccgcgcugggcgccaucuuuacggacgagaacaaguggaaaagcgcuagagaagccguggaggaugggcgguucugggagcuuguggacagagaacggaaucugcaucucgagggaaagugcgaaaccugugucuauaacaugaugggcaaacgcgagaagaaacugggcgaauuugggaaggcuaagggaucuagagccauuugguacauguggcugggcgcccgguuccucgaguuugaggcgcugggguuccuuaaugaagaucacugguuuucccgcggaaacagccuguccggcguugagggggaaggccuccauagacugggauauauccuucgggacgugggcaaaaaggaagggggagcuauguacgccgaugacacagccggcugggauacccgcauuacacuggaagaccucaaaaaugaggagauggugaccaaccacaugaagggggaacauaaaaagcuggcugaggccaucuucaagcugacguaccagaauaaagucgugagaguucagcggccuacaccccgcggaaccgugauggacaucauuagcagacgggaucaacgcggcucugggcaggucggcacauauggacucaacaccuuuacgaauauggaagcucagcugaucagacaaauggagggcgaggggauuuucaagagcauccagcaccuuaccgccacagaagagauugcggugcagaacuggcuggcccggguuggacgcgaaagacucucccggauggcuaucucuggcgacgauugcguggucaaaccgaucgacgauagauucgccagcgcucugaccgcccuuaaugacauggggaaggugcgcaaagauauucagcaaugggagccuucccggggauggaacgacuggacacagguucccuuuugcucucaccauuuccacgaacuggugaugaaggauggcagaguccucgugguccccugucgcaaccaggacgagcugaucgggcgggcgagaauuagccagggcgccggauggucccugaaggagaccgcuugccucggcaaaucuuacgcccaaauguggacacugauguauuuucaucgccgggaucuuagacuggcugccaaugcuaucuguagcgccgugccuccgcacuggguucccaccucccgcacgacauggagcauucacgcgaagcaugaauggaugaccaccgaggacaugcucgccguguggaaccgggucuggauccaggaaaauccuuggauggaggauaaaacacccguggaaucuugggaggaggugccuuaccuggggaagagagaagaccaguggugcggaucccuuauuggccugaccagccgcgcuacaugggccaaaaacauccagacggccaucaaucaaguucggucucucauugggaacgaggaauauaccgacuacaugcccuccaugaagagauuccggagagaggaagaggaggcuggagugcugugguga

SEQ ID NO: 19790 - RNA, 9876 nt, Artificial Sequence
  derived and/or modified CDS sequence (opt5) from DENV-2__FJ873808__SS-prME
accgccggcgugaucgucaugcugauucccaccgcuauggccuuccaccucacgaccagaaauggggagccucauaugaucguuggacggcaggaaaagggcaagagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaagauucgcccuacauuugccgcgggccuucugcucagaaaacugaccucuaaggagcucaugauggcuacaaucgggauugcccugcuuagccaguccaccauccccgaaaccauccuggagcucacagaugcccuggcucugggaaugauggugcuuaaaauuguccggaacauggaaaaguaccaacuggccgugacgaucauggcgauuucuugcguuccuaaugcugugauccuccagaacgccuggaaggucagcugugccauucuggcugccguguccgugagcccccuccugcuuaccucuuccaaacagaaggcugacuggaucccucuggcccucacaaucaaaggccugaaucccaccgcgauuuuccugacaacccuuagccgcacgucuaagaaaagauccuggccgcugaacgaggccgucauggcuguugggauggugagcauccucgccucuucccugcucaagaaugacauuccuaugacaggaccccugguggcuggcggccuucugaccgucugcuaugugcugaccgggcggagcgccgaucucgaacuggagcgcgccgcugacguuaaaugggaggaucaggcggaaaucuccggaagcucuccuauucuuagcaucacaauuuccgaggacggcucuaugagcaucaagaacgaagaggaggaacaaacccugacaauccucauuagaacggggcugcucgugaucuccggagucuuucccgugucuauuccgaucaccgccgcugccugguaccugugggagguuaagaaacagcgggccggcgugcuuugggaugucccuucucccccucccguggaaaaggcugagcuggaagacggggccuaucgcauuaaacagagaggaauccugggcuacucccagaucggcgcgggggucuauaaggagggaacauuccacaccauguggcaugugacacggggcgcuguucucaugcaccgcgggaaaagaauugagcccuccugggccgaugugaagaaggaccugaucagcuacggaggcggguggaaacuugaaggagaguggaaggaaggcgaggaaguccaagugcuggcccucgagccuggcaaaaauccgcgggcuguucagaccaagcccgggauuuuuaaaacgaacaccggaacaaucggcgccgugucccuggauuucagcccugggaccucuggaucccccauugucgacagaaagggcaaggugguggggcucuacggaaauggcguugucacacgcagcggcgcguaugugucugcuaucgcccagaccgagaaauccaucgaagauaacccugagauugaagacgauaucuuucggaagaaaagacugacaauuauggaccuucaucccggggccggaaagacgaaacgcuaccugccugcuaucgugcgggaggccauuaagagaggccugcgcacccucauccuggcuccgacacgggucguggccgcggaaauggaggaggcccuuagagggcugcccauucgcuaucagaccccugcuaucaagaccgaacacacaggacgggagaucguugaccucaugugucaugccacguucaccaugagacugcucagccccgugcgggucccuaacuacaaucugauuaucauggaugaagcucacuucacagaccccgccuccauugccgcucgcggcuauaucucuaccagaguggagaugggggaggcggccggcauuuuuaugacagcuaccccgccuggaagccgggaucccuucccccaauccaacgccccuaucauggacgaagaacgcgaaauccccgagagaagcuggaacucuggccacgaauggguuacggauuuuaaagggaagacagugugguucgucccuuccauuaaagccggaaacgacaucgcugccugccuucggaagaauggcaaaaaggugauucagcugagcagaaagaccuuugauucugaguacguuaaaacccgcgcgaacgacugggauuucguggucacaaccgacaucagcgagaugggggcuaauuuuaaggccgaacgggugauugauccgagacgcuguaugaaacccgugauccugacagacggagaggaacgggucauccucgccggcccuaugcccguuacccauuccucugcugcccagagacgcgggcggauuggcagaaacccuaagaaugagaacgaccaauauaucuacaugggagaaccccuggagaaugaugaggacugcgcgcacuggaaagaagccaagaugcuucuggauaacauuaauacgccggagggcaucauuccuagcauguucgaacccgagcgcgaaaaaguggacgcuaucgauggggaguacagacuccggggagaggcccgcaagacauuuguggaccugaugagacggggcgaucugccugucuggcucgcuuauaagguggccgcugaagggauuaacuacgccgaccgcaaaugguguuucgauggaaucagaaauaaccagauccuugaggaaaacauggagguugagauuuggaccaaggaaggcgagcggaaaaagcugaaacccagauggcuggacgcgcgcaucuauuccgauccucucgcccugaaggaauuuaaggaguucgcugccgggcggaaaucucuuacacugaaucucauuaccgaaaugggcaagcugcccacguucaugacccagaaagcuagaaacgcccuggacaaucucgccgugcuucauacagcugaggcgggaggccgcgccuacaaccacgcucugagcgagcugccggaaacccucgagacacugcuucugcucacccugcuggccacagucaccgggggaaucuuucucuuccuuauguccggcaaggggauuggaaaaaugacgcugggcaugugcugcaucaucacagccagcauucugcucugguaugcucagauccaaccucacuggauugccgcgucuaucauucuggaauuuuuccuuaucgugcugcucauccccgagcccgaaaagcagcggaccccucaggauaaucagcugaccuacguugugauugccauccugacagucguggcugccaccauggcuaacgagaugggcuuucucgagaagaccaagaaggaccuugggcugggauccauuacgacccaagaaagcgaguccaauauccuggacauugaucucagaccggccucugcguggacacuguaugccgucgcuaccacauucgugacccccaugcuucggcauagcaucgaaaacuccucuguuaaugugagccugacggccauugcuaaccaggccaccgugcucaugggccuggggaaaggauggccucuguccaagauggacaucggcgucccccuccuugcuaucggguguuacagccagguuaauccuauuacacugaccgccgcgcugcuccugcuuguggcccacuacgcuaucauuggacccggccugcaggccaaagcuacacgcgaggcccaaaagagagccgcggcuggcaucaugaagaacccuaccguggaugggauuacggucaucgaccucgaaccgauccccuaugauccuaaauuugagaagcagcugggacaggugaugcugcucauucuuugcguuacacaggugcugaugaugcggaccacaugggcccugugugaggcucucacccuggccaccggccccaucucuacacuuugggaagggaauccuggacgcuucuggaacacgaccauugccgucuccauggcuaauaucuuuagaggcagcuaccuggccggggcgggacuccuguucucuauuaugaaaaacacaaccaauacacggcgcggcaccggcaacaucggggagacgcugggagaaaaguggaaauccagacucaacgcccuuggcaagagcgaguuucaaaucuauaaaaagucugggauucaggagguggaccggacacuggcuaaggaaggaaucaaacgcggcgagaccgaucaucacgccgucagcagaggguccgcuaagcugcggugguucguggaaagaaauaugguuacccccgagggaaaaguggucgaccucggcugcggccgcgggggauggucuuacuauuguggcgggcugaagaacgugcgggaaguuaaaggacuuacaaagggcgggccgggacaugaggagccuauucccaugagcaccuacggcuggaaucuggugagacuccaguccggcgucgauguguuuuucacacccccugaaaagugcgacacgcugcugugugauaucggggagagcucccccaacccuaccauugaagccggacgcacacuccgggugcuuaaucugguugagaacuggcugaauaacaauacccaauucugcaucaaaguccucaacccguauaugcccucugugaucgaaaagauggaggcgcugcagagaaaauacggcggggcccuugugcgcaauccucugagccggaacuccacacacgagauguacugggucucuaaugcuaccggaaacauuguuagcuccgugaauaugaucucuagaaugcucauuaaccgcuuuacgaugaagcacaaaaaggccaccuaugaacccgacguggaucugggcagcgggacacggaacaucggaauugaguccgaaaucccuaaucuggacauuaucggcaagagaaucgagaaaauuaagcaggaacaugagaccagcuggcacuacgaccaggaucaucccuauaaaacaugggcuuaccacggcucuuaugagaccaagcaaacaggguccgccagcucuauggucaacggagugguucgccuccuuaccaaaccgugggacguggucccuauggugacgcagauggcuaugacagauaccacccccuucggccagcagcggguuuuuaaggaaaagguggacacaagaacgcaagagccuaaagaagggaccaagaaacugaugaagaucacagccgaguggcuguggaaagagcucggaaagaaaaagacaccccgcauguguacaagagaagaguucacccggaagguccgcuccaaugcggcccugggcgcuauuuuuacagaugaaaacaaauggaaaagcgccagagaggcuguggaagacgggcgguucugggagcuuguggauagagagcggaaucugcaccucgaaggaaaaugcgagaccugugucuacaacaugaugggcaagcgcgagaagaagcugggcgaguuugggaaggccaaaggaucuagagccaucugguauauguggcugggcgcgcgguuccucgaauuugaggcucugggguuccuuaaugaggaccauugguuuucccgcggaaacagccuguccggcguugaaggggagggccuccacagacugggauacauucuucgggaugugggcaagaaagaagggggagccauguacgccgacgauacggcuggcugggacacccgcaucacacuggaggaccucaagaaugaagagauggugaccaaccauaugaaaggggagcacaagaagcuggccgaagcuaucuucaaacugacauaucagaauaaggucgugagaguucagcggccuacaccccgcggaacggugauggauauuaucagcagacgggaccagcgcggcucugggcaagucggcacauacggacucaacaccuuuacaaauauggaggcccagcugauuagacagauggaaggcgaggggaucuucaaaagcauucaacaucuuaccgcgacggaggaaaucgccgugcagaacuggcuggcucggguuggacgcgagagacucucccggauggccaucucuggcgaugacugcguggucaagccgauugaugacagauucgcuagcgcccugaccgcgcuuaaugauauggggaaagugcgcaaggacauccagcagugggaaccuucccggggauggaacgauuggacacaaguucccuuuugcucucaccacuuccaugagcuggugaugaaggacggcagaguccucgugguccccugucgcaaccaggaugaacugauugggcgggccagaaucagccagggcgcuggauggucccugaaagagaccgccugccucggcaagucuuaugcucagauguggacacugauguacuuucaccgccgggaccuuagacuggccgcuaaugccauuuguagcgcggugccuccgcauuggguucccaccucccgcacaaccuggagcauccacgccaaacacgaguggaugacgacagaagauaugcucgcuguguggaaccgggucuggauucaagggaauccuuggauggaggacaagacccccguggaaucuugggaggaagugccuuaucugggaaaaagagaggaccaguggugcggcucccuuaucgggcugaccagccgcgccacaugggccaagaacauccagaccgcuauuaaucagguucggucucucaucggaaacgaggaauacacagauuauaugcccuccaugaagagauuccggagagaggaagaggaagccggcgugcugugguga

SEQ ID NO: 19791 - RNA, 9876 nt, Artificial Sequence
  derived and/or modified CDS sequence (opt5) from DENV-2__FJ850120__SS-prME
acagccggagugaucgugaugcugauucccacggcuauggccuuccaccucacgaccagaaacggggagccucauaugaucguuggacggcaggaaaagggaaaaagccugcuuuuuaagacagaggacggggugaauaugugcacccugauggcgauugaucucggagaacugugugaggacacaaucaccuacaaaugcccgcuucugagacaaaacgaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccgugaccgaggccgaacugacgggguauggaaccguuacaauggaguguagcccccggaccggccuugauuucaacgaaauggugcugcuccaaauggaggacaaggcuuggcugguccaccgccagugguuucuugaucugccgcucccuuggcugcccggggccgacacacagggaucuaauuggauucagaaggagacccuggugacguucaagaacccucaugcuaaaaagcaagacguugugguccucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgauugucaucagagugcaguaugagggggacggaucccccugcaagauccccuucgaaauuaccgaucucgagaaacgccauguucugggccggcugaucacagugaacccuauugucaccgaaaaggacagcccggugaacaucgaggccgaacccccuuuuggggauucuuacauuaucauuggcguugagcccggacagcucaaacugaauugguucaagaagggcuccagcaucgggcaaauguuugagacaaccaugagaggagcuaaacgcauggccauccuuggcgacacggccugggauuucgggucucugggaggcguguuuacaagcauugggaaggcucuccaccaggucuucggcgccaucuacggagcggcuuuuuccggcgugucuuggaccaugaaaauucugaucggggugauuaucaccuggaucggaaugaacagccgguccacaagccugucuguuucccuuguccucgugggcguggucacccuguaucugggggccauggugcaggccgacagcggauguguugugucuuggaagaauaaagaacucaagugcggcuccgggauuuucaucacagauaacguccacacguggaccgagcaguacaaguuucaaccugaaagccccuccaaacuggcuucugccauucagaaggcucaugaggaaggcaucuguggaauuagaagcgugacacgccuugagaaucugauguggaaacagaucaccccggagcucaaccacauccuguccgaaaaugagguuaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguggaagacuacggauuuggcgucuucacaaccaacauuuggcugaaacuuagagagaagcaggacguguuuugugauuccaaacugaugagcgccgcuaucaaggacaaucgcgccguucacgcggauaugggcuauuggaucgaaucugcccucaacgacacguggaaaauggagaaggcuuccuucauugaggucaagagcugccacuggccuaaaucucauacacuguggagcaaugggguccuggaauccgagaugaucauucccaagaacuucgccggaccggugagccagcacaacuaccggccuggcuaucauacccaaaccgcugggcccuggcaccuuggaaaacucgaaauggauuuugaccugugugagggcacaaccguggucguuacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucgugaauagccuggugaccgccggccaugggcagaucgauaacuucucucugggaguccuuggcauggcucucuuucuggaagagaugcugcgcacgcggauugggaccaagcacgcgauccuccugguggccguuagcuucgugacacuuaucaccggaaauauguccuuuagagaccugggccgcgucauggugaugguuggcgcuacaaugaccgaugacauugggaugggagugacguaucucgcccugcuggccgcuuucaaagucagaccuacauuugccgcgggccuucugcuccggaagcugaccucuaaagagcucaugauggcuacaaucgggauugcccugcuuagccaguccaccauccccgaaaccauucuggagcucacagaugcccuggcucugggaaugauggugcuuaagaucguucgcaacauggaaaaauaccaacuggccgugacgaucauggcgauuucuugcgucccuaaugcugugauccuccagaacgccuggaaggugagcuguaccauucuggccgcugucuccguuagcccccuccugcuuacaucuucccagcagaaggccgacuggaucccucuggcucucaccauuaaaggccugaaucccacagccaucuuccugaccacgcuuagcagaacaucuaagaaacgguccuggccgcugaacgaggcgaucauggccguggggauggugagcauucucgcuucuucccugcucaagaaugacaucccuaugaccggaccccuggucgccggcggccuucugaccgugugcuauguucugacagggcgcagcgcugaucucgaacuggagagagccgccgacgugaaaugggaggaucaagcugaaauuuccggaagcucuccuauccuuagcauuaccaucuccgaggacggcucuaugagcauuaagaacgaagaggaggaacagacacugacgauccucauccggaccgggcugcucgucauuuccggaguguuucccguuucuaucccgauuacagcggccgcuugguaccugugggaggugaaaaagcagcgcgccggcguccuuugggaugugccuucucccccucccgucgaaaaggccaaacuggaggacggggcuuauagaaucaagcagcgggggauucugggcuacucccaaaucggcgccgggguguauaaagaaggaaccuuccacacaauguggcauguuacccgcggcgcggugcucaugcacagagggaagcggaucgagcccuccugggcugaugucaaaaaggaccugauuagcuacggaggcggguggaaacuugagggagaauggaaagagggcgaagaggugcagguucuggcccucgaaccuggcaagaauccgagagccgugcagacgaaacccgggaucuuuaagaccaacacaggaaccauuggcgcugucucccuggauuucagcccugggacaucuggaucccccaucguggaccgcaaaggcaaggugguugggcucuacggaaauggcgucgugacccggagcggcgccuaugugucugcgauugcucagacagagaagaacaucgaggauaacccugaaaucgaggacgauauuuuucgcaagaagcgccugacgaucauggaccuucaucccggggccggaaaaaccaagcgguaccugccugccauugucagagaagcuaucaaacgcggccugcggacacucauucuggccccgaccagagugguugcugccgagauggaagaggcgcuucgcgggcugcccauccgguaucaaaccccugccauuaagacagagcacacgggaagagaaaucguggaccucaugugucaugcuaccuucacaaugcggcugcucucccccguccgcgugccuaauuacaaccugaucauuauggaugaggcccacuucaccgaccccgcuagcaucgccgccagaggcuauauuuccacacggguugaaaugggggaggcugcgggcaucuuuaugaccgccacgccgccuggaucucgcgaucccuucccccagagcaaugcuccuauuauggacgaggaaagagagauccccgaacgguccuggaacagcggccacgagugggugacagauuuuaaggggaaaaccgucugguucgugccuucuaucaaggccggaaaugacauugccgcuugccuucgcaagaauggcaagaaaguuauccagcugucccgcaagaccuuugauagcgaauacgugaagacacgggccaaugacugggauuucgucgugaccacagacauuucugagaugggggcgaacuuuaaagcugagagagugaucgauccgcgccgguguaugaagcccgucauucugaccgacggagaagagagaguuauccucgccggcccuaugcccgugacgcauagcuccgccgcucaacgccgggggagaaucggccgcaauccuaaaaacgaaaaugaccaguauauuuacaugggagagccccuggaaaacgaugaggacugcgcccacuggaaggaggcgaaaaugcuucuggauaauaucaacacaccggaaggcauuaucccuucuauguucgagcccgaaagagagaagguggacgccauugauggggaauaccggcuccgcggagaggcuagaaaaaccuuugucgaccugaugcggcgcggcgaucugccuguguggcucgccuauaagguugcugccgaggggaucaauuacgcugacagaaagugguguuucgauggaauuaaaaacaaccagauccuugaagagaauauggaaguggagaucuggacaaaggagggcgaacggaaaaagcugaaacccagauggcuggacgcccgcauuuauagcgauccucucgcgcugaaggaguuuaaggaguucgccgcugggcggaaaucccuuacccugaaccucaucacggagaugggcagacugcccaccuucaugacacagaaggcccgcaaugcucuggacaaccucgccguccuucauaccgccgaagcuggaggccgggcguacaaucacgcccugucugagcugccggagacacucgaaacccugcuucugcucacacugcuggcuaccgugacagggggaauuuuucucuuccuuaugagcggcaaagggaucggaaagaugacacugggcaugugcugcauuaucaccgccuccauccugcucugguaugcccaaauucagccucacuggaucgcugccagcauuauccuggaguuuuuccuuauuguucugcucauccccgaacccgagaaacagagaaccccucaggauaaccaacugacauacguggucaucgcgauucugaccguggucgccgcuacaauggccaaugaaaugggcuuucucgagaagacgaagaaagaccuugggcugggaucuaucaccacacaggaguccgaaagcaacauucuggacaucgaucuccggccggcuuccgccuggacccuguaugcgguggccacaaccuucguuacgcccaugcuucgccauucuauugagaauagcuccgugaacgugucucugaccgcuaucgccaaucaggcuacaguccucaugggccuggggaagggauggccucugagcaaaauggacauuggcguuccccuccuugccaucggguguuacucccaggugaacccuaucacccugacagcugcccugcuccugcuuguggcgcacuacgccauuaucggacccggccugcaagcuaaggccaccagagaagcucagaaacgggccgccgcgggcauuaugaagaauccuacggucgaugggaucacagugauugaccucgagccgauccccuaugauccuaaguuugaaaaacagcugggacagguuaugcugcucauccuuugcgugacccaaguccugaugaugcgcacaaccugggcucugugugaggcccucacccuggcuacaggccccauuagcacgcuuugggaggggaacccuggaagauucuggaauaccacaaucgccgugucuauggccaacauuuuucggggcuccuaccuggcuggggccggacuccuguucagcaucaugaagaauaccacaaacacccgcagaggcacgggcucuauuggggaaacacugggagagaaauggaagucccggcucaacgcgcuuggcaaaagcgaauuucagaucuauaagaaaucugggauccaggaggucgaccgcacccuggccaaggagggaauuaagagaggcgaaaccgaucaucacgcugugagccggggguccgccaaacugagaugguucguugagcgcaauauggugacacccgaaggaaaggucguggaccucggcugcggccggggaggauggucuuacuauuguggcgggcugaaaaacguuagagaggugaagggacuuaccaaaggcgggccgggacaugaagaaccuauccccaugagcacauacggcuggaaucugguccgccuccaauccggcguggauguguuuuucacgcccccugagaagugcgacacccugcugugugauauuggggaaagcucccccaacccuacaaucgaggcuggacggacccucagaguucuuaaucuggucgaaaacuggcugaauaacaauacacaguucugcauuaaggugcucaacccguauaugcccucugugaucgagaaaauggaagcccugcagcgcaaguacggcggggcgcuuguccggaauccucugagcagaaacuccacccacgagauguacuggguuucuaaugccacgggaaacaucgugagcuccgugaauaugauuucucgcaugcucaucaaccgguuuaccaugaaacacaagaaagcuacauaugagcccgacgucgaucugggcagcgggaccagaaacauuggaaucgaaaaugagauuccuaaccuggacaucauuggcaagcgcaucgaaaagaucaaacaggagcaugaaacauccuggcacuacgaccaagaucaucccuauaagaccugggccuaccacggcagcuaugagacaaaacagaccgggucugcuuccagcauggugaauggaguugugcggcuccuuacgaagccgugggacgucgugccuaugguuacacagauggccaugaccgauaccacacccuucggccagcaaagaguguuuaaagagaaggucgacacgcgcacccaggaaccuaaggaggggaccaaaaagcugaugaaaauuaccgcugaauggcuguggaaggagcucggcaaaaagaaaacacccagaauguguacccgggaggaguucacacgcaaggugagaucuaacgccgcgcugggcgccaucuuuaccgaugagaauaaguggaaauccgcucgggaagccguggaggacagcagauucugggaacuugucgaucgggagcgcaaccugcaccucgaggggaagugcgaaacguguguuuacaauaugaugggaaaaagagagaagaaacugggcgaauuuggcaaggcuaaggggucucgggccauuugguauauguggcugggagcccgcuuccucgaguuugaagcgcugggcuuccuuaacgaggaccauugguuuuccagagggaauagccuguccggaguggagggcgaagggcuccaccggcugggcuacauccuucgcgaugugggcaaaaaggagggcggggcuauguacgccgacgauaccgccggaugggacacaagaauuacccuggaagaccucaaaaacgaggaaauggucacaaaucauaugaagggcgagcacaaaaagcuggcugaggccaucuucaagcugaccuaucagaacaaagugguucgggugcagcgcccuacgcccagagggacagucauggauaucauuagccggcgcgaccaaagaggaucuggccagguggggaccuacggccucaauacauuuaccaacauggaagcucagcugauccggcaaauggagggagaaggcauuuucaagagcauccagcaucuuacggccaccgaggagauugcgguucagaauuggcuggcccgcguggggagagaacggcucuccagaauggcuaucucuggagaugacugcgucgugaaaccgaucgaugaccgcuucgccagcgcucugacagcccuuaacgauaugggcaagguucggaaagacauucagcaaugggagccuuccagaggguggaacgauuggacccaggugcccuuuugcucucaccacuuccaugaacuggucaugaaggacggacgcgugcucgucgugcccugucggaaucaggaugagcugaucggcagagcgcgcauuagccagggggccggcuggucccugaaggaaacagcuugccucggaaaaucuuaugcccaaauguggacccugauguacuuucaccggagagaccuucgccuggcugccaacgcuaucuguagcgccguuccuucccauugggugccgacaagccggaccacguggucuauucacgcgaagcacgaguggaugacaaccgaggauaugcucgccgucuggaauagaguguggauccaggaaaaccccuggauggaggacaaaaccccuguggaauccugggaggaaguucccuaucugggcaagcgcgaggaccaguggugcgggagccuuauuggacugacaucucgggcuaccugggccaaaaauauccagacagccaucaaccaagugagaucccucauuggcaaugaggaauacacggauuauaugccuagcaugaagcgguucagacgcgaggaagaggaagcugggguccugugguga

SEQ ID NO: 19792 - RNA, 9876 nt, Artificial Sequence
  derived and/or modified CDS sequence (opt5) from DENV-2__FJ850121__SS-prME
accgccggagugaucgucaugcugauucccacagcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaaucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucaucggcgucgagcccggacagcucaaacugaauugguucaagaagggcuccagcauugggcaaauguuugagacaaccaugagaggagcuaaacgcauggccauccuuggcgacacggccugggauuucgggucucugggaggcguguuuacaagcauugggaaggcucuccaccagguuuucggcgccaucuacggagcggcuuuuuccggcgugucuuggaccaugaaaauucugaucggggucaucauuaccuggaucggaaugaacagccgguccacaagccugucugugucccuugugcucguuggcgucgugacccuguaucugggggccauggugcaggccgacagcggaugugucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcguuuucacaaccaacaucuggcugaaacuucgggagaaacaggacguguuuugugauuccaagcugaugagcgccgcuauuaaagacaauagagccguccacgcggauaugggcuauuggaucgaaucugcccucaacgacacguggaagauggagaaggcuuccuucauugaggugaaaagcugccacuggccuaagucucauacacuguggagcaaugggguucuggaauccgagaugaucauucccaaaaacuucgccggaccggugagccagcacaacuaccgcccuggcuaucauacccaaaccgcugggcccuggcaccuuggaaagcucgaaauggauuuugaccugugugagggcacaaccgucguggugacggaagauugcgggaaucggggacccucucugagaacaaccacagccuccggcaaacucaucaccgaguggugcugucggagcugcacacugccuccgcuucgcuacagaggcgaggacggguguugguacggaauggaaauucggccccugaaggagaaggaagagaaccucgucaauucccugguuaccgccggccaugggcagaucgauaacuucucucugggagugcuuggcauggcucucuuucuggaagagaugcugagaacgcgcaucgggaccaaacacgugacacuccuggucgcggugagcuucguuacccuuauuacaggaaauauguccuuucgggaccugggcagagugauggucauggugggcgccaccaugacggaugacaucgggaugggaguuacauaucucgcucugcuggccgccuucaaggugcgcccuaccuuugcugccggccuucugcucagaaaacugacaucuaaggagcucaugauggcgaccauugggaucgcucugcuuagccaguccaccauucccgaaacaauccuggagcucacggaugcccuggcccugggaaugaugguccuuaaaaucgugcggaacauggaaaaguaccaacuggcuguuaccauuauggccaucucuugcgugccuaaugcggucauucuccagaacgcuuggaaggugagcuguacaauccuggccgccguguccgucagcccccuccugcuuaccucuucccagcagaaagcugacuggauuccucuggcccucacaaucaagggccugaaucccaccgcuaucuuccugacgacacuuagccgcaccucuaaaaagagauccuggccgcugaacgaggccauuauggcgguugggauggugagcauccucgccucuucccugcucaaaaaugacauuccuaugaccggaccccugguggcuggcggccuucugacagucugcuaugugcugaccgggcggagcgccgaucucgaacuggagcgcgcugccgacguuaagugggaggaucaagccgaaaucuccggaagcucuccuauucuuagcaucacaauuuccgaggacggcucuaugagcaucaaaaacgaagaggaggaacagacgcugaccauccucauuagaacagggcugcucgugaucuccggagucuuucccgugucuauuccgaucaccgcugcggccugguaccugugggagguuaagaagcagcgggcuggcgugcuuugggaugucccuucucccccucccguggaaaaagccgagcuggaagacggggccuaucgcauuaagcagagaggaauccugggcuacucccaaaucggcgcuggggucuauaaagagggaacauuccacaccauguggcaugugacgcggggcgccguucucaugcaccgcgggaagagaauugagcccuccugggcggaugugaaaaaggaccugaucagcuacggaggcggguggaaacuugaaggagaguggaaagaaggcgaggaaguccaggugcuggcucucgagccuggcaagaauccgcgggccguucagaccaaacccgggauuuuuaagacaaacaccggaacaaucggcgccgugucccuggauuucagcccugggaccucuggaucccccauugucgacagaaaaggcaaggugguggggcucuacggaaauggcguugucacacgcagcggcgcuuaugugucugccaucgcgcagacggagaaguccaucgaagauaacccugagauugaagacgauaucuuucggaaaaagagacugaccauuauggaccuucaucccggggcuggaaaaacaaagcgcuaccugccugccaucgugcgggaggccauuaaaagaggccugcgcacccucauccuggcuccgacccgggucguggccgcugaaauggaggaggcccuuagagggcugcccauucgcuaucaaaccccugcgaucaagacggaacacaccggacgggagaucguugaccucaugugucaugccacauucaccaugagacugcucagccccgugcgggucccuaacuacaaucugauuaucauggaugaagcucacuucacagaccccgccuccauugcugcccgcggcuauaucucuaccagaguggagaugggggaggccgcuggcauuuuuaugacggcgacaccgccuggaagccgggaucccuucccccaguccaacgccccuaucauggacgaagagagagaaauccccgagagaagcuggaacucuggccacgaauggguuaccgauuuuaaggggaaaaccgugugguucgucccuuccauuaaggcuggaaacgacaucgccgccugccuucggaaaaauggcaagaaagugauucagcugagcagaaagacauuugauucugaguacguuaagacccgcgcuaacgacugggauuucguggucacaaccgacaucagcgagaugggggccaauuuuaaagcggaacgggugauugauccgagacgcuguaugaagcccgugauccugacggacggagaggaacgggucauccucgcuggcccuaugcccguuacacauuccucugccgcccaaagacgcgggcggauuggcagaaacccuaaaaaugagaacgaccaguauaucuacaugggagaaccccuggagaaugaugaggacugcgcucacuggaaggaagccaaaaugcuucuggauaacauuaauaccccggagggcaucauuccuagcauguucgaacccgagcgcgaaaagguggacgcgaucgauggggaguacagacuccggggagaggcccgcaaaacauuuguggaccugaugagacggggcgaucugccugucuggcucgcuuauaagguggccgcugaagggauuaacuacgccgaccgcaagugguguuucgauggaaucaaaaauaaccagauccuugaggaaaacauggagguugagauuuggaccaaggaaggcgagcgcaagaagcugaaaccccgguggcuggacgcuagaaucuauuccgauccucucgcccugaaggaauuuaaggaguucgcggccgggcgcaaaucucuuacgcugaaucucauuaccgaaaugggccggcugcccacauucaugacccagaaggcuagaaacgcccuggacaaucucgcugugcuucauacagccgaggccggaggccgcgcuuacaaccacgcgcugagcgagcugccggaaacccucgagacacugcuucugcucacccugcuggccacggucacagggggaaucuuucucuuccuuauguccggcaaagggauuggaaagaugacccugggcaugugcugcaucaucaccgcuagcauucugcucugguaugcccaaauccagccucacuggauugccgcuucuaucauucuggaauuuuuccuuaucgugcugcucauccccgagcccgaaaaacagcggacaccucaggauaaucaacugaccuacguugugauugccauccugacagucguggcggccacgauggcuaacgagaugggcuuucucgagaagaccaagaaagaccuugggcugggauccauuacaacccaggaaagcgaguccaauauccuggacauugaucucagaccggccucugcuuggacacuguaugccgucgcgaccacguucgugacccccaugcuucggcauagcaucgaaaacuccucuguuaaugugagccugacagccauugcuaaccaggccaccgugcucaugggccuggggaagggauggccucuguccaaaauggacaucggcgucccccuccuugcuaucggguguuacagccagguuaauccuauuacacugaccgccgcucugcuccugcuuguggcccacuacgcgaucauuggacccggccugcaagccaaggcuacgcgcgaggcccagaaaagagcugccgccggcaucaugaagaacccuacaguggaugggauuaccgucaucgaccucgaaccgauccccuaugauccuaaguuugagaaacagcugggacaggugaugcugcucauucuuugcguuacacaagugcugaugaugcggaccaccugggcgcugugugaggcucucacacuggccacgggccccaucucuacccuuugggaagggaauccuggacgcuucuggaacacaaccauugcugucuccauggccaauaucuuuagaggcagcuaccuggccggggcuggacuccuguucucuauuaugaagaacacaaccaauacgcggcgcggcacaggcaacaucggggagacccugggagaaaaauggaaguccagacucaacgcccuuggcaaaagcgaguuucagaucuauaagaaaucugggauucaggagguggaccggacccuggcgaaggaaggaaucaagcgcggcgagacagaucaucacgccgucagcagaggguccgcuaaacugcggugguucguggaaagaaauaugguuacccccgagggaaagguggucgaccucggcugcggccgcgggggauggucuuacuauuguggcgggcugaaaaacgugcgggaaguuaagggacuuacaaaaggcgggccgggacaugaggagccuauucccaugagcacguacggcuggaaucuggugagacuccaauccggcgucgauguguuuuucacacccccugaaaagugcgacacccugcugugugauaucggggagagcucccccaacccuaccauugaagccggacgcacacuccgggugcuuaaucugguugagaacuggcugaauaacaauacccaguucugcaucaagguccucaacccguauaugcccucugugaucgagaagauggaggcucugcagagaaaguacggcggggcccuugugcgcaauccucugagccggaacuccacgcacgagauguacugggucucuaaugcgaccggaaacauuguuagcuccgugaauaugaucucuagaaugcucauuaaccgcuuuacaaugaaacacaagaaagccaccuaugaacccgacguggaucugggcagcgggacacggaacaucggaauugaguccgaaaucccuaaucuggacauuaucggcaagagaaucgagaagauuaaacaggaacaugagaccagcuggcacuacgaccaagaucaucccuauaagacaugggcuuaccacggcucuuaugagaccaaacagacgggguccgccagcucuauggucaacggagugguucgccuccuuacaaagccgugggacguggucccuauggugacccagauggcuaugaccgauacaacgcccuucggccagcaacggguuuuuaaagaaaagguggacaccagaacacaggagccuaaggaagggaccaaaaagcugaugaaaaucacagccgaguggcuguggaaggagcucggcaagaagaaaacaccccgcauguguacaagagaagaguucacccggaagguccgcuccaaugcugcccugggcgcgauuuuuacggaugaaaacaaguggaaaagcgccagagaggcuguggaagacgggcgguucugggagcuuguggauagagagcggaaucugcaccucgaaggaaagugcgagaccugugucuacaacaugaugggcaaacgcgaaaagaaacugggcgaguuugggaaggccaagggaucuagagcuaucugguauauguggcugggcgcccgguuccucgaauuugaggcccugggguuccuuaaugaggaccauugguuuucccgcggaaacagccuguccggcguugaaggggagggccuccacagacugggauacauucuucgggaugugggcaaaaaggaagggggagcgauguacgcugacgauacagccggcugggacacccgcaucacacuggaggaccucaaaaaugaagagauggugaccaaccauaugaagggggagcacaaaaagcuggccgaagcuaucuucaagcugacguaucagaauaaagucgugagaguucagcggccuacaccccgcggaaccgugauggauauuaucagcagacgggaccaacgcggcucugggcaggucggcacauacggacucaacaccuuuacgaauauggaggcccagcugauuagacaaauggaaggcgaggggaucuucaagagcauucagcaucuuaccgcuacagaggaaaucgccgugcagaacuggcuggcgcggguuggacgcgagagacucucccggauggccaucucuggcgaugacugcguggucaaaccgauugaugacagauucgcuagcgcccugaccgcucuuaaugauauggggaaggugcgcaaagacauccagcaaugggaaccuucccggggauggaacgauuggacacagguucccuuuugcucucaccacuuccaugagcuggugaugaaggacggcagaguccucgugguccccugucgcaaccaggaugaacugauugggcgggccagaaucagccagggcgcgggauggucccugaaggagaccgccugccucggcaaaucuuaugcucaaauguggacacugauguacuuucaccgccgggaccuuagacuggccgcuaaugccauuuguagcgcugugccuccgcauuggguucccaccucccgcacgacauggagcauccacgccaagcacgaguggaugaccaccgaagauaugcucgcgguguggaaccgggucuggauucaggagaauccuuggauggaagacaaaacacccguggagucuugggaagaggugccuuaucuggggaagagagaggaccaguggugcggaucccuuaucggccugaccagccgcgccacaugggcuaaaaacauccagacggccauuaaucaaguucggucucucaucgggaacgaagaguacaccgauuauaugcccuccaugaagagauuccggagagaagaggaagaggccggagugcugugguga

SEQ ID NO: 19793 - RNA, 9876 nt, Artificial Sequence
  derived and/or modified CDS sequence (opt5) from DENV-2__GQ199897__SS-prME
acagccggagugaucgucaugcugauucccacggcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggagggauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaaggugcgcccuacauuugccgcgggccuucugcucagaaaacugaccucuaaggagcucaugauggcuacaauugggaucgcccugcuuagccaguccaccauucccgaaaccauccuggagcucacagaugcccuggcucugggaaugaugguccuuaaaaucgugcggaacauggaaaaguaccaacuggccguuacgauuauggcgaucucuugcgugccuaaugcugucauucuccagaacgccuggaaggugagcuguaccauccuggccgcuguguccgucagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcgauuauggccguugggauggugagcauccucgcuucuucccugcucaaaaaugacauuccuaugaccggaccccugguggccggcggccuucugaccgucugcuaugugcugacagggcggagcgcugaucucgaacuggagcgcgccgccgacguuaagugggaggaucaagcugaaaucuccggaagcucuccuauucuuagcaucaccauuuccgaggacggcucuaugagcaucaaaaacgaagaggaggaacagacacugacgauccucauuagaaccgggcugcucguggucuccggaguguuucccguuucuaucccgauuacagcggccgcuugguaccugugggaggugaagaagcagcgggccggcguccuuugggaugugccuucucccccucccgucgaaaaagccgagcuggaagacggggcuuaucgcaucaagcagagagggauucugggcuacucccaaaucggcgccgggguguauaaagagggaaccuuccacacaauguggcauguuacccggggcgcggugcucaugcaccgcgggaagagaaucgagcccuccugggcugaugucaaaaaggaccugauuagcuacggaggcggguggaaacuugaaggagaguggaaagaaggcgaggaagugcagguucuggcccucgagccuggcaagaauccgcgggccgugcagacgaaacccgggaucuuuaagaccaacacaggaaccauuggcgcugucucccuggauuucagcccugggacaucuggaucccccaucguggacagaaaaggcaaggugguugggcucuacggaaauggcgucgugacccgcagcggcgccuaugugucugcgauugcucagacagagaaguccaucgaagauaacccugagaucgaagacgauauuuuucggaaaaagagacugacgaucauggaccuucaucccggggccggaaaaaccaagcgcuaccugccugccauuguccgggaggcuaucaaaagaggccugcgcacacucauucuggccccgacccgggugguugcugccgaaauggaggaggcgcuuagagggcugcccauccgcuaucaaaccccugccauuaagacagaacacacgggacgggagaucguggaccucaugugucaugcuaccuucacaaugagacugcucagccccguccgggugccuaacuacaaucugaucauuauggaugaagcccacuucaccgaccccgcuuccaucgccgcccgcggcuauauuucuacaagaguugagaugggggaggcugcgggcaucuuuaugaccgccacgccgccuggaagccgggaucccuucccccaguccaacgcuccuauuauggacgaagagagagaaauccccgagagaagcuggaacucuggccacgaaugggugacagauuuuaaggggaaaaccgucugguucgugccuuccaucaaggccggaaacgacauugccgcuugccuucggaaaaauggcaagaaaguuauccagcugagcagaaagaccuuugauucugaguacgugaagacacgcgccaacgacugggauuucgucgugaccacagacauuagcgagaugggggcgaauuuuaaagcugaacgggugaucgauccgagacgcuguaugaagcccgucauucugaccgacggagaggaacggguuauccucgccggcccuaugcccgugacgcauuccucugccgcucaaagacgcgggcggaucggcagaaacccuaaaaaugagaacgaccaguauauuuacaugggagaaccccuggagaaugaugaggacugcgcccacuggaaggaagcgaaaaugcuucuggauaacaucaauacaccggagggcauuaucccuagcauguucgaacccgagcgcgaaaagguggacgccauugauggggaguacagacuccggggagaggcucgcaaaaccuuugucgaccugaugagacggggcgaucugccuguguggcucgccuauaagguugcugccgaagggaucaacuacgcugaccgcaagugguguuucgauggaauuaaaaauaaccagauccuugaggaaaacauggagguggagaucuggacaaaggaaggcgagcgcaagaagcugaaaccccgguggcuggacgccagaauuuauuccgauccucucgcgcugaaggaauuuaaggaguucgccgcugggcgcaaaucucuuacccugaaucucaucacggaaaugggccggcugcccaccuucaugacacagaaggccagaaacgcucuggacaaucucgccguccuucauaccgccgaggcuggaggccgcgcguacaaccacgcccugagcgagcugccggaaacacucgagacccugcuucugcucacacugcuggcuaccgugacagggggaauuuuucucuuccuuauguccggcaaagggaucggaaagaugacacugggcaugugcugcauuaucaccgccagcauccugcucugguaugcccaaauucagccucacuggaucgcugccucuauuauccuggaauuuuuccuuauuguucugcucauccccgagcccgaaaaacagcggaccccucaggauaaucaacugacauacguggucaucgcgauucugaccguggucgccgcuacaauggccaacgagaugggcuuucucgagaagacgaagaaagaccuugggcugggauccaucaccacacaggaaagcgaguccaauauucuggacaucgaucucagaccggcuucugccuggacccuguaugcgguggccacaaccuucguuacgcccaugcuucggcauagcauugaaaacuccucugugaaugugagccugaccgcuaucgccaaccaggcuacaguccucaugggccuggggaagggauggccucuguccaaaauggacauuggcguuccccuccuugccaucggguguuacagccaggugaauccuaucacccugacagcugcccugcuccugcuuguggcgcacuacgccauuaucggacccggccugcaagcuaaggccacccgcgaggcucagaaaagagccgccgcgggcauuaugaagaacccuacggucgaugggaucacagugauugaccucgaaccgauccccuaugauccuaaguuugagaaacagcugggacagguuaugcugcucauccuuugcgugacccaaguccugaugaugcggacaaccugggcucugugugaggcccucacccuggcuacaggccccauuucuacgcuuugggaagggaauccuggacgcuucuggaacaccacaaucgccguguccauggccaauauuuuuagaggcagcuaccuggcuggggccggacuccuguucucuaucaugaagaacaccacaaauacccggcgcggcacgggcaacauuggggagacacugggagaaaaauggaaguccagacucaacgcgcuuggcaaaagcgaguuucagaucuauaagaaaucugggauccaggaggucgaccggacccuggccaaggaaggaauuaagcgcggcgagaccgaucaucacgcugugagcagaggguccgccaaacugcggugguucguugaaagaaauauggugacacccgagggaaaggucguggaccucggcugcggccgcgggggauggucuuacuauuguggcgggcugaaaaacguucgggaagugaagggacuuaccaaaggcgggccgggacaugaggagccuauccccaugagcacauacggcuggaaucuggucagacuccaauccggcguggauguguuuuucacgcccccugaaaagugcgacacccugcugugugauauuggggagagcucccccaacccuacaaucgaagcuggacgcacccuccggguucuuaaucuggucgagaacuggcugaauaacaauacacaguucugcauuaaggugcucaacccguauaugcccucugugaucgagaagauggaggcccugcagagaaaguacggcggggcgcuuguccgcaauccucugagccggaacuccacccacgagauguacuggguuucuaaugccacgggaaacaucgugagcuccgugaauaugauuucuagaaugcucaucaaccgcuuuaccaugaaacacaagaaagcuacauaugaacccgacgucgaucugggcagcgggacccggaacauuggaaucgaguccgaaauuccuaaucuggacaucauuggcaagagaaucgagaagaucaaacaggaacaugagacaagcuggcacuacgaccaagaucaucccuauaagaccugggccuaccacggcucuuaugagacaaaacagaccggguccgcuagcucuauggugaacggaguugugcgccuccuuacgaagccgugggacgucgugccuaugguuacacagauggccaugaccgauaccacacccuucggccagcaacggguguuuaaagaaaaggucgacacgagaacccaggagccuaaggaagggaccaagaagcugaugaaaauuaccgcugaguggcuguggaaggagcucggcaaaaagaaaacaccccgcauguguaccagagaagaguucacacggaaggugcgcuccaaugccgcgcugggcgccaucuuuaccgaugaaaacaaguggaaaagcgcuagagaggccguggaagacgggcgguucugggagcuugucgauagagagcggaaucugcaccucgaaggaaagugcgagacguguguuuacaacaugaugggcaaacgcgaaaagaaacugggcgaguuugggaaggcuaagggaucuagagccauuugguauauguggcugggcgcccgguuccucgaauuugaggcgcugggguuccuuaaugaggaccauugguuuucccgcggaaacagccuguccggcguggaaggggagggccuccacagacugggauacauccuucgggaugugggcaaaaaggaagggggagcuauguacgccgacgauaccgccggcugggacacacgcauuacccuggaggaccucaaaaaugaagagauggucacaaaccauaugaagggggagcacaaaaagcuggcugaagccaucuucaagcugaccuaucagaauaaagugguuagagugcagcggccuacgccccgcggaacagucauggauaucauuagcagacgggaccaacgcggcucuggacaggugggcaccuacggacucaacacauuuaccaauauggaggcucagcugaucagacaaauggaaggcgaggggauuuucaagagcauccagcaucuuacggccaccgaggaaauugcgguucagaacuggcuggcccgggugggacgcgagagacucucccggauggcuaucucuggcgaugacugcgucgugaaaccgaucgaugacagauucgccagcgcucugacagcccuuaaugauauggggaagguucgcaaagacauucagcaaugggaaccuucccggggauggaacgauuggacccaggugcccuuuugcucucaccacuuccaugagcuggucaugaaggacggcagagugcucgucgugcccugucgcaaccaggaugaacugaucgggcgggcgagaauuagccagggcgccggauggucccugaaggagacagcuugccucggcaaaucuuaugcccaaauguggacccugauguacuuucaccgccgggaccuuagacuggcugccaaugcuaucuguagcgccguuccuccgcauugggugcccacaucccgcaccacguggagcauucacgcgaagcacgaguggaugacaaccgaagauaugcucgccgucuggaaccggguguggauccaggagaauccuuggauggaagacaaaacccccguggagucuugggaagagguuccuuaucuggggaagagagaggaccaguggugcggaucccuuauuggccugacaagccgcgcuaccugggccaaaaacauccagacagccaucaaucaagugcggucucucauugggaacgaagaguacacggauuauaugcccuccaugaagagauuccggagagaagaggaagaggcuggaguccugugguga

SEQ ID NO: 19794 - RNA, 9876 nt, Artificial Sequence
  derived and/or modified CDS sequence (opt5) from DENV-2__GQ199895__SS-prME
acagccggagugaucgucaugcugauucccacggcuauggccuuccaccucacgaccagaaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugagacaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaaggugcgcccuacauuugccgcgggccuucugcucagaaaacugaccucuaaggagcucaugauggcuacaauugggaucgcccugcuuagccaguccaccauucccgaaaccauccuggagcucacagaugcccuggcucugggaaugaugguccuuaaaaucgugcggaacauggaaaaguaccaacuggccguuacgauuauggcgaucucuugcgugccuaaugcugucauucuccagaacgccuggaaggugagcuguaccauccuggccgcuguguccgucagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcgauuauggccguugggauggugagcauccucgcuucuucccugcucaaaaaugacauuccuaugaccggaccccugguggccggcggccuucugaccgucugcuaugugcugacagggcggagcgcugaucucgaacuggagcgcgccgccgacguuaagugggaggaucaagcugaaaucuccggaagcucuccuauucuuagcaucaccauuuccgaggacggcucuaugagcaucaaaaacgaagaggaggaacagacacugacgauccucauuagaaccgggcugcucgugaucuccggagucuuucccgugucuauuccgaucacagcggccgcuugguaccugugggagguuaagaagcagcgggccggcgugcuuugggaugucccuucucccccucccguggaaaaagccgagcuggaagacggggcuuaucgcauuaagcagagaggaauccugggcuacucccaaaucggcgccggggucuauaaagagggaaccuuccacacaauguggcaugugacccggggcgcgguucucaugcaccgcgggaagagaauugagcccuccugggcugaugugaaaaaggaccugaucagcuacggaggcggguggaaacuugaaggagaguggaaagaaggcgaggaaguccaggugcuggcccucgagccuggcaagaauccgcgggccguucagacgaaacccgggauuuuuaagaccaacacaggaaccaucggcgcugugucccuggauuucagcccugggacaucuggaucccccauugucgacagaaaaggcaaggugguggggcucuacggaaauggcguugucacccgcagcggcgccuaugugucugcgaucgcucagacagagaaguccaucgaagauaacccugagauugaagaggacaucuuucggaaaaagagacugacgauuauggaucuucaucccggggccggaaaaaccaagcgcuaccugccugccaucgugcgggaagcuauuaaaagaggccugcgcacacucauccuggccccgacccgggucguggcugccgagauggaggaagcgcuuagagggcugcccauucgcuaucaaaccccugccaucaagacagagcacacgggacgggaaaucguugaccucaugugucaugcuaccuucacaaugagacugcucagccccgugcgggucccuaacuacaaucugauuaucauggacgaggcccacuucaccgaucccgcuuccauugccgcccgcggcuauaucucuacaagaguggagaugggggaagcugcgggcauuuuuaugaccgccacgccgccuggaagccgggaccccuucccccaguccaacgcuccuaucauggaugaggaacgcgagauccccgaaagaagcuggaacucuggccacgaguggguuacagacuuuaaggggaaaaccgugugguucgucccuuccauuaaggccggaaacgauaucgccgcuugccuucggaaaaauggcaagaaagugauucagcugagcagaaagaccuuugacucugaguacguuaagacacgcgccaacgauugggacuucguggucaccacagauaucagcgaaaugggggcgaauuuuaaagcugagcgggugauugacccgagacgcuguaugaagcccgugauccugaccgauggagaagaacgggucauccucgccggcccuaugcccguuacgcauuccucugccgcucaaagacgcgggcggauuggcagaaacccuaaaaaugaaaacgaccaguauaucuacaugggagagccccuggagaaugacgaagauugcgcccacuggaaggaggcgaaaaugcuucuggacaacauuaauacaccggaaggcaucauuccuagcauguucgagcccgaacgcgagaagguggaugccaucgacggggaguacagacuccggggagaagcucgcaaaaccuuuguggaucugaugagacggggcgaccugccugucuggcucgccuauaagguggcugccgaggggauuaacuacgcugaucgcaagugguguuucgacggaaucaaaaauaaccagauccuugaagagaacauggagguugaaauuuggacaaaggagggcgaacgcaagaagcugaaaccccgguggcuggaugccagaaucuauuccgacccucucgcgcugaaggaguuuaaggaguucgccgcugggcgcaaaucucuuacccugaaucucauuacggagaugggccggcugcccaccuucaugacacagaaggccagaaacgcucuggauaaucucgccgugcuucauaccgccgaggcuggaggccgcgcguacaaccacgcccugagcgaacugccggagacacucgaaacccugcuucugcucacacugcuggcuaccgucacagggggaaucuuucucuuccuuauguccggcaaagggauuggaaagaugacacugggcaugugcugcaucaucaccgccagcauucugcucugguaugcccaaauccagccucacuggauugcugccucuaucauucuggaguuuuuccuuaucgugcugcucauccccgaacccgagaaacagcggaccccucaggacaaucaacugacauacguugugauugcgauccugaccgucguggccgcuacaauggccaacgagaugggcuuucucgaaaagacgaagaaagaucuugggcugggauccauuaccacacaggagagcgaauccaauauccuggacauugaccucagaccggcuucugccuggacccuguaugcggucgccacaaccuucgugacgcccaugcuucggcauagcaucgagaacuccucuguuaaugugagccugaccgcuauugccaaccaggcuacagugcucaugggccuggggaagggauggccucuguccaaaauggauaucggcgucccccuccuugccaucggguguuacagccagguuaauccuauuacccugacagcugcccugcuccugcuuguggcgcacuacgccaucauuggacccggccugcaagcuaaggccacccgcgaagcucagaaaagagccgccgcgggcaucaugaagaacccuacgguggacgggauuacagucaucgaucucgagccgauccccuaugacccuaaguuugagaaacagcugggacaggugaugcugcucauucuuugcguuacccaagugcugaugaugcggacaaccugggcucugugugaagcccucacccuggcuacaggccccaucucuacgcuuugggaggggaauccuggacgcuucuggaacaccacaauugccgucuccauggccaauaucuuuagaggcagcuaccuggcuggggccggacuccuguucucuauuaugaagaacaccacaaauacccggcgcggcacgggcaacaucggggaaacacugggagagaaauggaaguccagacucaacgcgcuuggcaaaagcgaguuucagaucuauaagaaaucugggauucaggaaguggaucggacccuggccaaggagggaaucaagcgcggcgaaaccgaccaucacgcugucagcagaggguccgccaaacugcggugguucguggagagaaauaugguuacacccgaaggaaagguggucgaucucggcugcggccgcgggggauggucuuacuauuguggcgggcugaaaaacgugcgggagguuaagggacuuaccaaaggcgggccgggacaugaggaaccuauucccaugagcacauacggcuggaaucuggugagacuccaauccggcgucgacguguuuuucacgcccccugagaagugcgauacccugcugugugacaucggggaaagcucccccaacccuacaauugaggcuggacgcacccuccgggugcuuaaucugguugaaaacuggcugaauaacaauacacaguucugcaucaagguccucaacccguauaugcccucugugaucgagaaaauggaggcccugcagagaaaguacggcggggcgcuugugcgcaauccucugagccggaacuccacccacgaaauguacugggucucuaaugccacgggaaacauuguuagcuccgugaauaugaucucuagaaugcucauuaaccgcuuuaccaugaaacacaagaaagcuacauaugagcccgauguggaccugggcagcgggacccggaacaucggaauugaauccgagaucccuaaucuggauauuaucggcaagagaaucgaaaagauuaaacaggagcaugagacaagcuggcacuacgaccaagaccaucccuauaagaccugggccuaccacggcucuuaugaaacaaaacagaccggguccgcuagcucuauggucaacggagugguucgccuccuuacgaagccgugggauguggucccuauggugacacagauggccaugaccgacaccacacccuucggccagcaacggguuuuuaaagagaagguggauacgagaacccaggaaccuaaggaggggaccaagaagcugaugaaaaucaccgcugaguggcuguggaaggaacucggcaagaagaaaacaccccgcauguguaccagagaggaguucacacggaagguccgcuccaaugccgcgcugggcgccauuuuuaccgacgagaacaaguggaaaagcgcuagagaagccguggaggaugggcgguucugggagcuuguggacagagaacggaaucugcaccucgagggaaagugcgaaacgugugucuacaacaugaugggcaaacgcgagaagaaacugggcgaauuugggaaggcuaagggaucuagagccaucugguauauguggcugggcgcccgguuccucgaguuugaggcgcugggguuccuuaaugaagaucauugguuuucccgcggaaacagccuguccggcguugagggggaaggccuccacagacugggauacauucuucgggacgugggcaaaaaggaagggggagcuauguacgccgaugacaccgccggcugggauacacgcaucacccuggaagaccucaaaaaugaggagauggugacaaaccauaugaagggggaacacaaaaagcuggcugaggccaucuucaagcugaccuaucagaauaaagucgugagaguucagcggccuacgccccgcggaacagugauggacauuaucagcagacgggaucaacgcggcucugggcaggucggcaccuacggacucaacacauuuaccaauauggaagcucagcugauuagacaaauggagggcgaggggaucuucaagagcauucagcaucuuacggccaccgaagagaucgcggugcagaacuggcuggcccggguuggacgcgaaagacucucccggauggcuaucucuggcgacgauugcguggucaaaccgauugacgauagauucgccagcgcucugacagcccuuaaugacauggggaaggugcgcaaagauauccagcaaugggagccuucccggggauggaacgacuggacccagguucccuuuugcucucaccacuuccaugaacuggugaugaaggauggcagaguccucgugguccccugucgcaaccaggacgagcugauugggcgggcgagaaucagccagggcgccggauggucccugaaggagacagcuugccucggcaaaucuuaugcccaaauguggacccugauguacuuucaccgccgggaucuuagacuggcugccaaugcuauuuguagcgccgugccuccgcauuggguucccacaucccgcaccacguggagcauccacgcgaagcacgaauggaugacaaccgaggacaugcucgccguguggaaccgggucuggauucaggaaaauccuuggauggaggauaaaacccccguggaaucuugggaggaggugccuuaucuggggaagagagaagaccaguggugcggaucccuuaucggccugacaagccgcgcuaccugggccaaaaacauccagacagccauuaaucaaguucggucucucaucgggaacgaggaauacacggacuauaugcccuccaugaagagauuccggagagaggaagaggaggcuggagugcugugguga

SEQ ID NO: 19795 - RNA, 9876 nt, Artificial Sequence
  derived and/or modified CDS sequence (opt5) from DENV-2__FJ898478__SS-prME
acagccggagugaucgucaugcugauucccacggcuauggccuuccaccucacgacccggaauggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguugaagacuacggauuuggcguguucacaaccaacaucuggcugaaacuucgggagaaacaggacgucuuuugugauuccaagcugaugagcgccgcuaucaaagacaauagagccgugcacgcggauaugggcuauuggauugaaucugcccucaacgacacguggaagauggagaaggcuuccuucaucgagguuaaaagcugccacuggccuaagucucauacacuguggagcaauggggugcuggaauccgagaugauuauccccaaaaacuucgccggaccggucagccagcacaacuaccgcccuggcuaucauacccaaaccgcugggcccuggcaccuuggaaagcucgaaauggauuuugaccugugugagggcacaaccgugguggucacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucguuaauucccuggugaccgccggccaugggcagauugauaacuucucucugggagugcuuggcauggcucucuuucuggaagagaugcugagaacgcgcaucgggaccaaacacgcgauccuccuggucgccgugagcuucguuacacuuauuaccggaaauauguccuuucgggaccugggcagagugauggucauggugggcgcuacaaugaccgaugacaucgggaugggaguuacguaucucgcccugcuggccgcuuucaaggugcgcccuacauuugccgcgggccuucugcucagaaaacugaccucuaaggagcucaugauggcuacaauugggaucgcccugcuuagccaguccaccauucccgaaaccauccuggagcucacagaugcccuggcucugggaaugaugguccuuaaaaucgugcggaacauggaaaaguaccaacuggccguuacgauuauggcgaucucuugcgugccuaaugcugucauucuccagaacgccuggaaggugagcuguaccauccuggccgcuguguccgucagcccccuccugcuuacaucuucccagcagaaagccgacuggauuccucuggcucucaccaucaagggccugaaucccacagccaucuuccugaccacgcuuagccgcacaucuaaaaagagauccuggccgcugaacgaggcgauuauggccguugggauggugagcauccucgcuucuucccugcucaaaaaugacauuccuaugaccggaccccugguggccggcggccuucugaccgucugcuaugugcugacagggcggagcgcugaucucgaacuggagcgcgccgccgacguuaagugggaggaucaagcugaaaucuccggaagcucuccuauucuuagcaucaccauuuccgaggacggcucuaugagcaucaaaaacgaagaggaggaacagacacugacgauccucauuagaaccgggcugcucgugaucuccggagucuuucccgugucuauuccgaucacagcggccgcuugguaccugugggagguuaagaagcagcgggccggcgugcuuugggaugucccuucucccccucccguggaaaaagccgagcuggaagacggggcuuaucgcauuaagcagagaggaauccugggcuacucccaaaucggcgccggggucuauaaagagggaaccuuccacacaauguggcaugugacccggggcgcgguucucaugcaccgcgggaagagaauugagcccuccugggcugaugugaaaaaggaccugaucagcuacggaggcggguggaaacuugaaggagaguggaaagaaggcgaggaaguccaggugcuggcccucgagccuggcaagaauccgcgggccguucagacgaaacccgggauuuuuaagaccaacacaggaaccaucggcgcugugucccuggauuucagcccugggacaucuggaucccccauugucgacagaaaaggcaaggugguggggcucuacggaaauggcguugucacccgcagcggcgccuaugugucugcgaucgcucagacagagaaguccaucgaagauaacccugagauugaagacgauaucuuucggaaaaagagacugacgauuauggaccuucaucccggggccggaaaaaccaagcgcuaccugccugccaucgugcgggaggcuauuaaaagaggccugcgcacacucauccuggccccgacccgggucguggcugccgaaauggaggaggcgcuuagagggcugcccauucgcuaucaaaccccugccaucaagacagaacacacgggacgggagaucguugaccucaugugucaugcuaccuucacaaugagacugcucagccccgugcgggucccuaacuacaaucugauuaucauggaugaagcccacuucaccgaccccgcuuccauugccgcccgcggcuauaucucuacaagaguggagaugggggaggcugcgggcauuuuuaugaccgccacgccgccuggaagccgggaucccuucccccaguccaacgcuccuaucauggacgaagagagagaaauccccgagagaagcuggaacucuggccacgaauggguuacagauuuuaaggggaaaaccgugugguucgucccuuccauuaaggccggaaacgacaucgccgcuugccuucggaaaaauggcaagaaagugauucagcugagcagaaagaccuuugauucugaguacguuaagacacgcgccaacgacugggauuucguggucaccacagacaucagcgagaugggggcgaauuuuaaagcugaacgggugauugauccgagacgcuguaugaagcccgugauccugaccgacggagaggaacgggucauccucgccggcccuaugcccguuacgcauuccucugccgcucaaagacgcgggcggauuggcagaaacccuaaaaaugagaacgaccaguauaucuacaugggagaaccccuggagaaugaugaggacugcgcccacuggaaggaagcgaaaaugcuucuggauaacauuaauacaccggagggcaucauuccuagcauguucgaacccgagcgcgaaaagguggacgccaucgauggggaguacagacuccggggagaggcucgcaaaaccuuuguggaccugaugagacggggcgaucugccugucuggcucgccuauaagguggcugccgaagggauuaacuacgcugaccgcaagugguguuucgauggaaucaaaaauaaccagauccuugaggaaaacauggagguugagauuuggacaaaggaaggcgagcgcaagaagcugaaaccccgguggcuggacgccagaaucuauuccgauccucucgcgcugaaggaauuuaaggaguucgccgcugggcgcaaaucucuuacccugaaucucauuacggaaaugggccggcugcccaccuucaugacacagaaggccagaaacgcucuggacaaucucgccgugcuucauaccgccgaggcuggaggccgcgcguacaaccacgcccugagcgagcugccggaaacacucgagacccugcuucugcucacacugcuggcuaccgucacagggggaaucuuucucuuccuuauguccggcaaagggauuggaaagaugacacugggcaugugcugcaucaucaccgccagcauucugcucugguaugcccaaauccagccucacuggauugcugccucuaucauucuggaauuuuuccuuaucgugcugcucauccccgagcccgaaaaacagcggaccccucaggauaaucaacugacauacguugugauugcgauccugaccgucguggccgcuacaauggccaacgagaugggcuuucucgagaagacgaagaaagaccuugggcugggauccauuaccacacaggaaagcgaguccaauauccuggacauugaucucagaccggcuucugccuggacccuguaugcggucgccacaaccuucgugacgcccaugcuucggcauagcaucgaaaacuccucuguuaaugugagccugaccgcuauugccaaccaggcuacagugcucaugggccuggggaagggauggccucuguccaaaauggacaucggcgucccccuccuugccaucggguguuacagccagguuaauccuauuacccugacagcugcccugcuccugcuuguggcgcacuacgccaucauuggacccggccugcaagcuaaggccacccgcgaggcucagaaaagagccgccgcgggcaucaugaagaacccuacgguggaugggauuacagucaucgaccucgaaccgauccccuaugauccuaaguuugagaaacagcugggacaggugaugcugcucauucuuugcguuacccaagugcugaugaugcggacaaccugggcucugugugaggcccucacccuggcuacaggccccaucucuacgcuuugggaagggaauccuggacgcuucuggaacaccacaauugccgucuccauggccaauaucuuuagaggcagcuaccuggcuggggccggacuccuguucucuauuaugaagaacaccacauccacccggcgcggcacgggcaauaucggggagacacugggagaaaaauggaaaagcagacucaacgcgcuuggcaaaucugaguuucagaucuauaagaaaagcgggauucaggagguggaccggacccuggccaaggaaggaaucaagcgcggcgagaccgaucaucacgcugucuccagagggucugccaaacugcggugguucguggaaagaaacaugguuacacccgagggaaagguggucgaccucggcugcggccgcgggggauggagcuacuauuguggcgggcugaaaaaugugcgggaaguuaagggacuuaccaaaggcgggccgggacaugaggagccuauucccauguccacauacggcuggaaccuggugagacuccaaagcggcgucgauguguuuuucacgcccccugaaaagugcgacacccugcugugugauaucggggaguccucucccaauccuacaauugaagcuggacgcacccuccgggugcuuaaccugguugagaauuggcugaacaauaacacacaguucugcaucaagguccucaauccguauaugcccagcgugaucgagaagauggaggcccugcagagaaaguacggcggggcgcuugugcgcaacccucuguccagaaauucuacccacgagauguacugggucagcaacgccacgggaaauauuguuuccucugugaacaugaucagcagaaugcucauuaaucgcuuuaccaugaaacacaagaaagcuacauaugaacccgacguggaucugggcuccgggacccggaacaucggaauugagagcgaaaucccuaaccuggacauuaucggcaagagaaucgagaagauuaaacaggaacaugagacaucuuggcacuacgaccaagaucaucccuauaagaccugggccuaccacggcuccuaugagacaaaacagaccgggagcgcuucuuccauggucaauggagugguucgccuccuuacgaagccgugggacguggucccuauggugacacagauggccaugaccgauaccacacccuucggccagcaacggguuuuuaaagaaaagguggacacgagaacccaggagccuaaggaagggaccaagaagcugaugaaaaucaccgcugaguggcuguggaaggagcucggcaagaagaaaacaccccgcauguguaccagagaagaguucacacggaagguccgcagcaacgccgcgcugggcgccauuuuuaccgaugaaaauaaguggaaaucugcuagagaggccguggaagacgggcgguucugggagcuuguggauagagagcggaaccugcaccucgaaggaaagugcgagacgugugucuacaauaugaugggcaaacgcgaaaagaaacugggcgaguuugggaaggcuaagggauccagagccaucugguauauguggcugggcgcccgguuccucgaauuugaggcgcugggguuccuuaacgaggaccauugguuuagccgcggaaauucccugagcggcguugaaggggagggccuccacagacugggauacauucuucgggaugugggcaaaaaggaagggggagcuauguacgccgacgauaccgccggcugggacacacgcaucacccuggaggaccucaaaaacgaagagauggugacaaaucauaugaagggggagcacaaaaagcuggcugaagccaucuucaagcugaccuaucagaacaaagucgugagaguucagcggccuacgccccgcggaacagugauggauauuaucucuagacgggaccaacgcggcagcgggcaggucggcaccuacggacucaauacauuuaccaacauggaggcucagcugauuagacaaauggaaggcgaggggaucuucaaguccauucagcaucuuacggccaccgaggaaaucgcggugcagaauuggcuggcccggguuggacgcgagagacucucucggauggcuaucagcggcgaugacugcguggucaaaccgauugaugacagauucgccuccgcucugacagcccuuaacgauauggggaaggugcgcaaagacauccagcaaugggaaccuucucggggauggaaugauuggacccagguucccuuuugcagccaccacuuccaugagcuggugaugaaggacggcagaguccucgugguccccugucgcaaccaggaugaacugauugggcgggcgagaaucucccagggcgccggauggucucugaaggagacagcuugccucggcaaaagcuaugcccaaauguggacccugauguacuuucaccgccgggaccuuagacuggcugccaacgcuauuuguuccgccgugccuagccauuggguuccgacaucucgcaccacgugguccauccacgcgaagcacgaguggaugacaaccgaagauaugcucgccguguggaaucgggucuggauucaggagaaccccuggauggaagacaaaaccccuguggagagcugggaagaggugcccuaucuggggaagagagaggaccaguggugcggaucucuuaucggccugacaucccgcgcuaccugggccaaaaauauccagacagccauuaaccaaguucggagccucaucgggaaugaagaguacacggauuauaugccuuccaugaagagauuccggagagaagaggaagaggcuggagugcugugguga

SEQ ID NO: 19796 - RNA, 9876 nt, Artificial Sequence
  derived and/or modified CDS sequence (opt5) from DENV-2__GQ199869__SS-prME
acagccggcgugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacauccagggaucuaauuggauucagaaggagacacuggucaccuucaagaacccucaugcuaaaaagcaagacgugguugugcucggcucccaggaaggggccaugcacacggcccugacaggcgcuaccgagauccagaugagcuccggaaaucuucuguuuacaggccaucucaaaugcagacugcggauggauaaacuucaacugaaagggaugucuuacagcauguguaccggaaaguucaagauugucaaagaaaucgcggagacccagcacggcacaaucgugauuagaguccaguaugagggggacggaucccccugcaagauccccuucgaaauuacggaucucgagaaacgccaugugcugggccggcugaucaccguuaacccuauugugacagaaaaggacagcccggucaacaucgaggccgaacccccuuuuggggauucuuacauuaucaucggcguggagcccggacagcucaaacugaauugguucaagaagggcuccagcauugggcaaauguuugagaccacaaugagaggagcuaaacgcauggccauccuuggcgacaccgccugggauuucgggucucugggaggcguuuuuacgagcauugggaaggcucuccaccagguguucggcgccaucuacggagcggcuuuuuccggcgucucuuggacaaugaaaauucugaucggggugaucauuaccuggaucggaaugaacagccgguccaccagccugucugugucccuuguucucgucggcguggugacacuguaucugggggccgucgugcaggccgacagcggauguguugugucuuggaagaauaaagaacucaagugcggcuccgggauuuucaucaccgauaacguccacacauggacggagcaguacaaguuucaaccugaaagccccuccaaacuggcuucugccauucagaaggcucaugaggaaggcaucuguggaaucagaagcgugacccgccuugagaaucugauguggaaacagauuacaccggagcucaaccacauccuguccgaaaaugagguuaagcugaccauuaugacaggcgacaucaaagggauuaugcaggccggaaagcggucucuuagaccucaacccaccgaacucaaauauagcuggaagacguggggcaaggcgaaaaugcuguccaccgagagccauaaccagacauuccugaucgaugggccugaaaccgccgagugccccaauacaaaccgcgcuuggaacucucucgagguggaagacuacggauuuggcgucuucaccacaaacaucuggcugaaacuucgggagaaacaggacguguuuugugauuccaagcugaugagcgccgcuauuaaagacaauagagccguucacgcggauaugggcuauuggaucgaaucugcccucaacgacaccuggaagauggagaaggcuuccuucauugaggugaaaagcugccacuggccuaagucucauacgcuguggagcaaugggguccuggaauccgagaugaucauucccaaaaacuucgccggaccggugagccagcacaacuaccgcccuggcuaucauacacaaaccgcugggcccuggcaccuuggaaagcucgaaauggauuuugacuucugugagggcaccacaguggucguuaccgaagauugcgggaaucggggacccucucugagaacgacaaccgccuccggcaaacugaucacagaguggugcugucggagcugcacccucccuccgcugcgcuacagaggcgaggacggguguugguacggaauggaaauucggccccuuaaggagaaggaagagaaccuggugaauagccucgugacagccggccaugggcagaucgauaacuuuucucugggaguccugggcauggcucuuuuccucgaagagaugcugagaacccgcaucgggacgaaacacgcgauucugcucguggccguuagcuuugugacccugaucacaggaaauauguccuuccgggaccuuggcagagucauggugaugguuggcgcuaccaugacagaugacauugggaugggagugaccuaucuggcccuccuggccgcuuuuaagguccgcccuacguucgccgcgggccugcuucugagaaaacucacaucuaaggagcugaugauggcuaccaucgggauugcccuccugagccaguccacaauccccgaaaccauccuugagcugaccgaugcccucgcucugggaaugauggugcugaaaauuguucggaacauggaaaaguaccaacuugccgugacaaucauggcgauuucuugcgucccuaaugcugugauccugcagaacgccuggaaggugagcuguacgauucucgccgcugucuccguuagcccccugcuccugaccucuucccagcagaaagccgacuggaucccucuugcucugacaaucaagggccucaaucccaccgccauuuuucugacaacccugagccgcacgucuaaaaagagauccuggccgcuuaacgaggcgaucauggccguggggauggugagcauucuggcuucuucccuccugaaaaaugacaucccuaugacaggaccccucgucgccggcggccugcuuaccgugugcuauguucugaccgggcggagcgcugaucuggaacucgagcgcgccgccgacgugaagugggaggaucaagcugaaauuuccggaagcucuccuauccugagcauuacaaucuccgaggacggcucuaugagcaucaaaaacgaagaggaggaacagacccuuacaauucugaucagaacggggcuccuggucauuuccggaguguuccccguuucuaucccgauuaccgcggccgcuugguaccucugggaggugaagaagcagcgggccggcguccugugggaugugccuucucccccucccgucgaaaaagccgagcuugaagacggggcuuaucgcaucaagcagagaggaauccugggcuacucccaaauuggcgccgggguguauaaagagggaacauuucacaccauguggcauguuacacggggcgcggugcugaugcaccgcgggaagagaaucgagcccuccugggcugaugucaaaaaggaccucauuagcuacggaggcggguggaagcuggaaggagaguggaaagaaggcgaggaagugcagguucuugcccuggagccuggcaagaauccgcgggccgugcagaccaaacccgggaucuucaagacgaacaccggaacaauuggcgcugucucccucgauuuuagcccugggaccucuggaucccccaucguggacagaaaaggcaaggugguugggcuguacggaaauggcgucgugacacgcagcggcgccuaugugucugcgaucgcucagaccgagaaguccauugaagauaacccugagaucgaagacgauauuuuccggaaaaagagacucacaaucauggaccugcaucccggggccggaaaaacgaagcgcuaccuuccugccauuguccgggaggcuaucaaaagaggccugcgcacccugauucucgccccgacacgggugguugcugccgaaauggaggaggcgcugagagggcuucccauccgcuaucaaaccccugccaucaagaccgaacacacaggacgggagauuguggaccugaugugucaugcuacguucaccaugagacuccugagccccguccgggugccuaacuacaaucucaucauuauggaugaagcccacuuuacagaccccgcuuccaucgccgcccgcggcuauauuucuaccagaguugagaugggggaggcugcgggcaucuucaugacagccaccccgccuggaagccgggaucccuuuccccaguccaacgcuccuaucauggacgaagaaagagaaauucccgagagaagcuggaacucuggccacgaaugggugacggauuucaaggggaaaacagucugguuugugccuuccaucaaggccggaaacgacauugccgcuugccugcggaaaaauggcaagaaaguuauccagcuuagcagaaagaccuucgauucugaguacgugaagacccgcgccaacgacugggauuuugucgugacaaccgacauuagcgagaugggggcgaauuucaaagcugaacgggugaucgauccgagacgcuguaugaagcccgucauccugacagacggagaggaacggguuauucuggccggcccuaugcccgugacccauuccucugccgcucaaagacgcgggcggaucggcagaaacccuaaaaaugagaacgaccaguauauuuacaugggagaaccccucgagaaugaugaggacugcgcccacuggaaggaagcgaaaaugcugcuugauaacaucaauacgccggagggcauuaucccuagcauguuugaacccgagcgcgaaaagguggacgccauugauggggaguacagacugcggggagaggcucgcaaaacauucgucgaccucaugagacggggcgaucugccuguguggcuggccuauaagguugcugccgaagggaucaacuacgcugaccgcaagugguguuuugauggaaucaaaaauaaccagauucucgaggaaaacauggagguggagaucuggaccaaggaaggcgagcgcaagaaacuuaaaccccgguggcuggacgccagaauuuauuccgauccucuggcgcucaaggaguucaaggaguucgccgcugggcgcaaaucucugacacuuaaucugaucaccgaaaugggccggcuccccacguuuaugacccagaaggccagaaacgcucuggacaaucuggccguccuccauacagccgaggcuggaggccgcgcguacaaccacgcccuuagcgagcugccggaaacccuggagacacuccugcuucugacccuccuggcuacagugaccgggggaauuuuccuguuucucauguccggcaaagggaucggaaagaugacgcuuggcaugugcugcaucauuacagccagcauccugcugugguaugcccaaauucagccucacuggaucgcugccucuauuauccucgaguucuuucugaucguucuucugauucccgagcccgaaaaacagcggaccccucaggauaaucaacucaccuacguggucaucgcgauucugacaguggucgccgcuaccauggccaacgagaugggcuuccuggagaagacaaagaaagaccucgggcuuggauccaucacgacccaggaaagcgaguccaauauucuggacaucgaucugagaccggcuucugccuggacacucuaugcgguggccaccacauuuguuacccccaugcugcggcauagcauugaaaacuccucugugaaugugagccuuacggcuaucgccaaccaggcuaccguccugaugggccucgggaagggauggccucuguccaaaauggacaucggcguuccccugcucgccauuggguguuacagccaggugaauccuaucacacuuaccgcugcccugcugcuccugguggcgcacuacgccauuaucggacccggccuucaagcuaaggccacacgcgaggcucagaaaagagccgccgcgggcauuaugaagaacccuaccgucgaugggaucacggugaucgaccuggaaccgauucccuaugauccuaaguucgagaaacagcucggacagguuaugcugcugauccucugcgugacacaaguccuuaugaugcggaccacaugggcucugugugaggcccugacccucgcuaccggccccauuucuacacugugggaagggaauccuggacgcuuuuggaacacgaccaucgccguguccauggccaauauuuucagaggcagcuaccuugcuggggccggacugcucuuuucuaucaugaagaacacaaccuccacacggcgcggcaccggcaauaucggggagacgcugggagaaaaauggaaaagcagacugaacgcgcucggcaaaucugaguuccagauuuauaagaaaagcgggauccaggaggucgaccggacacuugccaaggaaggaauuaagcgcggcgagaccgaucaucacgcuguguccagagggucugccaaacugcggugguuuguugaaagaaacauggugacccccgagggaaaggucguggaccugggcugcggccgcgggggauggagcuacuauuguggcgggcucaaaaauguucgggaagugaagggacugacaaaaggcgggccgggacaugaggagccuauccccauguccaccuacggcuggaaccuugucagacugcaaagcggcguggauguguucuucacacccccugaaaagugcgacacgcuccugugugauauuggggaguccucucccaauccuaccaucgaagcuggacgcacacugcggguucucaaccuugucgagaauuggcugaacaauaacacccaguuuugcaucaaggugcugaauccguauaugcccagcgugauugagaagauggaggcccuccagagacaguacggcggggcgcugguccgcaacccucuuuccagaaauucuacacacgagauguacuggguuagcaacgccaccggaaauaucguguccucugugaacaugauuagcagaaugcugaucaaucgcuucacgaugaagcacaaaaaggcuaccuaugaacccgacgucgaucucggcuccgggacacggaacauuggaaucgagagcgaaauuccuaaccuggacaucaucggcaaaagaauugagaagaucaagcaagaacaugagauuucuuggcacuacgaccaggaucaucccuauaaaaccugggccuaccacggcuccuaugagacaaagcagaccgggagcgcuucuuccauggugaauggaguugugcgccugcucacaaaaccgugggacgucgugccuaugguuacccagauggccaugacggauacaacccccuuuggccaacagcggguguucaaggaaaaagucgacaccagaacacaggagccuaaggaagggacgaagaaacuuaugaagaucaccgcugaguggcuguggaaagagcugggaaagaaaaagacaccccgcauguguaccagagaagaguuuaccaagaaggugcggagcaacgccgcgcucggcgccauuuucaccgaugaaaauaaguggaaaucugcucgcgaggccguggaagacgggagauuuugggagcuggucgaucgggagagaaaccuucaccuggaaggaaagugcgagacauguguuuacaauaugaugggcaaacgggaaaagaaacucggcgaguucgggaaggcuaagggaucccgcgccaucugguauauguggcugggcgccagauuucuggaguucgaggcgcucggguuucugaacgaggaccauugguucagccggggaaauucccuuagcggcguggaaggggagggccugcaccgccucggauacauccugagagaugugggcaaaaaggaagggggagcuauguacgccgacgauaccgccggcugggacacgcggauuacccuugaggaccugaaaaacgaagagauggucacaaaucauaugaagggggagcacaaaaagcucgcugaagccaucuuuaagcugaccuaucagaacaaagugguucgcgugcaaagaccuacaccccggggaaccgucauggauauuaucucucgcagagaccagcggggcagcggacaggugggcacguacggacugaauacauucaccaacauggaggcucaacucauucgccagauggaaggcgaggggaucuucaaguccauccagcaucugacagccaccgaggaaauugcgguucagaauuggcuugccagagugggacgggagcgccugucuagaauggcuaucagcggcgaugacugcgucgugaaaccgauugaugaccgguuugccuccgcucucacggcccugaacgauauggggaagguuagaaaagacauccaacagugggaaccuucucgcggauggaaugauuggacccaggugcccuucugcagccaccacuuucaugagcuugucaugaaggacggccgggugcuggucgugcccuguagaaaccaggaugaacucauugggcgcgcgcggaucucccaaggcgccggauggucucugaaggagacagcuugccugggcaaaagcuaugcccagauguggacccucauguacuuccacagacgcgaccugcggcuugcugccaacgcuauuuguuccgccguuccuagccauugggugccgacaucuagaaccacaugguccauccacgcgaagcacgaguggaugaccacggaagauaugcuggccgucuggaaucgcguguggauccaggagaaccccuggauggaagacaaaacaccuguggagagcugggaagagguucccuaucucgggaagcgggaggaccaguggugcggaucucugauuggccuuaccuccagagcuaccugggccaaaaauauccaaacagccauuaaccaggugcgcagccugaucgggaaugaagaguacaccgauuauaugccuuccaugaagcgguuuagacgggaagaggaagaggcuggaguccucugguga

SEQ ID NO: 19797 - RNA, 9876 nt, Artificial Sequence
  derived and/or modified CDS sequence (opt5) from DENV-2__JX079688__SS-prME
accgccggcgugaucgucaugcugauucccaccgcuauggccuuccaccucacgacccggaauggggaaccucauaugaucguuggacggcaggaaaagggcaagagccugcuuuuuaagaccgaagacggggugaauaugugcacccugauggcgauugaucucggagaacugugugaggacacgaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggaucccuuuccccaguccaacgcuccuaucauggacgaagaaagagaaauccccgagagaagcuggaacucuggccacgaaugggugacagauuucaaggggaaaaccgucugguuugugccuuccauuaaggccggaaacgacaucgccgcuugccugcggaaaaauggcaagaaaguuauucagcuuagcagaaagaccuucgauucugaguacgugaagacacgcgccaacgacugggauuuugucgugaccacagacaucagcgagaugggggcgaauuucaaagcugaacgggugauugauccgagacgcuguaugaagcccgucauccugaccgacggagaggaacggguuauccuggccggcccuaugcccgugacgcauuccucugccgcucaaagacgcgggcggauuggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccccgguggcuggacgccagaaucuauuccgauccucuggcgcucaaggaguucaaggaguucgccgcugggcgcaaaucucugacccuuaaucugauuacggaaaugggccggcuccccaccuuuaugacacagaaggccagaaacgcucuggacaaucuggccguccuccauaccgccgaggcuggaggccgcgcguacaaccacgcccuuagcgagcugccggaaacacuggagacccuccugcuucugacacuccuggcuaccgugacagggggaaucuuccuguuucucauguccggcaaagggauuggaaagaugacacuuggcaugugcugcaucaucaccgccagcauucugcuguggcacgcccaaauccagccucauuggauugcugccucuaucauucucgaguucuuucugaucguucuucugauccccgagcccgaaaaacagcggaccccucaggauaaucaacucacauauguggucauugcgauccugaccguggucgccgcuacaauggccaacgagaugggcuuccuggagaagacgaagaaagaccucgggcuuggauccauuaccacacaggaaagcgaguccaauauccuggacauugaucugagaccggcuucugccuggacccucuacgcgguggccacaaccuuuguuacgcccaugcugcggcacagcaucgaaaacuccucugugaaugugagccuuaccgcuauugccaaccaggcuacaguccugaugggccucgggaagggauggccucuguccaaaauggacaucggcguuccccugcucgccaucggguguuauagccaggugaauccuauuacccuuacagcugcccugcugcuccugguggcgcauuacgccaucauuggacccggccuucaagcuaaggccacccgcgaggcucagaaaagagccgccgcgggcaucaugaagaacccuacggucgaugggauuacagugaucgaccuggaaccgauccccuacgauccuaaguucgagaaacagcucggacagguuaugcugcugauucucugcgugacccaaguccuuaugaugcggacaaccugggcucugugugaggcccugacccucgcuacaggccccaucucuacgcugugggaagggaauccuggacgcuuuuggaacaccacaauugccguguccauggccaauaucuucagaggcagcuaucuugcuggggccggacugcucuuuucuauuaugaagaacaccacauccacccggcgcggcacgggcaauaucggggagacacugggagaaaaauggaaaagcagacugaacgcgcucggcaaaucugaguuccagaucuacaagaaaagcgggauucaggaggucgaccggacccuugccaaggaaggaaucaagcgcggcgagaccgaucaccaugcuguguccagagggucugccaaacugcggugguuuguugaaagaaacauggugacacccgagggaaaggucguggaccugggcugcggccgcgggggauggagcuauuacuguggcgggcucaaaaauguucgggaagugaagggacugaccaaaggcgggccgggacacgaggagccuauucccauguccacauauggcuggaaccuugucagacugcaaagcggcguggauguguucuucacgcccccugaaaagugcgacacccuccugugugauaucggggaguccucucccaauccuacaauugaagcuggacgcacccugcggguucucaaccuugucgagaauuggcugaacaauaacacacaguuuugcaucaaggugcugaauccguacaugcccagcgugaucgagaagauggaggcccuccagagacaguauggcggggcgcugguccgcaacccucuuuccagaaauucuacccacgagauguacuggguuagcaacgccacgggaaauauuguguccucugugaacaugaucagcagaaugcugauuaaucgcuucaccaugaagcauaaaaaggcuacauacgaacccgacgucgaucucggcuccgggacccggaacaucggaauugagagcgaaaucccuaaccuggacauuaucggcaaaagaaucgagaagauuaagcaagaacacgagaucucuuggcauuaugaccaggaucaccccuacaaaacaugggccuaucacggcuccuacgagaccaagcagacagggagcgcuucuuccauggugaauggaguugugcgccugcucaccaaaccgugggacgucgugccuaugguuacgcagauggccaugacagauaccacccccuuuggccaacagcggguguucaaggaaaaagucgacacaagaacgcaggagccuaaggaagggaccaagaaacuuaugaagauuacagcugaguggcuguggaaagagcugggaaagaaaaagacaccccgcauguguacaagagaagaguuuaccaaaaaggugcggagcaacgccgcgcucggcgccaucuucacagaugaaaauaaguggaaaucugcucgcgaggccguggaagacgggagauuuugggagcuggucgaucgggagagaaaccuucaucuggaaggaaagugcgagaccuguguuuauaauaugaugggcaaacgggaaaagaaacucggcgaguucgggaaggcuaagggaucccgcgccauuugguacauguggcugggcgccagauuucuggaguucgaggcgcucggguuucugaacgaggaccacugguucagccggggaaauucccuuagcggcguggaaggggagggccugcaucgccucggauauauccugagagaugugggcaaaaaggaagggggagcuauguacgccgacgauacggccggcugggacacccggaucacacuugaggaccugaaaaacgaagagauggucaccaaucacaugaagggggagcauaaaaagcucgcugaagccauuuuuaagcugacauaccagaacaaagugguucgcgugcaaagaccuacaccccggggaacggucauggauaucauuucucgcagagaccagcggggcagcggacaggugggcacauauggacugaauaccuucacaaacauggaggcucaacucauccgccagauggaaggcgaggggauuuucaaguccauccagcaccugaccgccacggaggaaaucgcgguucagaauuggcuugccagagugggacgggagcgccugucuagaauggcuauuagcggcgaugacugcgucgugaaaccgaucgaugaccgguuugccuccgcucucaccgcccugaacgauauggggaagguuagaaaagacauucaacagugggaaccuucucgcggauggaaugauuggacacaggugcccuucugcagccaccauuuucacgagcuugucaugaaggacggccgggugcuggucgugcccuguagaaaccaggaugaacucaucgggcgcgcgcggauuucccaaggcgccggauggucucugaaggagaccgcuugccugggcaaaagcuacgcccagauguggacacucauguauuuccauagacgcgaccugcggcuugcugccaacgcuaucuguuccgccguuccuagccacugggugccgaccucuagaacaaccugguccauucacgcgaagcaugaguggaugacgacagaagauaugcuggccgucuggaaucgcguguggauccaggagaaccccuggauggaagacaaaaccccuguggagagcugggaagagguucccuaccucgggaagcgggaggaccaguggugcggaucucugaucggccuuaccuccagagcuacaugggccaaaaauauucaaaccgccaucaaccaggugcgcagccugauugggaucgaagaguauacagauuacaugccuuccaugaagcgguuuagacgggaagaggaagaggcuggaguccucugguga

SEQ ID NO: 19798 - RNA, 9876 nt, Artificial Sequence
  derived and/or modified CDS sequence (opt5) from DENV-2__JF357906__SS-prME
accgccggagugaucguuaugcugauucccaccgcuauggccuuccaccucacgaccagaaauggggaaccucauaugaucguuggacggcaggaaaagggcaaaagccugcuuuuuaagacagaagacggggugaauaugugcacccugauggcgauugaucucggagaacugugugaggacacaaucaccuacaaaugcccgcuucugagacaaaaugaacccgaggauauugacuguuggugcaauuccacaucuaccugggugacguauggcaccuguacaaccacaggggagcacagacgggaaaagcgcagcguggcucucgugccucauguuggaaugggccuggagaccagaacggaaacauggauguccucugagggcgccuggaaacacgugcagcggaucgagaccuggauccugcgccaucccggguucacaauuauggccgcuguccucgccuacaccaucggaaccacacacuuucagaaggcucugauuuucauccuucugacggccguggcgccuagcaugaccaugagaugcauuggcaucuccaaccgggauuuuguugaaggggugucuggaggcagcugggucgacauugugcucgagcacggguccugugugacaaccauggccaagaauaaacccacacuggauuucgaacuuaucaagaccgaggcuaaacagccugccacgcugcgcaaguauugcaucgaagcuaaacucacaaacaccaccacagagagcagauguccgacccaaggagagcccucucugaaugaagaacaggacaagcgguuuauuugcaagcauuccauggucgaucgcggcuggggcaacggguguggacuguucggcaaagggggaaucguuacaugcgccauguuuacgugcaagaaaaauauggaaggcaagguggugcagccugagaaccucgaauacaccauugucaucacaccccacagcggggaggagcaugcggugggaaaugacaccggcaaacacggcaaggaaauuaaaaucacaccucagucuuccaucaccgaggccgaacugacgggguauggaaccguuacaauggaguguagccccagaaccggccuugauuucaacgaaauggugcugcuccaaauggaggacaaggcuuggcugguccaccggcagugguuucuugaucugccgcucccuuggcugcccggggccgacacacagggaucuaauuggauucagaaggagacccuggugacguucaaaaacccucaugcuaagaaacaagacguugugguccucggcucccaggaaggggccaugcacacagcccugaccggcgcuacagagauccagaugagcuccggaaaucuucuguuuaccggccaucucaagugccgccugagaauggauaaacuucaacugaaggggaugucuuacagcauguguaccggaaaguucaaaauugugaaggaaaucgcggagacacagcacggcacgauugucauccgggugcaguaugagggggacggaucccccugcaaaauccccuucgaaauuaccgaucucgagaagagacauguucugggccgccugaucacagugaacccuauugucaccgaaaaagacagcccggugaacaucgaggccgaacccccuuuuggggauucuuacauuaucauuggcguugagcccggacagcucaagcugaauugguucaagaaaggcuccagcaucgggcaaauguuugagacaaccaugcggggagcuaagagaauggccauccuuggcgacacggccugggauuucgggucucugggaggcguguuuacaagcauugggaaagcucuccaccaggucuucggcgccaucuacggagcggcuuuuuccggcgugucuuggaccaugaagauucugaucggggugauuaucaccuggaucggaaugaacagccgcuccacaagccugucuguuucccuuguccucgugggcguggucacccuguaucugggggccgugguucaggccgacagcggauguguggucucuuggaaaaauaaggaacucaagugcggcuccgggauuuucaucacagauaacgugcacacguggaccgagcaguacaaauuucaaccugaaagccccuccaagcuggcuucugccauucagaaagcucaugaggaaggcaucuguggcauucggagcguuacaagacuugagaaucugauguggaagcagaucaccccggagcucaaccacauccuguccgaaaaugaggugaaacugacaauuaugaccggcgacaucaaggggauuaugcaggccggaaaacgcucucuucggccucaacccacggaacucaaguauagcuggaagaccuggggcaaagcgaagaugcuguccacagagagccauaaccagaccuuccugaucgaugggccugaaacagccgagugccccaauaccaacagagcuuggaacucucucgaggucgaagacuacggauuuggcguguucacaaccaacauuuggcugaaacuucgcgagaagcaggacgucuuuugugauuccaaacugaugagcgccgcuaucaaggacaaucgggccgugcacgcggauaugggcuauuggaucgaaucugcccucaacgacacguggaagauggagaaggcuagcuucauugaggucaagagcugccacuggccuaaaucucauacacuguggagcaauggggugcuggaauccgagaugaucauucccaagaacuucgccggaccggugagccagcacaacuacagaccuggcuaucauacccaaaccgcugggcccuggcaccuuggaaaacucgaaauggauuuugacuucugugagggcacaaccgucguugugacggaagauugcgggaaucgcggacccucucugcggacaaccacagccuccggcaagcugaucaccgaguggugcuguagaagcugcacacucccuccgcugcgguaccgcggcgaggacggguguugguacggaauggaaauuagaccccuuaaggagaaagaagagaaccuggucaauucccucgucaccgccggccaugggcagaucgauaacuuuucucugggagugcugggcauggcucuuuuccucgaagagaugcugcggacgagaauugggaccaagcacgcgauccugcucguugccgugagcuuugucacacugaucaccggaaauauguccuuccgcgaccuuggccgggugaugguuauggugggcgcuacaaugaccgaugacauugggaugggagucacguaucuggcccuccuggccgcuuuuaaagugagaccuacauucgccgcgggccugcuucugcgcaagcucaccucuaaagagcugaugauggcuacaaucgggauugcccuccugagccaguccaccauccccgaaaccauucuugagcugacagaugcccucgcucugggaaugaugguucugaagaucgugagaaacauggaaaaguaccaacuugccgucacgaucauggcgauuucuugcgugccuaaugcugugauccugcagaacgccuggaaagucagcuguaccauucucgccgcuguuuccgugagcccccugcuccugacaucuucccagcagaaggccgacuggaucccucuugcucugaccauuaaaggccucaaucccacagccaucuuucugaccacgcugagccggacaucuaagaaacgcuccuggccgcuuaacgaggcgaucauggccguggggauggucagcauucuggcuucuucccuccugaagaaugacaucccuaugaccggaccccucguggccggcggccugcuuaccguuugcuaugugcugacagggagaagcgcugaucuggaacucgagcgggccgccgacgucaaaugggaggaucaagcugaaauuuccggaagcucuccuauccugagcauuaccaucuccgaggacggcucuaugagcauuaagaacgaagaggaggaacagacacuuacgauccugauccgcaccgggcuccuggugauuuccggaaucuuccccguuucuauuccgaucacagcggccgcuugguaccucugggaggugaagaaacagagagccggcguccugugggaugugccuucucccccucccgucgaaaaggccgagcuugaagacggggcuuaucggauuaaacagcgcggaauccugggcuacucccaaaucggcgccgggguguauaaggagggaaccuuucacacaauguggcauguuaccagaggcgcggugcugaugcaccgggggaaacgcauugagcccuccugggcugaugucaagaaggaccucaucagcuacggaggcggguggaaacuggaaggagaguggaaggaaggcgaggaagugcagguucuugcccuggagccuggcaaaaauccgagagccgugcagacgaagcccgggauuuucaaaaccaacacaggaaccaucggcgcugucucccucgauuuuagcccugggacaucuggaucccccauuguggaccggaagggcaaggugguugggcuguacggaaauggcgucgugaccagaagcggcgccuaugugucugcgaucgcucagacagagaaauccaucgaagauaacccugagauugaagacgauaucuuccgcaagaaacggcucacgauuauggaccugcaucccggggccggaaagaccaaaagauaccuuccugccaucguccgcgaggcuauuaagcggggccugagaacacugauccucgccccgacccgcgugguugcugccgaaauggaggaggcgcugcgggggcuucccauuagauaucaaaccccugccaucaagacagaacacacgggacgcgagaucguggaccugaugugucaugcuaccuucacaaugcggcuccugagccccgucagagugccuaacuacaaucucauuaucauggaugaagcccacuuuaccgaccccgcuuccauugccgcccggggcuauaucucuacacgcguugagaugggggaggcugcgggcauuuucaugaccgccacgccgccuggaagcagagaucccuuuccccaguccaacgcuccuaucauggacgaagaacgggaaauccccgagcgcagcuggaacucuggccacgaaugggugacagauuucaaagggaagaccgucugguuugugccuuccauuaaagccggaaacgacaucgccgcuugccugagaaagaauggcaaaaagguuauucagcuuagccggaagaccuucgauucugaguacgugaaaacaagagccaacgacugggauuuugucgugaccacagacaucagcgagaugggggcgaauuucaaggcugaacgcgugauugauccgcggagauguaugaaacccgucauccugaccgacggagaggaacgcguuauccuggccggcccuaugcccgugacgcauuccucugccgcucaacggagagggcgcauuggccggaacccuaagaaugagaacgaccaguauaucuacaugggagaaccccucgagaaugaugaggacugcgcccacuggaaagaagcgaagaugcugcuugauaacauuaauacaccggagggcaucauuccuagcauguuugaacccgagagagaaaaaguggacgccaucgauggggaguaccgccugagaggagaggcucggaagaccuucgucgaccucaugcgcagaggcgaucugccuguguggcuggccuauaagguugcugccgaagggauuaacuacacagaccggaaaugguguuuugauggaaucaagaauaaccagauccucgaggaaaacauggagguggagauuuggaccaaagaaggcgagcgcaagaaacuuaagcccagauggcuggacgcucggaucuauuccgauccucuggcccucaaggaguucaaagaguucgcggccgggagaaagucucugacgcuuaaucugauuaccgaaaugggccgccuccccacauuuaugacccagaaagcucggaacgcccuggacaaucuggcuguccuccauacagccgaggccggaggcagagcuuacaaccacgcgcuuagcgagcugccggaaacccuggagacacuccugcuucugacccuccuggccacggugacagggggaaucuuccuguuucucauguccggcaaggggauuggaaaaaugacccuuggcaugugcugcaucaucaccgcuagcauucugcugugguaugcccaaauccagccucacuggauugccgcuucuaucauucucgaguucuuucugaucguucuucugauccccgagcccgaaaagcagcgcacaccucaggauaaucaacucaccuacguggucauugccauccugacaguggucgcggccacgauggcuaacgagaugggcuuccuggagaagaccaaaaaggaccucgggcuuggauccauuacaacccaggaaagcgaguccaauauccuggacauugaucugcggccggccucugcuuggacacucuaugccguggcgaccacguuuguuacccccaugcugagacauagcaucgaaaacuccucugugaaugugagccuuacagccauugcuaaccaggccaccguccugaugggccucgggaaaggauggccucuguccaagauggacaucggcguuccccugcucgcuaucggguguuacagccaggugaauccuauuacacuuaccgccgcucugcugcuccugguggcccacuacgcgaucauuggacccggccuucaagccaaagcuacgcgggaggcccagaagcgcgcugccgccggcaucaugaagaacccuacagucgaugggauuaccgugaucgaccuggaaccgauccccuaugauccuaaauucgagaagcagcucggacagguuaugcugcugauucucugcgugacacaaguccuuaugaugagaaccaccugggcgcugugugaggcucugacacucgccacgggccccaucucuacccugugggaagggaauccuggacgguuuuggaacacaaccauugcuguguccauggccaauaucuuccgcggcagcuaccuugccggggcuggacugcucuuuucuauuaugaaaaacacaaccuccacgagacggggcacaggcaauaucggggagacccugggagaaaaguggaaaagccgccugaacgcccucggcaagucugaguuccagaucuauaaaaagagcgggauucaggaggucgacagaacccuugcgaaggaaggaaucaaacggggcgagacagaucaucacgccgugucccgcgggucugcuaagcugagaugguuuguugaacggaacauggugacccccgagggaaaagucguggaccugggcugcggcagagggggauggagcuacuauuguggcgggcucaagaauguucgcgaagugaaaggacugacaaagggcgggccgggacaugaggagccuauucccauguccacguacggcuggaaccuuguccggcugcaaagcggcguggauguguucuucacacccccugaaaagugcgacacacuccugugugauaucggggaguccucucccaauccuaccauugaagccggaagaacacugcgcguucucaaccuugucgagaauuggcugaacaauaacacccaguuuugcaucaaagugcugaauccguauaugcccagcgugaucgaaaagauggaggcucuccagcggcaguacggcggggcccuggucagaaacccucuuucccgcaauucuacgcacgagauguacuggguuagcaacgcgaccggaaauauuguguccucugugaacaugaucagccggaugcugauuaauagauucacaaugaaacacaagaaagccaccuaugaacccgacgucgaucucggcuccgggacacgcaacaucggaauugagagcgaaaucccuaaccuggacauuaucggcaagcggaucgagaagauuaaacaagaacaugagaucucuuggcacuacgaccaggaucaucccuauaagaccugggcuuaccacggcuccuaugagacaaaacagaccgggagcgccucuuccauggugaauggaguugugagacugcucacgaagccgugggacgucgugccuaugguuacacagauggcuaugaccgauaccacacccuuuggccaacagcgcguguucaaagaaaaggucgacacgcggacccaggagccuaaggaagggaccaagaaacuuaugaaaauuaccgccgaguggcuguggaaagagcugggacgcaaaaagacaccccgcauguguaccagagaagaguuuacacggaaagugcgcagcaacgcugcccucggcgcgaucuucaccgaugaaaauaaguggaagucugccagagaggcuguggaagacgggcgguuuugggagcuggucgauagagagcggaaccuucaccuggaaggaaaaugcgagacguguguuuacaauaugaugggcaagcgcgagaaaaagcucggcgaguucgggaaagccaagggauccagagcuauuugguauauguggcugggcgcccgguuucuggaguucgaggcccucggguuucugaacgaggaccauugguucagccgcgaaaauucccuuagcggaguggagggcgaagggcugcacagacucggcuacauccugcgggaugugggaaagaaagagggcggggcgauguacgcugacgauaccgccggaugggacacacgcaucacccuugaagaccugaagaacgaggagauggucacaaaucauaugaaaggcgaacacaagaaacucgccgaggcuauuuuuaagcugaccuaucagaacaaggugguuagagugcaacggccuacgccccgcgggacagucauggauaucauuucuagacgggaccagcgcggaagcggccagguggggaccuacggccugaauacauucaccaacauggaagcccaacucaucagacagauggagggagagggcauuuucaaauccauccagcaucugacggcuaccgaagagaucgccguucagaauuggcuugcgcggguggggcgcgaaagacugucucggauggccauuagcggagaugacugcgucgugaagccgaucgaugacagauuugcuuccgcccucacagcucugaacgauaugggcaaaguucgcaaggacauucaacagugggagccuucucggggguggaaugauuggacccaggugcccuucugcagccaccacuuucaugaacuugucaugaaagacggaagagugcuggucgugcccugucgcaaccaggaugagcucaucggccgggccagaauuucccaaggggcgggcuggucucugaaggagacagccugccugggaaagagcuaugcucagauguggacccucauguacuuccaccgccgggaccugagacuugccgcuaacgccaucuguuccgcuguuccuagccauugggugccgacaucucgcaccacgugguauauucacgccaaacacgaauggaugacaaccgaggauaugcuggcggucuggaaucggguguggauccaggaaaaccccuggauggaggacaagaccccuguggaauccugggaggagguucccuaccucggcaaaagagaagaccaguggugcgggagccugaucggacuuacaucucgcgccaccugggcuaagaauauucaaacagccaucaaccaggugcggucccugauuggcaaugaggaauauacggauuacaugccuagcaugaaaagauuucggagagaggaagaggaggccgggguccucugguga

SEQ ID NO: 19799 - RNA, 9873 nt, Artificial Sequence
  derived and/or modified CDS sequence (opt5) from DENV-2__HQ705624__SS-prME
accgccggcgugaucgugaugcugauucccacagcuauggccuuccaccucacgaccagaaauggggagccucauaugaucguuggacggcaggaaaagggcaaaagccugcuuuuuaagaccgaggacggggugaauaugugcacccugauggcgauugaucucggagaacugugugaggacacaaucaccuacaaaugcccgcuucugcgccaaaacgaacccgaggauauugacuguuggugcaauuccacaucuaccugggugacguauggcaccuguacaaccacaggggagcacagacgggaaaagcgcagcguggcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccaaauuuacgugcaagaaaaauauggaaggcaagguugugcagccugagaaccucgaauacaccaucgugauuacaccccacagcggggaggagcaugcggucggaaaugacaccggcaaacacggcaaggaaaucaaaaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaaaaacccucaugcuaagaaacaagacgugguugugcucggcucccaggaaggggccaugcacacagcccugaccggcgcuacagagauucagaugagcuccggaaaucuucuguuuaccggccaucucaagugcagacugcggauggauaaacuucaacugaaggggaugucuuacagcauguguaccggaaaguucaaaaucgucaaggaaauugcggagacacagcacggcacgaucgugaucagaguccaguaugagggggacggaucccccugcaaagugcccuucgaaauuaccgaucucgagaagcgccauguucugggccggcugaucacagugaacccuauugucaccgaaaaagacagcccggugaacaucgaggccgaacccccuuuuggggauucuuacauuaucauuggcguugagcccggacagcucaagcugaauugguucaagaaaggcuccagcaucgggcaaauguuugagacaaccaugagaggagcuaagcgcauggccauccuuggcgacacggccugggauuucgggucucugggaggcguguuuacaagcauugggaaagcucuccaccaggucuucggcgccaucuacggagcggcuuuuuccggcgugucuuggaccaugaagauucugaucggggugauuaucaccuggaucggaaugaacagccgguccacaagccugucuguuucccuuguccucgugggcguggucacccuguaucugggggccauggugcaggccgacagcggauguguugugucuuggaaaaauaaggaacucaagugcggcuccgggauuuucaucacagauaacguccacacguggaccgagcaguacaaauuucaaccugaaagccccuccaagcuggcuucugccauuaaaaaggcucaugaggaaggcaucuguggaauuagaagcgugacacgccuugagaaucugauguggaaacagaucaccccggagcucaaccacauccuguccgaaaaugagguuaagcugacaauuaugaccggcgacauccgggggauuaugcaggccggaaaaagaucucuucgcccucagcccacggaacucaaguauagcuggaagaccuggggcaaagcgaagaugcuguccacagagagccauaaccaaaccuuccugaucgaugggccugaaacagccgagugccccaauaccaaccgggcuuggaacucucucgagguggaagacuacggauuuggcgucuucacaaccaacauuuggcugaaacuuagagacaagcaggauguguuuugugacuccaaacugaugagcgccgcuaucaaggauaaucgcgccguucacgcggacaugggcuauuggaucgagucugcccucaacgauacguggaagauggaaaaagcuagcuucauugaggucaagagcugccacuggccuaaaucucauacacuguggagcaaugggguccuggaguccgaaaugaucauucccaagaacuucgccggaccggugagccagcacaacuaccggccuggcuaucauacccagaccgcugggcccuggcaccuuggaaaacucgagauggacuuugaucugugugaaggcacaaccguggucguuacggaggacugcgggaauagaggacccucucugcggacaaccacagccuccggcaagcucaucaccgaauggugcugucgcagcugcacacugccuccgcuuagauaccggggcgaggauggguguugguacggaauggagauuagaccccugaaggaaaaagaggaaaaccucgucaauucccuggugaccgccggccaugggcaaaucgacaacuucucucugggaguccuuggcauggcucuccugcuggaggaaaugcuccgcacgcggauugggaccaagcacgcgauccugcuuguggccguuagcuuugugacacugaucaccggaaauauguccuucagagaucucggccgcgucauggugaugguuggcgcuacaaugaccgacgauauugggaugggagugacguaucuggcccugcuugccgcuuuuaaagucagaccuacauucgccgcgggccugcuccugcggaagcucaccucuaaagagcugaugauggcuacaaucgggauugcccuucugagccaguccaccauccccgagaccauucucgaacugacagacgcccuggcucuuggaaugauggugcugaagaucguucgcaacauggagaaguaccagcucgccgugacggucauggcgaucucuugcgugccuaaugcugugauucugcaaaacgccuggaaagucagcuguaccauccucgccgcuguuuccgugagcccccugcuucugacaucuucccagcagaaggccgacuggauuccucucgcucugaccaucaaaggccugaaucccacagccauuuuucuuaccacgcugagcagaacaucuaagaaacgguccuggccgcucaacgaagcgaucauggccguggggauggucagcauccuggcuucuucccuccugaagaaugauauuccuaugaccggaccccuuguggccggcggccugcugaccguuugcuaugugcucacagggcgcagcgcugaccuggagcuugaaagagccgccgaugucaaaugggaggaccaggcugagaucuccggaagcucuccuauucugagcaucaccauuuccgaagauggcucuaugagcaucaagaacgaggaagaggagcaaacacucacgauucugauccggaccgggcuccuggugaucuccggaguuuuccccgugucuauuccgaucacagcggccgcuugguaccuuugggaagucaagaaacagcgcgccggcgugcugugggacgucccuucucccccucccguggagaaggccgaacuggaggauggggcuuauagaauuaaacagcggggaauccucggcuacucccagauuggcgccgggguuuauaaggaaggaaccuuucacacaauguggcaugugacccgcggcgcgguccugaugcacagagggaaacggaucgagcccuccugggcugacgugaagaaggaucuuaucagcuacggaggcggguggaaacuggagggagaauggaaggagggcgaagagguucaagugcucgcccuggaaccuggcaaaaauccgagagccguccagacgaagcccgggauuuucaaaaccaacacaggaaccaucggcgcugugucccucgacuuuccugggacaagcggaucucccauuguggaucgcaagggcaagguugucgggcuguacggaaauggcguggugacccgguccggcgccuaugucagcgcgaucgcucagacagagaaaucuauugaggacaacccugaaaucgaggaugacaucuucagaaagaaacgccuuacgauuauggaccugcaucccggggccggaaagaccaaacgguaccugccugccaucgugagagaagcuauuaagcgcggccuccggacacugauccuugccccgaccagaguuguggcugccgagauggaagaggcgcugcgcgggcuccccauucgguaucagaccacagccaucaagacggagcacaccggaagagaaauugucgaucugaugugucaugcuacauuuaccaugcggcuccuguccccugugcgcguucccaacuacaaucuuaucaucauggacgaggcccacuucacagauccugcuagcauugccgccagaggcuauaucuccacccggguggaaaugggggaggcugcgggcauuuucaugacggccacacccccgggaucucgcgacccuuuuccccaaagcaacgcucccaucauggaugaggaaagagagauuccugaacgguccuggaauagcggccacgagugggucaccgacuucaaagggaagaccgugugguuuguucccucuaucaaagccggaaacgauaucgccgcuugccugagaaagaauggcaaaaaggugauucagcugucccgcaagacauucgacagcgaauacgucaaaacccgggccaacgauugggacuuuguggugacaaccgauaucucugagaugggggcgaauuucaaggcugagagagucauugacccucgccgguguaugaaaccgguuauccucacggacggagaagagagagugauucuggccggccccaugccugugacacauagcuccgccgcucagcgccgggggagaaucggccgcaaccccaagaaugaaaacgaucaauauaucuacaugggagagccucuugaaaaugacgaggauugcgcccacuggaaagaggcgaagaugcugcucgacaacauuaauacccccgaaggcaucauuccgucuauguuugagccugaaagagagaaagucgaugccaucgacggggaauaccggcugcgcggagaggcuagaaagacauucguggaucugaugcggcgcggcgaccuccccguuuggcuugccuauaagguggcugccgaggggauuaacuacgcugauagaaaaugguguuuugacggaaucaagaauaaccagauucuggaagagaacauggaagucgagaucuggaccaaagagggcgaacggaagaaacugaagccuagauggcucgaugcccgcaucuauagcgacccccuggcgcuuaaggaguucaaagaauuugccgcugggcggaagucccugacgcucaaucugauuaccgagaugggcagacugccuacauucaugacccagaaagcccgcaacgcucucgauaaucuugccgugcugcauacagccgaagcuggaggccgggcguacaaccacgcccugucugagcuccccgagacccuggaaacacuucugcuccugacccugcucgcuacgguuacagggggaaucuuccuuuuucugaugagcggcaaggggauuggaaaaaugacccugggcaugugcugcaucauuaccgccuccauccuccugugguaugcccagauccaaccgcacuggauugcugccagcaucauucuugaguucuuucugaucgugcuccugauuccugaacccgagaagcagagaacaccccaggacaaucagcugaccuacgucgugaucgcgauccucacagucguggccgcuacgauggccaacgaaaugggcuuccuugagaagaccaaaaaggaccuggggcugggaucuauuacaacccaagaguccgaaagcaauauccucgauauugaccugcggccugcuuccgccuggacacuuuaugcgguugccaccacguuugugaccccgaugcugcgccauucuaucgagaacagcuccgugaaugucucucucacagcuauugccaaccaggcuaccguucugaugggccuggggaaaggauggccccucagcaagauggauaucggcgugccucuucuggccauuggguguuacucccaggugaaucccaucacacugaccgcugcccuccugcuucuggucgcgcacuacgccaucauuggaccuggccuccaggcuaaagccacgagagaagcucaaaagcgggccgccgcgggcaucaugaagaaccccacaguggacgggauuaccguuaucgaucuggagccuauuccguaugaccccaaauucgaaaagcagcugggacaggugaugcuccuuauccugugcgucacacaggugcugaugaugcgcaccaccugggcucucugugaggcccugacacuugcuacgggcccuaucagcacccugugggaggggaaucccggaagauuuuggaacacaaccauugccgucucuauggccaauaucuuccggggcuccuaccucgcuggggccggacugcuguuuagcauuaugaaaaacacaaccaauacgcgcagaggcacaggcaacaucggggaaacccucggagagaaguggaaaucucggcuuaacgcgcugggcaaguccgaguuccaaauuuauaaaaagagcgggauccaggagguggaucgcacccuggccaaggagggaaucaaaagaggcgaaacagaccaucacgcuguuucucgggggagcgccaagcucagaugguuuguggagcgcaauauggucaccccugaaggaaaagugguugaucugggcugcggcagagggggaugguccuacuauuguggcgggcuuaagaacgugcgggaggucaaaggacugacaaagggcgggcccggacaugaagaacccauuccuaugucuacguacggcuggaaucucgugcgccugcagagcggcguggacguuuucuuuacaccgcccgagaagugcgauacacugcucugugacaucggggaauccagcccuaaccccaccauugaggcuggacggacacuuagaguccugaaucugguggaaaacuggcucaauaacaauacccaauucugcaucaaagugcugaacccuuauaugccguccgucauugagaagauggaagcccuucagcgcaaauacggcggggcgcugguucggaauccccucucuagaaacagcacgcacgagauguacuggguguccaaugccaccggaaacaucgugucuagcgucaauaugaucucccgcaugcugauuaaccgguucacaaugaagcacaaaaaggcuaccuaugagccugauguggaccugggcucugggacaagaaacaucggaauugaaagcgagauccccaaucucgacauuaucggcaagcgcauugaaaagaucaagcaggagcaugaaaccuccuggcacuacgaucaggaccauccuuauaaaacaugggccuaccacggcagcuaugagaccaagcaaacggggucugcuuccagcaugguuaacggagugguccggcuucugacaaaacccugggaugugguuccgauggugacccagauggccaugaccgacacaacgccuuuuggccagcagagagucuucaaggagaagguggauacccgcacacaagaacccaaagaggggaccaagaaacugaugaagaucacagcugaauggcucuggaaagagcugggaaagaaaaagaccccuagaauguguacacgggaggaauuuacccgcaaggugagaucuaaugccgcgcuuggcgccauuuucacggacgagaacaaauggaaguccgcucgggaagccgucgaggaugggagauuuugggaacugguugaccgggagcgcaaucuccaccuggagggaaaaugcgaaaccuguguguacaacaugaugggcaagagagagaaaaagcugggcgaguucgggaaggcuaaaggaagccgggccaucugguauauguggcucggcgcccgcuuucuggaguucgaagcgcuuggguuucugaaugaggaucauugguucucuagaggaaacucccucagcggcguggagggggaaggccugcaccggcuuggauacauucugcgcgacgucggcaagaaagaagggggagcuauguacgccgaugacacagccggcugggacaccagaaucacacucgaagaucugaagaaugaggaaauggugaccaaccauaugaaaggggagcacaagaagcuggcugaggccauuuuuaaacucacguaucagaauaagguugugcggguccagcgccccacaccuagaggaaccgugauggacaucaucucccggcgcgaucagagaggcagcgggcaaguuggcacauacggacugaacaccuucacgaauauggaagcucagcuuauucggcagauggagggcgaagggaucuuuaaaucuauucaacaucugaccgccacagaggagaucgcggugcagaacuggcucgcccgcgucggaagagaacggcugagcagaauggcuauuuccggcgacgauugcgugguuaagcccaucgacgaucgcuucgccucugcucuuaccgcccugaaugacauggggaaagugcggaaggauauccagcagugggagccgagcagaggauggaacgacuggacacaagucccuuucugcucccaccacuuucaugaacucgugaugaaggauggccgcguccuggugguucccugucggaaccaggacgagcugauugggagagcgcgcaucucucagggcgccggauggagccucaaagaaaccgcuugccugggcaaguccuaugcccagauguggacacuuauguacuuccaccggagagaucugcgccucgcugccaaugcuauuuguucugccgugcccagccauugggucccuaccucccggacgacauggagcauccacgcgaaacacgaguggaugaccaccgaggacaugcuggccguguggaacagaguguggauucaagaaaauccguggauggaggacaagacacccguugaaucuugggaggaagugccuuaucuugggaaacgcgaggaucaguggugcggaucccugaucggccucaccagccgggcuacaugggccaagaacauucagacggccaucaaucaggucagaucucugaucgggaacgaggaauacaccgacuauaugcccuccaugaagcgguuuagacgcgaggaagaggaagcuggagugcugugguga

SEQ ID NO: 19800 - RNA, 9876 nt, Artificial Sequence
  derived and/or modified CDS sequence (opt5) from DENV-2__HQ705625__SS-prME
acagccggcgugaucgucaugcugauucccacagcuauggccuuccaccucacgacacggaauggggaaccucauaugaucguuggacggcaggaaaagggcaaaagccugcuuuuuaagacagaagacggggugaauaugugcacccugauggcgauugaucucggagaacugugugaggacacaaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaugaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggagggaucgucacaugcgccauguuuacgugcaaaaagaauauggaaggcaaaguugugcagccugagaaccucgaauacaccauugugaucacaccccacagcggggaggagcaugcggucggaaaugacaccggcaagcacggcaaagaaauuaagaucacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgauugugaucagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucauuggcguggagcccggacagcucaaacugaauugguucaagaagggcuccagcaucgggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucggggugauuaucaccuggaucggaaugaacagccgguccacaagccugucugugucccuuguucucgucggcguggugacccuguaucugggggccgucgugcaggccgacagcggauguguugugucuuggaagaauaaagaacucaagugcggcuccgggauuuucaucacagauaacguccacacguggaccgagcaguacaaguuucaaccugaaagccccuccaaacuggcuucugccauucagaaggcucaugaggaaggcaucuguggaauuagaagcgugacacgccuugagaaucugauguggaaacagaucaccccggagcucaaccacauccuguccgaaaaugagguuaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuaucaaagacaauagagccguucacgcggauaugggcuauuggaucgaaucugcccucaacgacacguggaagauggagaaggcuuccuucauugaggugaaaagcugccacuggccuaagucucauacacuguggagcaaugggguccuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgugaccgccggccaugggcagaucgauaacuuuucucugggaguccugggcauggcucuuuuccucgaagagaugcugagaacgcgcauugggaccaaacacgcgauccugcucguggccguuagcuuugugacacugaucaccggaaauauguccuuccgggaccuuggcagagucauggugaugguuggcgcuacaaugaccgaugacauugggaugggagugacguaucuggcccuccuggccgcuuuuaagguccgcccuacauucgccgcgggccugcuucugagaaaacucaccucuaaggagcugaugauggcuacaaucgggauugcccuccugagccaguccaccauccccgaaaccauucuugagcugacagaugcccucgcucugggaaugauggugcugaaaaucguucggaacauggaaaaguaccaacuugccgugacgaucauggcgauuucuugcgucccuaaugcugugauccugcagaacgccuggaaggugagcuguaccauucucgccgcugucuccguuagcccccugcuccugacaucuucccagcagaaagccgacuggaucccucuugcucugaccauuaagggccucaaucccacagccaucuuucugaccacgcugagccgcacaucuaaaaagagauccuggccgcuuaacgaggcgaucauggccguggggauggugagcauucuggcuucuucccuccugaaaaaugacaucccuaugaccggaccccucgucgccggcggccugcuuaccgugugcuauguucugacagggcggagcgcugaucuggaacucgagcgcgccgccgacgugaagugggaggaucaagcugaaauuuccggaagcucuccuauccugagcauuaccaucuccgaggacggcucuaugagcauuaaaaacgaagaggaggaacagacacuuacgauccugaucagaaccgggcuccuggucauuuccggaguguuccccguuucuaucccgauuacagcggccgcuugguaccucugggaggugaagaagcagcgggccggcguccugugggaugugccuucucccccucccgucgaaaaagccgagcuugaagacggggcuuaucgcaucaagcagagagggauucugggcuacucccaaaucggcgccgggguguauaaagagggaaccuuucacacaauguggcauguuacccggggcgcggugcugaugcaccgcgggaagagaaucgagcccuccugggcugaugucaaaaaggaccucauuagcuacggaggcggguggaagcuggaaggagaguggaaagaaggcgaggaagugcagguucuugcccuggagccuggcaagaauccgcgggccgugcagacgaaacccgggaucuucaagaccaacacaggaaccauuggcgcugucucccucgauuuuagcccugggacaucuggaucccccaucguggacagaaaaggcaaggugguugggcuguacggaaauggcgucgugacccgcagcggcgccuaugugucugcgauugcucagacagagaaguccaucgaagauaacccugagaucgaagacgauauuuuccggaaaaagagacucacgaucauggaccugcaucccggggccggaaaaaccaagcgcuaccuuccugccauuguccgggaggcuaucaaaagaggccugcgcacacugauucucgccccgacccgggugguugcugccgaaauggaggaggcgcugagagggcuucccauccgcuaucaaaccccugccauuaagacagaacacacgggacgggagaucguggaccugaugugucaugcuaccuucacaaugagacuccugagccccguccgggugccuaacuacaaucucaucauuauggaugaagcccacuuuaccgaccccgcuuccaucgccgcccgcggcuauauuucuacaagaguugagaugggggaggcugcgggcaucuucaugaccgccacgccgccuggaagccgggaucccuuuccccaguccaacgcuccuauuauggacgaagaaagagaaauccccgagagaagcuggaacucuggccacgaaugggugacagauuucaaggggaaaaccgucugguuugugccuuccaucaaggccggaaacgacauugccgcuugccugcggaaaaauggcaagaaaguuauccagcuuagcagaaagaccuucgauucugaguacgugaagacacgcgccaacgacugggauuuugucgugaccacagacauuagcgagaugggggcgaauuucaaagcugaacgggugaucgauccgagacgcuguaugaagcccgucauucugaccgacggagaggaacggguuauccuggccggcccuaugcccgugacgcauuccucugccgcucaaagacgcgggcggaucggcagaaacccuaaaaaugagaacgaccaguauauuuacaugggagaaccccucgagaaugaugaggacugcgcccacuggaaggaagcgaaaaugcugcuugauaacaucaauacaccggagggcauuaucccuagcauguuugaacccgagcgcgaaaagguggacgccauugauggggaguacagacugcggggagaggcucgcaaaaccuucgucgaccucaugagacggggcgaucugccuguguggcuggccuauaagguugcugccgaagggaucaacuacgcugaccgcaagugguguuuugauggaaccaagaauaaccagauucucgaggaaaacauggagguggagaucuggaccaaggaaggcgagcgcaagaaacuuaaaccccgguggcuggacgccagaaucuauuccgauccucuggcgcucaaggaguucaaggaguucgccgcugggcgcaaaucucugacgcuuaaucugauuaccgaaaugggccggcuccccacauuuaugacccagaaggccagaaacgcucuggacaaucuggccguccuccauacagccgaggcuggaggccgcgcguacaaccacgcccuuagcgagcugccggaaacccuggagacacuccugcuucugacccuccuggcuacggugacagggggaaucuuccuguuucucauguccggcaaagggauuggaaagaugacccuuggcaugugcugcaucauuaccgccagcauccugcugugguaugcccaaauccagccucacuggauugcugccucuaucauucucgaguucuuucugaucguucuucugauucccgagcccgaaaaacagcggacaccucaggauaaucaacucaccuacguggucaucgcgauccugacaguggucgccgcuacgauggccaacgagaugggcuuccuggagaagaccaagaaagaccucgggcuuggauccauuacaacccaggaaagcgaguccaauauccuggacauugaucugagaccggcuucugccuggacacucuaugcgguggccaccacguuuguuacccccaugcugcggcauagcaucgaaaacuccucugugaaugugagccuuacagcuauugccaaccaggcuaccguccugaugggccucgggaagggauggccucuguccaaaauggacaucggcguuccccugcucgccauuggguguuacagccaggugaauccuaucacacuuaccgcugcccugcugcuccugguggcgcacuacgccaucauuggacccggccuucaagcuaaggccacgcgcgaggcucagaaaagagccgccgcgggcaucaugaagaacccuacagucgaugggauuaccgugaucgaccuggaaccgauucccuaugauccuaaguucgagaaacagcucggacagguuaugcugcugauccucugcgugacacaaguccuuaugaugcggaccaccugggcucugugugaggcccugacacucgcuacgggccccaucucuacccugugggaagggaauccuggacgcuuuuggaacacaaccauugccguguccauggccaauaucuucagaggcagcuaccuugcuggggccggacugcucuuuucuauuaugaagaacacaaccuccacgcggcgcggcacaggcaauaucggggagacccugggagaaaaauggaaaagcagacugaacgcgcucggcaaaucugaguuccagauuuauaagaaaagcgggauccaggaggucgaccggacccuugccaaggaaggaaucaagcgcggcgagacagaucaucacgcuguguccagagggucugccaaacugcggugguuuguugaaagaaacauggugacccccgagggaaaggucguggaccugggcugcggccgcgggggauggagcuacuauuguggcgggcucaaaaauguucgggaagugaagggacugacaaaaggcgggccgggacaugaggagccuauucccauguccacguacggcuggaaccuugucagacugcaaagcggcguggauguguucuucacacccccugaaaagugcgacacccuccugugugauaucggggaguccucucccaauccuaccauugaagcuggacgcacacugcggguucucaaccuugucgagaauuggcugaacaauaacacccaguuuugcaucaaggugcugaauccguauaugcccagcgugauugagaagauggaggcccuccagagacaguacggcggggcgcugguccgcaacccucuuuccagaaauucuacgcacgagauguacuggguuagcaacgccaccggaaauaucguguccucugugaacaugaucagcagaaugcugauuaaucgcuucacaaugaagcacaaaaaggcuaccuaugaacccgacgucgaucucggcuccgggacacggaacaucggaauugagagcgaaaucccuaaccuggacauuaucggcaaaagaauugagaagaucaagcaagaacaugagaucucuuggcacuacgaccaggaucaucccuauaaaaccugggccuaccacggcuccuaugagacaaagcagaccgggagcgcuucuuccauggugaauggaguugugcgccugcucacgaaaccgugggacgucgugccuaugguuacacagauggccaugaccgauaccacacccuuuggccaacagcggguguucaaggaaaaagucgacacgagaacccaggagccuaaggaagggacaaagaaacuuaugaagauuaccgcugaguggcuguggaaagagcugggaaagaaaaagacaccccgcauguguaccagagaagaguuuaccaagaaggugcggagcaacgccgcgcucggcgccaucuucaccgaugaaaauaaguggaaaucugcucgcgaggccguggaagacgggagauuuugggagcuggucgaucgggagagaaaccuucaccuggaaggaaagugcgagacguguguuuacaauaugaugggcaaacgggaaaagaaacucggcgaguucgggaaggcuaagggaucccgcgccauuugguauauguggcugggcgccagauuucuggaguucgaggcgcucggguuucugaacgaggaccauugguucagccggggaaauucccuuagcggcguggaaggggagggccugcaccgccucggauacauccugagagaugugggcaaaaaggaagggggagcuauguacgccgacgauaccgccggcugggacacacggauuacccuugaggaccugaaaaacgaagagauggucacaaaucauaugaagggggagcacaaaaagcucgcugaagccaucuuuaagcugaccuaucagaacaaagugguucgcgugcaaagaccuacgccccggggaacagucauggauaucauuucucgcagagaccagcggggcagcggacaggugggcaccuacggacugaauacauucaccaacauggaggcucaacucauccgccagauggaaggcgaggggauuuucaaguccauccagcaucugacggccaccgaggaaauugcgguucagaauuggcuugccagagugggacgggagcgccugucuagaauggcuaucagcggcgaugacugcgucgugaaaccgaucgaugaccgguuugccuccgcucucacagcccugaacgauauggggaagguuagaaaagacauucaacagugggaaccuucucgcggauggaaugauuggacccaggugcccuucugcagccaccacuuucaugagcuugucaugaaggacggccgggugcuggucgugcccuguagaaaccaggaugaacucaucgggcgcgcgcggauuucccaaggcgccggauggucucugaaggagacagcuugccugggcaaaagcuaugcccagauguggacccucauguacuuccacagacgcgaccugcggcuugcugccaacgcuaucuguuccgccguuccuagccauugggugccgacaucuagaaccacgugguccauucacgcgaagcacgaguggaugacaaccgaagauaugcuggccgucuggaaucgcguguggauccaggagaaccccuggauggaagacaaaaccccuguggagagcugggaagagguucccuaucucgggaagcgggaggaccaguggugcggaucucugauuggccuuacauccagagcuaccugggccaaaaauauccaaacagccaucaaccaggugcgcagccugauugggaaugaagaguacacggauuauaugccuuccaugaagcgguuuagacgggaagaggaagaggcuggaguccucugguga

SEQ ID NO: 19801 - RNA, 9876 nt, Artificial Sequence
  derived and/or modified CDS sequence (opt5) from DENV-2__JF730052__SS-prME
accgccggcgugaucgucaugcugauucccacagcuauggccuuccaccucacgacccggaauggggaaccucauaugaucguuggacggcaggaaaagggcaagagccugcuuuuuaagacagaagacggggugaauaugugcacccugauggcgauugaucucggagaacugugugaggacacaaucaccuacaagugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaugaaaaccgaggcuaagcagccugccacgcugagaaaauauugcaucgaagcuaagcucacaaacaccaccacagagagccgguguccgacccaaggagagcccucucugaaugaagaacaggacaaacgcuuuauuugcaagcauuccaugguggauagaggcuggggcaacggguguggacuguucggcaaaggcgggaucgucacaugcgccauguuuacgugcaaaaagaauauggaagggaaaguugugcagccugagaaccucgaauacaccauugugaucacaccccacagcggggaggagcaugcggucggaaaugacaccggcaagcacggcaaagaaauuaagaucacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgauugugaucagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucauuggcguggagcccggacagcucaaacugaauugguucaagaagggcuccagcaucgggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucggggugauuaucaccuggaucggaaugaacagccgguccacaagccugucugugucccuuguucucgucggcguggugacccuguaucugggggccgucgugcaggccgacagcggauguguugugucuuggaagaauaaagaacucaagugcggcuccgggauuuucaucacagauaacguccacacguggaccgagcaguacaaguuucaaccugaaagccccuccaaacuggcuucugccauucagaaggcucaugaggaaggcaucuguggaauuagaagcgugacacgccuugagaaucugauguggaaacagaucaccccggagcucaaccacauccuguccgaaaaugagguuaagcugacaauuaugaccggcgacaucaaagggauuaugcaggccggaaagcggucucuuagaccucaacccacggaacucaaauauagcuggaagaccuggggcaaggcgaaaaugcuguccacagagagccauaaccagaccuuccugaucgaugggccugaaacagccgagugccccaauaccaaccgcgcuuggaacucucucgagguggaagacuacggauuuggcgucuucacaaccaacauuuggcugaaacuucgggagaaacaggacguguuuugugauuccaagcugaugagcgccgcuaucaaagacaauagagccguucacgcggauaugggcuauuggaucgaaucugcccucaacgacacguggaagauggagaaggcuuccuucauugaggugaaaagcugccacuggccuaagucucauacacuguggagcaaugggguccuggaauccgagaugaucauucccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugaucaccgaguggugcugucggagcugcacacucccuccgcugcgcuacagaggcgaggacggguguugguacggaauggaaauucggccccuuaaggagaaggaagagaaccuggugaauagccucgugaccgccggccaugggcagaucgauaacuuuucucugggaguccugggcauggcucuuuuccucgaagagaugcugagaacgcgcauugggaccaaacacgcgauccugcucguggccguuagcuuugugacacugaccacaggaaauauguccuuccgggaccuuggcagagucauggugaugguuggcgcuaccaugacggaugacaucgggaugggagugacauaucuggcccuccuggccgcuuuuaagguccgcccuaccuucgccgcgggccugcuucugagaaaacucacaucuaaggagcugaugauggcuaccauugggaucgcccuccugagccaguccaccauucccgaaacaauccuugagcugacggaugcccucgcucugggaaugauggugcugaaaauuguucggaacauggaaaaguaccaacuugccgugaccaucauggcgaucucuugcgucccuaaugcugugauucugcagaacgccuggaaggugagcuguacaauccucgccgcugucuccguuagcccccugcuccugaccucuucccagcagaaagccgacuggauuccucuugcucugacaaucaagggccucaaucccaccgccauuuuucugacgacacugagccgcaccucuaaaaagagauccuggccgcuuaacgaggcgaucauggccguggggauggugagcauccuggcuucuucccuccugaaaaaugacauuccuaugaccggaccccucgucgccggcggccugcuuacagugugcuauguucugaccgggcggagcgcugaucuggaacucgagcgcgccgccgacgugaagugggaggaucaagcugaaaucuccggaagcucuccuauucugagcaucacaauuuccgaggacggcucuaugagcaucaaaaacgaagaggaggaacagacgcuuaccauucugaucagaacagggcuccuggucaucuccggaguguuccccguuucuauuccgaucaccgcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaauuggcgccgggguguauaaagagggaacauuucacaccauguggcauguuacgcggggcgcggugcugaugcaccgcgggaagagaaucgagcccuccugggcugaugucaaaaaggaccucaucagcuacggaggcggguggaagcuggaaggagaguggaaagaaggcgaggaagugcagguucuugcccuggagccuggcaagaauccgcgggccgugcagaccaaacccgggauuuucaagacaaacaccggaacaaucggcgcugucucccucgauuuuagcccugggaccucuggaucccccauuguggacagaaaaggcaaggugguugggcuguacggaaauggcgucgugacacgcagcggcgccuaugugucugcgaucgcucagacggagaaguccauugaagauaacccugagaucgaagacgauaucuuccggaaaaagagacucaccauuauggaccugcaucccggggccggaaaaacaaagcgcuaccuuccugccaucguccgggaggcuauuaaaagaggccugcgcacccugauccucgccccgacccgggugguugcugccgaaauggaggaggcgcugagagggcuucccauucgcuaucaaaccccugccaucaagacggaacacaccggacgggagauuguggaccugaugugucaugcuacauucaccaugagacuccugagccccguccgggugccuaacuacaaucucaucaucauggaugaagcccacuuuacagaccccgcuuccauugccgcccgcggcuauaucucuaccagaguugagaugggggaggcugcgggcauuuucaugacggccacaccgccuggaagccgggaucccuuuccccaguccaacgcuccuaucauggacgaagaaagagaaauucccgagagaagcuggaacucuggccacgaaugggugaccgauuucaaggggaaaaccgucugguuugugccuuccaucaaggccggaaacgacaucgccgcuugccugcggaaaaauggcaagaaaguuauucagcuuagcagaaagacauucgauucugaguacgugaagacccgcgccaacgacugggauuuugucgugacaaccgacaucagcgagaugggggcgaauuucaaagcugaacgggugauugauccgagacgcuguaugaagcccgucauccugacggacggagaggaacggguuauucuggccggcccuaugcccgugacacauuccucugccgcucaaagacgcgggcggaucggcagaaacccuaaaaaugagaacgaccaguauaucuacaugggagaaccccucgagaaugaugaggacugcgcccacuggaaggaagcgaaaaugcugcuugauaacauuaauaccccggagggcaucauuccuagcauguuugaacccgagcgcgaaaagguggacgccaucgauggggaguacagacugcggggagaggcucgcaaaacauucgucgaccucaugagacggggcgaucugccuguguggcuggccuauaagguugcugccgaagggauuaacuacgcugaccgcaagugguguuuugauggaaccaaaaauaaccagauccucgaggaaaacauggagguggagauuuggacgaaggaaggcgagcgcaagaaacuuaaaccccgguggcuggacgccagaaucuauuccgauccucuggcgcucaaggaguucaaggaguucgccgcugggcgcaaaucucugacccuuaaucugaucacagaaaugggccggcuccccaccuuuaugacacagaaggccagaaacgcucuggacaaucuggccguccuccauaccgccgaggcuggaggccgcgcguacaaccacgcccuuagcgagcugccggaaacacuggagacccuccugcuucugacgcuccuggcuacagugaccgggggaauuuuccuguuucucauguccggcaaagggaucggaaagaugacccuuggcaugugcugcauuaucacagccagcauucugcugugguaugcccaaauccagccucacuggaucgcugccucuauuauccucgaguucuuucugauuguucuucugauccccgagcccgaaaaacagcggaccccucaggauaaucaacucacauacguggucauugcgauccugacgguggucgccgcuaccauggccaacgagaugggcuuccuggagaagacaaagaaagaccucgggcuuggauccaucaccacacaggaaagcgaguccaauauucuggacaucgaucugagaccggcuucugccuggacccucuaugcgguggccacgaccuuuguuacacccaugcugcggcauagcauugaaaacuccucugugaaugugagccuuaccgcuaucgccaaccaggcuacaguccugaugggccucgggaagggauggccucuguccaaaauggacauuggcguuccccugcucgccaucggguguuacagccaggugaauccuauuacccuuacggcugcccugcugcuccugguggcgcacuacgccaucaucggacccggccuucaagcuaaggccacacgcgaggcucagaaaagagccgccgcgggcauuaugaagaacccuaccgucgaugggaucacagugauugaccuggaaccgauccccuaugauccuaaguucgagaaacagcucggacagguuaugcugcugauucucugcgugacccaaguccuuaugaugcggaccacaugggcucugugugaggcccugacgcucgcuaccggccccaucucuacacugugggaagggaauccuggacgcuuuuggaacaccacaaucgccguguccauggccaauauuuucagaggcagcuaccuugcuggggccggacugcucuuuucuaucaugaagaacaccacguccacacggcgcggcaccggcaauauuggggagacccugggagaaaaauggaaaagcagacugaacgcgcucggcaaaucugaguuccagaucuauaagaaaagcgggauucaggaggucgaccggacacuugccaaggaaggaaucaagcgcggcgagaccgaucaucacgcuguguccagagggucugccaaacugcggugguuuguugaaagaaacauggugacacccgagggaaaggucguggaccugggcugcggccgcgggggauggagcuacuauuguggcgggcucaaaaauguucgggaagugaagggacugacgaaaggcgggccgggacaugaggagccuauccccauguccaccuacggcuggaaccuugucagacugcaaagcggcguggauguguucuucacacccccugaaaagugcgacacccuccugugugauauuggggaguccucucccaauccuacaaucgaagcuggacgcacccugcggguucucaaccuugucgagaauuggcugaacaauaacacgcaguuuugcauuaaggugcugaauccguauaugcccagcgugaucgagaagauggaggcccuccagagacaguacggcggggcgcugguccgcaacccucuuuccagaaauucuacccacgagauguacuggguuagcaacgccacaggaaauauuguguccucugugaacaugaucagcagaaugcugaucaaucgcuucaccaugaagcacaaaaaggcuacauaugaacccgacgucgaucucggcuccgggacccggaacauuggaaucgagagcgaaauuccuaaccuggacaucauuggcaaaagaaucgagaagauuaagcaagaacaugagaucucuuggcacuacgaccaggaucaucccuauaaaacaugggccuaccacggcuccuaugagaccaagcagacggggagcgcuucuuccauggugaauggaguugugcgccugcucacaaaaccgugggacgucgugccuaugguuacccagauggccaugaccgauacaacgcccuuuggccaacagcggguguucaaggaaaaagucgacaccagaacacaggagccuaaggaagggaccaagaaacuuaugaagaucacagcugaguggcuguggaaagagcugggaaagaaaaagacaccccgcauguguacaagagaagaguuuaccaaaaaggugcggagcaacgccgcgcucggcgccauuuucacggaugaaaauaaguggaaaucugcucgcgaggccguggaagacgggagauuuugggagcuggucgaucgggagagaaaccuucaccuggaaggaaagugcgagaccuguguuuacaauaugaugggcaaacgggaaaagaaacucggcgaguucgggaaggcuaagggaucccgcgccaucugguauauguggcugggcgccagauuucuggaguucgaggcgcucggguuucugaacgaggaccauugguucagccggggaaauucccuuagcggcguggaaggggagggccugcaccgccucggauacauucugagagaugugggcaaaaaggaagggggagcuauguacgccgacgauacagccggcugggacacccggaucacacuugaggaccugaaaaacgaagagauggucaccaaucauaugaagggggagcacaaaaagcucgcugaagccauuuuuaagcugacguaucagaacaaagugguucgcgugcaaagaccuacaccccggggaaccgucauggauaucaucucucgcagagaccagcggggcagcggacaggugggcacauacggacugaauaccuucacgaacauggaggcucaacucauucgccagauggaaggcgaggggaucuucaaguccauucagcaucugaccgccacagaggaaaucgcgguucagaauuggcuugccagagugggacgggagcgccugucuagaauggcuauuagcggcgaugacugcgucgugaaaccgaucgaugaccgguuugccuccgcucucaccgcccugaacgauauggggaagguuagaaaagacauccaacagugggaaccuucucgcggauggaaugauuggacacaggugcccuucugcagccaccacuuucaugagcuugucaugaaggacggccgggugcuggucgugcccuguagaaaccaggaugaacucauugggcgcgcgcggaucucccaaggcgccggauggucucugaaggagaccgcuugccugggcaaaagcuaugcccagauguggacacucauguacuuccacagacgcgaccugcggcuugcugccaacgcuauuuguuccgccguuccuagccauugggugccgaccucuagaacgacaugguccauccacgcgaagcacgaguggaugaccaccgaagauaugcuggccgucuggaaucgcguguggauucaggagaaccccuggauggaagacaaaacaccuguggagagcugggaagagguucccuaucucgggaagcgggaggaccaguggugcggaucucugaucggccuuaccuccagagcuacaugggccaaaaauauucaaacggccaucaaccaggugcgcagccugaucgggaaugaagaguacaccgauuauaugccuuccaugaagcgguuuagacgggaagaggaagaggcuggaguccucugguga

SEQ ID NO: 19802 - RNA, 9876 nt, Artificial Sequence
  derived and/or modified CDS sequence (opt5) from DENV-2__EU482748__SS-prME
accgccggagugaucgucaugcugauucccacggcuauggccuuccaccucacgacccggaauggggagccucauaugaucguuggacggcaggaaaagggcaagagccugcuuuuuaagacagaggacggggugaauaugugcacccugauggcgauugaucucggagaacugugugaggaaacaaucaccuacaagugcccgcuucugcgccaaaaugagcccgaggacauugauuguuggugcaauagcacaucuaccugggugacguauggcaccuguacaaccacaggggaacacagacgggagaagcgcagcgucgcucucgugccucauguuggaaugggccuggaaaccagaacggagacauggauguccucugagggcgccuggaaacacgugcagcggaucgaaaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgacuuuguggaggggguuucuggaggcagcuggguggauaucguccucgaacacggguccugugugacaaccauggccaagaauaagcccacacuggacuucgagcuuaucaaaaccgaagcuaagcagccugccacgcugagaaaauauugcauugaggcuaagcucacaaacaccaccacagagagccgguguccgacccaaggagaacccucucugaaugaggaacaggauaaacgcuuuaucugcaagcauuccaugguggacagaggcuggggcaacggguguggacuguucggcaaagggggaauugucacaugcgccauguuuacgugcaaaaagaauauggagggcaaaguugugcagccugaaaaccucgaguacaccaucgugauuacaccccacagcggggaggaacaugcggucggaaaugauaccggcaagcacggcaaagagaucaagaucacaccucagucuuccauuaccgaagccgagcugacgggguauggaaccgugacaauggaauguagcccccggaccggccuugacuucaacgagaugguucugcuccaaauggaggauaaggcuuggcuggugcaccgccagugguuucuugaccugccgcucccuuggcugcccggggccgauacacagggaucuaauuggauccagaaggaaacccuggucacguucaagaacccucaugcuaaaaagcaagacgugguugugcucggcucccaggagggggccaugcacacagcccugaccggcgcuacagaaauucagaugagcuccggaaaucuucuguuuaccggccaucucaaaugcagacugcggauggacaaacuucaacugaaagggaugucuuacagcauguguaccggaaaguucaagaucgucaaagagauugcggagacacagcacggcacgaucgugaucagaguccaguaugaaggggauggaucccccugcaagauucccuucgagaucaccgaccucgaaaaacgccaugugcugggccggcugauuacaguuaacccuaucgugaccgagaaggauagcccggucaacauugaagccgagcccccuuuuggggacucuuacaucauuaucggcguggagcccggacagcucaaacugaauugguucaagaagggcuccagcaucgggcaaauguuugaaacaaccaugagaggagcuaaacgcauggccauucuuggcgauacggccugggacuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgauagcggaugugugguuucuuggaagaauaaagagcucaagugcggcuccgggaucuucauuacagacaacgugcacacguggaccgaacaguacaaguuucaaccugagagccccuccaaacuggcuucugccauccagaaggcucaugaagagggcauuuguggaaucagaagcgucacacgccuugagaaucugauguggaaacagaucaccccggaacucaaccacauucuguccgagaaugaagugaagcugacaaucaugaccggcgauauuaaagggaucaugcaggccggaaagcggucucuuagaccucaacccacggagcucaaauauagcuggaagaccuggggcaaggcgaaaaugcuguccacagaaagccauaaccagaccuuccugauugacgggccugagacagccgagugccccaauaccaaccgcgcuuggaacucucucgaaguugaggauuacggauuuggcguguucacaaccaacaucuggcugaaacuucgggaaaaacaggacgucuuuugugacuccaagcugaugagcgccgcuaucaaagauaauagagccgugcacgcggacaugggcuauuggauugagucugcccucaacgauacguggaagauggagaaggcuuccuucaucgaaguuaaaagcugccacuggccuaagucucauacacuguggagcaauggggugcuggaguccgaaaugauuauccccaaaaacuucgccggaccggucagccagcacaacuaccgcccuggcuaucauacccaaaccgcugggcccuggcaccuuggaaagcucgagauggacuuugaucugugugaaggcacaaccgugguggucacggaggacugcgggaaucggggacccucucugagaacaaccacagccuccggcaaacucauuaccgaguggugcugucggagcugcacacugccuccgcuucgcuacagaggcgaagauggguguugguacggaauggagauccggccccugaaggaaaaggaggaaaaccucguuaauucccuggugaccgccggccaugggcagauugacaacuucucucugggagugcuuggcauggcucucuuucuggaggagaugcugagaacgcgcaucgggaccaaacacgcgauccuccuggucgccgugagcuucguuacacuuauuaccggaaauauguccuuucgggaucugggcagagugauggucauggugggcgcuacaaugaccgacgauaucgggaugggaguuacguaucucgcccugcuggccgcuuucaaggugcgcccuacauuugccgcgggccuucugcucagaaaacugaccucuaaggaacucaugauggcuacaauugggaucgcccugcuuagccaguccaccauucccgagaccauccuggaacucacagacgcccuggcucugggaaugaugguccuuaaaaucgugcggaacauggagaaguaccaacuggccguuacgauuauggcgaucucuugcgugccuaaugcugucauucuccagaacgccuggaaggugagcuguaccauccuggccgcuguguccgucagcccccuccugcuuacaucuucccagcagaaagccgauuggauuccucuggcucucaccaucaagggccugaaucccacagccaucuuccugaccacgcuuagccgcacaucuaaaaagagauccuggccgcugaacgaagcgauuauggccguugggauggugagcauccucgcuucuucccugcucaaaaaugacauuccuaugaccggaccccugguggccggcggccuucugaccgucugcuaugugcugacagggcggagcgcugaccucgagcuggagcgcgccgccgauguuaagugggaagaccaagcugagaucuccggaagcucuccuauucuuagcaucaccauuuccgaagauggcucuaugagcaucaaaaacgaggaggaagaacagacacugacgauccucauuagaaccgggcugcucgugaucuccggagucuuucccgugucuauuccgaucacagcggccgcuugguaccugugggaaguuaagaagcagcgggccggcgugcuuugggacgucccuucucccccucccguggagaaagccgaacuggaggauggggcuuaucgcauuaagcagagaggaauccugggcuacucccaaaucggcgccggggucuauaaagagggaaccuuccacacaauguggcaugugacccggggcgcgguucucaugcaccgcgggaagagaauugaacccuccugggcugacgugaaaaaggaucugaucagcuacggaggcggguggaaacuugagggagaauggaaagagggcgaagagguccaggugcuggcccucgagccuggcaagaauccgcgggccguucagacgaaacccgggauuuuuaagaccaacacaggaaccaucggcgcugugucccuggacuucagcccugggacaucuggaucccccauugucgauagaaaaggcaaggugguggggcucuacggaaauggcguugucacccgcagcggcgccuaugugucugcgaucgcucagacagaaaaguccaucgaggacaacccugaaauugaggaugacaucuuucggaaaaagagacugacgauuauggaucuucaucccggggccggaaaaaccaagcgcuaccugccugccaucgugcgggaagcuauuaaaagaggccugcgcacacucauccuggccccgacccgggucguggcugccgagauggaggaagcgcuuagagggcugcccauucgcuaucaaaccccugccaucaagacagagcacacgggacgggaaaucguugaccucaugugucaugcuaccuucacaaugagacugcucagccccgugcgggucccuaacuacaaucugauuaucauggacgaggcccacuucaccgaucccgcuuccauugccgcccgcggcuauaucucuacaagaguggagaugggggaagcugcgggcauuuuuaugaccgccacgccgccuggaagccgggaccccuucccccaguccaacgcuccuaucauggaugaggaacgcgagauccccgaaagaagcuggaacucuggccacgaguggguuacagacuuuaaggggaaaaccgugugguucgucccuuccauuaaggccggaaacgauaucgccgcuugccuucggaaaaauggcaagaaagugauucagcugagcagaaagaccuuugacucugaguacguuaagacacgcgccaacgauugggacuucguggucaccacagauaucagcgaaaugggggcgaauuuuaaagcugagcgggugauugacccgagacgcuguaugaagcccgugauccugaccgauggagaagaacgggucauccucgccggcccuaugcccguuacgcauuccucugccgcucaaagacgcgggcggauuggcagaaacccuaaaaaugaaaacgaccaguauaucuacaugggagagccccuggagaaugacgaagauugcgcccacuggaaggaggcgaaaaugcuucuggacaacauuaauacaccggaaggcaucauuccuagcauguucgagcccgaacgcgagaagguggaugccaucgacggggaguacagacuccggggagaagcucgcaaaaccuuuguggaucugaugagacggggcgaccugccugucuggcucgccuauaagguggcugccgaggggauuaacuacgcugaucgcaagugguguuucgacggaaucaaaaauaaccagauccuugaagagaacauggagguugaaauuuggacaaaggagggcgaacgcaagaagcugaaaccccgguggcuggaugccagaaucuauuccgacccucucgcgcugaaggaguuuaaggaguucgccgcugggcgcaaaucucuuacccugaaucucauuacggagaugggccggcugcccaccuucaugacacagaaggccagaaacgcucuggauaaucucgccgugcuucauaccgccgaggcuggaggccgcgcguacaaccacgcccugagcgaacugccggagacacucgaaacccugcuucugcucacacugcuggcuaccgucacagggggaaucuuucucuuccuuauguccggcaaagggauuggaaagaugacacugggcaugugcugcaucaucaccgccagcauucugcucugguaugcccaaauccagccucacuggauugcugccucuaucauucuggaguuuuuccuuaucgugcugcucauccccgaacccgagaaacagcggaccccucaggacaaucaacugacauacguugugauugcgauccugaccgucguggccgcuacaauggccaacgagaugggcuuucucgaaaagacgaagaaagaucuugggcugggauccauuaccacacaggagagcgaauccaauauccuggacauugaccucagaccggcuucugccuggacccuguaugcggucgccacaaccuucgugacgcccaugcuucggcauagcaucgagaacuccucuguuaaugugagccugaccgcuauugccaaccaggcuacagugcucaugggccuggggaagggauggccucuguccaaaauggauaucggcgucccccuccuugccaucggguguuacagccagguuaauccuauuacccugacagcugcccugcuccugcuuguggcgcacuacgccaucauuggacccggccugcaagcuaaggccacccgcgaagcucagaaaagagccgccgcgggcaucaugaagaacccuacgguggacgggauuacagucaucgaucucgagccgauccccuaugacccuaaguuugagaaacagcugggacaggugaugcugcucauucuuugcguuacccaagugcugaugaugcggacaaccugggcucugugugaagcccucacccuggcuacaggccccaucucuacgcuuugggaggggaauccuggacgcuucuggaacaccacaauugccgucuccauggccaauaucuuuagaggcagcuaccuggcuggggccggacuccuguucucuauuaugaagaacaccacauccacccggcgcggcacgggcaauaucggggaaacacugggagagaaauggaaaagcagacucaacgcgcuuggcaaaucugaguuucagaucuauaagaaaagcgggauucaggaaguggaucggacccuggccaaggagggaaucaagcgcggcgaaaccgaccaucacgcugucuccagagggucugccaaacugcggugguucguggagagaaacaugguuacacccgaaggaaagguggucgaucucggcugcggccgcgggggauggagcuacuauuguggcgggcugaaaaaugugcgggagguuaagggacuuaccaaaggcgggccgggacaugaggaaccuauucccauguccacauacggcuggaaccuggugagacuccaaagcggcgucgacguguuuuucacgcccccugagaagugcgauacccugcugugugacaucggggaauccucucccaauccuacaauugaggcuggacgcacccuccgggugcuuaaccugguugaaaauuggcugaacaauaacacacaguucugcaucaagguccucaauccguauaugcccagcgugaucgagaaaauggaggcccugcagagaaaguacggcggggcgcuugugcgcaacccucuguccagaaauucuacccacgaaauguacugggucagcaacgccacgggaaauauuguuuccucugugaacaugaucagcagaaugcucauuaaucgcuuuaccaugaaacacaagaaaacaaccuaugagcccgauguggaccugggcuccgggacacggaacaucggaauugaaagcgagaucccuaaccuggauauuaucggcaagagaaucgaaaagauuaaacaggagcaugagaccucuuggcacuacgaccaagaccaucccuauaagacaugggcuuaccacggcuccuaugaaaccaaacagacggggagcgccucuuccauggucaauggagugguucgccuccuuacaaagccgugggauguggucccuauggugacccagauggcuaugaccgacacaacgcccuucggccagcaacggguuuuuaaagagaagguggauaccagaacacaggaaccuaaggaggggaccaaaaagcugaugaaaaucacagccgaguggcuguggaaggaacucggcaagaagaaaacccccagaauguguacaagagaggaguucacccggaagguccgcagcaacgcugcccugggcgcgauuuuuacggacgagaauaaguggaaaucugccagagaagcuguggaggaugggcgguucugggagcuuguggacagagaacggaaccugcaccucgagggaaagugcgaaaccugugucuacaauaugaugggcaaacgcgagaagaaacugggcgaauuugggaaggccaagggauccagagcuaucugguauauguggcugggcgcccgguuccucgaguuugaggcccugggguuccuuaacgaagaucauugguuuagccgcggaaauucccugagcggcguugagggggaaggccuccacagacugggauacauucuucgggacgugucuaaaaaggagggcggggcgauguacgcugaugacacagccggaugggauacccgcaucacacuggaagaccucaaaaacgaggagauggugaccaaucauaugaagggcgaacacaaaaagcuggccgaggcuaucuucaagcugacguaucagaacaaagucgugagaguucagcggccuacaccccgcgggaccgugauggacauuaucagcagacgggaucaacgcggauccggccaggucgggacauacggccucaauaccuuuacgaacauggaagcccagcugauuagacaaauggagggagagggcaucuucaagucuauucagcaucuuaccgcuacagaagagaucgugguucagaauuggcuggcccggguggggcgcgaaagacucagccggauggcgaucuccggagacgauugcgucgugaaaccgauugacgauagauucgccucugcucugaccgcccuuaacgacaugggcaagguucgcaaagauauccagcaaugggagccuagccggggguggaaugacuggacacaggugcccuuuugcucccaccacuuccaugaacuggucaugaaggauggaagagugcucgucgugcccugucgcaaccaggacgagcugauuggccgggcuagaaucucucagggggccggcuggagccugaaggagaccgcgugccucggaaaauccuaugcccaaauguggacacugauguacuuucaccgccgggaucuuagacuggcugccaacgcuauuuguagcgccguuccuucucauugggugccgaccucccgcacgacauggagcauccacgcuaagcacgaauggaugaccaccgaggacaugcucgccgucuggaaucggguguggauucaggaaaaccccuggauggaggauaaaacaccuguggaaucuugggaggagguucccuaucugggcaagagagaagaccaguggugcgggucccuuaucggacugaccagccgcgcgacaugggccaaaaauauccagacggcuauuaaccaagugcggucccucaucggcaaugaggaauacaccgacuauaugccuucuaugaagagauuccggagagaggaagaggaggccgggguccugugguga

SEQ ID NO: 19803 - RNA, 9876 nt, Artificial Sequence
  derived and/or modified CDS sequence (opt5) from DENV-2__EU482749__SS-prME
accgccggcgugaucgucaugcugauucccaccgcuauggccuuccaccucacgacccggaauggggagccucauaugaucguuggacggcaggaaaagggcaagucccugcuuuuuaagaccgaggacggggugaauaugugcacccugauggcgauugaucucggagaacugugugaggacaccaucaccuacaaaugcccgcuucugcgccaaaacgaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagaccaucgagacauggauccugcggcaucccggguucaccauuauggccgcuauccucgccuacaccauuggaacaacgcacuuucagcgcgcucugaucuucauucuucugaccgccgucgcgccuagcaugacaaugagaugcaucggcauuuccaaccgggauuuuguggaagggguuucuggaggcagcuggguggacaucguccucgagcacggguccugugugaccacaauggccaagaauaagcccacccuggauuucgaacuuaucaaaacggaggcuaagcagccugccacacugcgcaaauauugcauugaagcuaagcucaccaacaccacaaccgagagcagauguccgacacaaggagagcccucucuguccgaagaacaggacaaacgguuuaucugcaagcauagcaugguggaucgcggcuggggcaauggguguggacuguucggcaaagggggaauugucacgugcgccauguuuaccugcaaaaagaacauggaaggcaaaguugugcagccugagaaucucgaauacacaaucgugauuacaccccacucuggggaggagcaugcggucggaaacgacacaggcaagcacggcaaagaaaucaagaucaccccucaguccagcauuacggaggccgaacugaccggguauggaacagugaccauggaguguucucccagaacaggccuugauuucaaugaaaugguucugcuccaaauggaggacaaggcuuggcuggugcaccggcagugguuucuugaucugccgcucccuuggcugcccggggccgacacccagggauccaacuggauccagaaggagacgcuggucacauucaagaauccucaugcuaaaaagcaagacgugguugugcucggcagccaggaaggggccaugcacaccgcccugacaggcgcuaccgagauucagauguccucuggaaaccuucuguuuaccggccaucucaaaugccgccugagaauggauaaacuucaacugaaagggaugagcuacuccauguguacaggaaaguucaagaucgucaaagaaauugcggagacgcagcacggcaccaucgugauccggguccaguaugagggggacggaagccccugcaagauucccuucgaaaucacagaucucgagaaaagacaugugcugggccgccugauuaccguuaauccuaucgugacagaaaaggacucuccggucaacauugaggccgaacccccuuuuggggauuccuacaucauuaucggcguggagcccggacagcucaaacugaacugguucaagaagggcagcucuaucgggcaaauguuugagaccacgaugcggggagcuaaaagaauggccauucuuggcgacacagccugggauuucgggagccugggaggcguuuuuaccuccaucgggaaggcucuccaccagguguucggcgccauuuacggagcggcuuuuucuggcgucagcuggaccaugaaaauccugauuggggugaucaucacauggauuggaaugaacucccgcagcaccucucuguccgugagccuuguucucgucggcguggugacacuguaucugggggccaugguccaggccgacucuggaugugugguuuccuggaagaacaaagaacucaagugcggcagcgggaucuucauuacggauaaugugcacaccuggacagagcaguacaaguuucaaccugaaucccccucuaaacuggcuagcgccauccagaaggcucaugaggaaggcauuuguggaauccgguccgucaccagacuugagaaccugauguggaaacagaucacaccggagcucaaucacauucugucugaaaacgaggugaagcugaccaucaugacgggcgacauucgcgggaucaugcaggccggaaaacggagccuuagaccucaacccaccgaacucaaguauuccuggaaaacauggggcaaggcgaagaugcugagcaccgagucucauaaucagacauuccugauugaugggccugaaaccgccgagugccccaacacaaaucgcgcuuggaacucccucgagguugaagacuacggauuuggcguguucaccacgaauaucuggcugaaacuucgggagaagcaggacgucuuuugugauagcaaacugaugucugccgcuaucaaggacaacagagccgugcacgcggauaugggcuauuggauugaauccgcccucaaugacacauggaaaauggagaaggcuagcuucaucgagguuaagucuugccacuggccuaaaagccauacccugugguccaacggggugcuggaaagcgagaugauuauccccaagaauuucgccggaccggucucucagcacaacuaccgcccuggcuaucauacccaaacagcugggcccuggcaccuuggaaaacucgaaauggauuuugaccugugugagggcaccacggugguggucacagaagauugcgggaaccggggacccucccugagaaccacaaccgccagcggcaagcucauuacagaguggugcugucgguccugcacccugccuccgcuucgcuacagaggcgaggacggguguugguacggaauggaaauccggccccugaaagagaaggaagagaaucucguuaacucucuggugacggccggccaugggcagauugauaauuucagccugggagugcuuggcauggcucucuuucuggaagagaugcugagaacccgcaucgggacaaagcacgcgauccuccuggucgccguguccuucguuacccuuauuacaggaaacaugucuuuucgggaccugggcagagugauggucauggugggcgcuaccaugacggaugacaucgggaugggaguuacauaucucgcccugcuggccgcuuucaaagugcgcccuaccuuugccgcgggccuucugcucagaaagcugacaagcaaagagcucaugauggcuaccauugggaucgcccugcuuucccagucuaccauucccgaaacaauccuggagcucacggaugcccuggcucugggaaugaugguccuuaagaucgugcggaauauggaaaaauaccaacuggccguuaccauuauggcgaucagcugcgugccuaacgcugucauucuccagaaugccuggaagguguccuguacaauccuggccgcugugagcgucucuccccuccugcuuaccuccagccagcagaaggccgacuggauuccucuggcucucacaaucaaaggccugaaccccaccgccaucuuccugacgacacuuucucgcaccuccaagaaaagaagcuggccgcugaaugaggcgauuauggccguugggauggugucuauccucgcuuccagccugcucaagaacgacauuccuaugaccggaccccugguggccggcggccuucugacagucugcuaugugcugaccgggcgguccgcugaucucgaacuggagcgcgccgccgacguuaaaugggaggaucaagcugaaaucagcggaucuagcccuauucuuuccaucacaauuucugaggacggcagcauguccaucaagaaugaagaggaggaacagacgcugaccauccucauuagaacagggcugcucgugaucucuggagucuuucccgugagcauuccgaucaccgcggccgcuugguaccugugggagguuaaaaagcagcgggccggcgugcuuugggaugucccuucucccccucccguggaaaaggccgagcuggaagacggggcuuaucgcauuaaacagagaggaauccugggcuacagccaaaucggcgccggggucuauaaggagggaacauuccacaccauguggcaugugacgcggggcgcgguucucaugcaccgcgggaaaagaauugagcccagcugggcugaugugaagaaagaccugaucuccuacggaggcggguggaaacuugaaggagaguggaaggaaggcgaggaaguccaggugcuggcccucgagccuggcaaaaacccgcgggccguucagaccaagcccgggauuuuuaaaacaaauaccggaacaaucggcgcugugagccuggauuucucuccugggaccuccggaagccccauugucgacagaaagggcaaagugguggggcucuacggaaacggcguugucacacgcucuggcgccuauguguccgcgaucgcucagacggaaaagagcaucgaagauaauccugagauugaagacgauaucuuucggaagaaaagacugaccauuauggaccuucaucccggggccggaaagacaaaacgcuaccugccugccaucgugcgggaggcuauuaagagaggccugcgcacccucauccuggccccgacccgggucguggcugccgaaauggaggaggcgcuuagagggcugcccauucgcuaucaaacaacggccaucaaaaccgaacacacaggacgggagaucguugaccucaugugucaugcuaccuucacaaugagacugcucuccccugugcggguccccaacuacaaccugauuaucauggaugaagcccacuucaccgacccugcuucuauugccgcccgcggcuauaucagcacgagaguggagaugggggaggcugcgggcauuuuuaugacagccacaccucccggaucccgggaucccuucccccagagcaaugcucccaucauggacgaggagcgcgaaaucccugagagaucuuggaacuccggccacgaauggguuaccgauuuuaaggggaagacagugugguucguccccagcauuaaagccggaaaugacaucgccgcuugccuucggaagaacggcaaaaaggugauucagcugucuagaaaaaccuuugauagcgaguacguuaagacacgcgccaaugacugggauuucguggucaccacggacaucuccgagaugggggcgaacuuuaaggcugaacgggugauugauccuagacgcuguaugaaaccggugauccugacagacggagaggaacgggucauccucgccggccccaugccuguuacccauucuagcgccgcucaaagacgcgggcggauuggcagaaaucccaagaacgagaaugaccaguauaucuacaugggagaaccucuggagaacgaugaggacugcgcccacuggaaagaagcgaagaugcuucuggauaauauuaacacacccgagggcaucauuccguccauguucgaaccugagcgcgaaaaaguggacgccaucgauggggaguacagacuccggggagaggcucgcaagaccuuuguggaccugaugagacggggcgaucugcccgucuggcucgccuauaaaguggcugccgaagggauuaauuacgcugaccgcaagugguguuucgauggaaucaagaacaaucagauccuugaggaaaacauggagguugagauuuggacgaaagaaggcgagagaaagaaacugaagccucgguggcuggacgccagaaucuauucugauccccucgcgcugaaagaauuuaaggaguucgccgcugggcgcaagagccuuacccugaaccucauuacagaaaugggccggcugccuaccuucaugacacagaaagccagaaaugcucuggacaaccucgccgugcuucauaccgccgaggcuggaggccgcgcguacaaucacgcccuguccgagcugcccgaaacacucgagacccugcuucugcucacgcugcuggcuacagucaccgggggaaucuuucucuuccuuaugagcggcaaggggauuggaaaaaugacccugggcaugugcugcaucaucacagccucuauucugcucugguaugcccaaauccagccgcacuggauugcugccuccaucauucuggaauuuuuccuuaucgugcugcucaucccugagcccgaaaagcagcggacaccccaggauaaccaacugacauacguugugauugcgauccugacggucguggccgcuaccauggccaaugagaugggcuuucucgagaaaacaaagaaggaccuugggcugggaagcauuaccacacaggaauccgagucuaacauccuggacauugaucucagaccugcuagcgccuggacccuguaugcggucgccacgaccuucgugacaccgaugcuucggcauuccaucgaaaauucuagcguuaacgugucccugaccgcuauugccaaucaggcuacagugcucaugggccuggggaaaggauggccccugagcaagauggacaucggcgucccucuccuugccaucggguguuacucucagguuaaccccauuacccugacggcugcccugcuccugcuuguggcgcacuacgccaucauuggaccuggccugcaagcuaaagccacacgcgaggcucagaagagagccgccgcgggcaucaugaaaaaucccaccguggaugggauuacagucaucgaccucgaaccuaucccguaugaucccaaguuugagaagcagcugggacaggugaugcugcucauucuuugcguuacccaagugcugaugaugcggaccacaugggcucugugugaggcccucacgcuggcuaccggcccuaucuccacacuuugggaagggaaccccggacgcuucuggaauaccacaauugccgucagcauggccaacaucuuuagaggcucuuaccuggcuggggccggacuccuguucuccauuaugaaaaauaccacgaacacacggcgcggcaccggcaauaucggggagacccugggagaaaaguggaaaagcagacucaacgcgcuuggcaagucugaguuucagaucuauaaaaagagcgggauucaggagguggaccggacacuggccaaagaaggaaucaagcgcggcgagaccgaucaucacgcugucuccagagggucugccaagcugcggugguucguggaaagaaacaugguuacaccugagggaaaaguggucgaccucggcugcggccgcgggggauggagcuacuauuguggcgggcugaagaaugugcgggaaguuaaaggacuuacgaagggcgggcccggacaugaggagccgauuccuauguccaccuacggcuggaaccuggugagacuccaaagcggcgucgauguguuuuucacaccgcccgaaaaaugcgacacccugcugugugauaucggggaguccucuccuaaucccacaauugaagcuggacgcacccuccgggugcuuaaccugguugagaauuggcugaacaauaacacgcaguucugcaucaagguccucaauccuuauaugccgagcgugaucgaaaagauggaggcccugcagagaaaauacggcggggcgcuugugcgcaacccccuguccagaaauucuacccacgagauguacugggucagcaacgccacaggaaauauuguuuccucugugaacaugaucagcagaaugcucauuaaucgcuuuaccaugaagcacaaaaaggcuacauaugaaccugacguggaucugggcuccgggacccggaacaucggaauugagagcgaaauccccaaccuggacauuaucggcaaaagaaucgagaagauuaagcaggaacaugagacaucuuggcacuacgaccaagaucauccuuauaaaaccugggccuaccacggcuccuaugagacgaagcagacagggagcgcuucuuccauggucaauggagugguucgccuccuuaccaaacccugggacguggucccgauggugacccagauggccaugacagauacgaccccuuucggccagcaacggguuuuuaaggaaaaaguggacacaagaacccaggagcccaaggaagggacaaagaaacugaugaagaucaccgcugaguggcuguggaaagagcucggaaagaaaaagacaccucgcauguguaccagagaagaguucacgcggaaaguccgcagcaacgccgcgcugggcgccauuuuuaccgaugaaaauaaguggaagucugcuagagaggccguggaagacgggcgguucugggagcuuguggauagagagcggaaccugcaccucgaaggaaaaugcgagacaugugucuacaauaugaugggcaagcgcgagaagaagcugggcgaguuugggaaagcuaagggauccagagccaucugguauauguggcugggcgcccgguuccucgaauuugaggcgcugggguuccuuaacgaggaccauugguuuagccgcggaaauucccugagcggcguugaaggggagggccuccacagacugggauacauucuucgggaugugggcaagaaagaagggggagcuauguacgccgacgauaccgccggcugggacacacgcaucacccuggaggaccucaagaacgaagagauggugacgaaucauaugaaaggggagcacaagaaacuggcugaagccaucuucaagcugacauaucagaacaaggucgugagaguucagcggcccaccccucgcggaacagugauggauauuaucucuagacgggaccaacgcggcagcgggcaggucggcaccuacggacucaauacguuuaccaacauggaggcucagcugauuagacaaauggaaggcgaggggaucuucaaauccauucagcaucuuacagccaccgaggaaaucgcggugcagaauuggcuggcccggguuggacgcgagagacucucucggauggcuaucagcggcgaugacugcguggucaagcccauugaugacagauucgccuccgcucugacagcccuuaacgauauggggaaaauccgcaaggacauucagcaaugggaaccgucucggggauggaaugauuggacccaggugccuuuuugcagccaccacuuccaugagcugguuaugaaagacggcagagugcucgucgugcccugucgcaaccaggaugaacugaucgggcgggcgagaauuucccagggcgccggauggucucugaaggagacagcuugccucggcaagagcuaugcccaaauguggacccugauguacuuucaccgccgggaccuuagacuggcugccaacgcuaucuguuccgccguccccagccauugggugccuacgucucgcacaaccugguccauucacgcgaaacacgaguggaugaccacagaagauaugcucgccguuuggaaucggguguggauccaggagaacccguggauggaagacaagacccccgucgagagcugggaagaggugccuuaucuggggaaaagagaggaccaguggugcggaucucuuaucggccugacaucccgcgcuacgugggccaagaauauucagaccgccaucaaccaagugcggagccucauugggaaugaagaguacacagauuauaugcccuccaugaaaagauuccggagagaagaggaagaggcuggaguucugugguga

SEQ ID NO: 19804 - RNA, 9876 nt, Artificial Sequence
  derived and/or modified CDS sequence (opt5) from DENV-2__EU482751__SS-prME
accgccggcgugaucgucaugcugauucccaccgcuauggccuuccaccucacgacccggaauggggaaccucauaugaucguuggacggcaggaaaagggcaagagccugcuuuuuaagaccgaagacggggugaauaugugcacccugauggcgauugaucucggagaacugugugaagacacgaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugacuucugugagggcacaaccguggucguuacggaagauugcgggaaucggggacccucucugagaacaaccacagccuccggcaaacugauuaccgaguggugcugucggagcugcacacucccuccgcugcgcuacagaggcgaggacggguguugguacggaauggaaauccggccccuuaaggagaaggaagagaaccuggugaauagccucgugaccgccggccaugggcagauugauaacuuuucucugggaguccugggcauggcucuuuuccucgaagagaugcugagaacgcgcaucgggaccaaacacgcgauccugcucguggccguuagcuuugugacacugauuaccggaaauauguccuuccgggaccuuggcagagucauggugaugguuggcgcuacaaugaccgaugacaucgggaugggagugacguaucuggcccuccuggccgcuuuuaagguccgcccuacauucgccgcgggccugcuucugagaaaacucaccucuaaggagcugaugauggcuacaauugggaucgcccuccugagccaguccaccauucccgaaaccauccuugagcugacagaugcccucgcucugggaaugauggugcugaaaaucguucggaacauggaaaaguaccaacuugccgugacgauuauggcgaucucuugcgucccuaaugcugugauucugcagaacgccuggaaggugagcuguaccauccucgccgcugucuccguuagcccccugcuccugacaucuucccagcagaaagccgacuggauuccucuugcucugaccaucaagggccucaaucccacagccaucuuucugaccacgcugagccgcacaucuaaaaagagauccuggccgcuuaacgaggcgauuauggccguggggauggugagcauccuggcuucuucccuccugaaaaaugacauuccuaugaccggaccccucgucgccggcggccugcuuaccgugugcuauguucugacagggcggagcgcugaucuggaacucgagcgcgccgccgacgugaagugggaggaucaagcugaaaucuccggaagcucuccuauucugagcaucaccauuuccgaggacggcucuaugagcaucaaaaacgaagaggaggaacagacacuuacgauccugauuagaaccgggcuccuggucaucuccggaguguuccccguuucuauuccgaucacagcggccgcuugguaccucugggaggugaagaagcagcgggccggcguccugugggaugugccuucucccccucccgucgaaaaagccgagcuugaagacggggcuuaucgcauuaagcagagaggaauccugggcuacucccaaaucggcgccgggguguauaaagagggaaccuuucacacaauguggcauguuacccggggcgcggugcugaugcaccgcgggaagagaauugagcccuccugggcugaugucaaaaaggaccucaucagcuacggaggcggguggaagcuggaaggagaguggaaagaaggcgaggaagugcagguucuugcccuggagccuggcaagaauccgcgggccgugcagacgaaacccgggauuuucaagaccaacacaggaaccaucggcgcugucucccucgauuuuagcccugggacaucuggaucccccauuguggacagaaaaggcaaggugguugggcuguacggaaauggcgucgugacccgcagcggcgccuaugugucugcgaucgcucagacagagaaguccaucgaagauaacccugagauugaagacgauaucuuccggaaaaagagacucacgauuauggaccugcaucccggggccggaaaaaccaagcgcuaccuuccugccaucguccgggaggcuauuaaaagaggccugcgcacacugauccucgccccgacccgggugguugcugccgaaauggaggaggcgcugagagggcuucccauucgcuaucaaaccccugccaucaagacagaacacacgggacgggagaucguggaccugaugugucaugcuaccuucacaaugagacuccugagccccguccgggugccuaacuacaaucucauuaucauggaugaagcccacuuuaccgaccccgcuuccauugccgcccgcggcuauaucucuacaagaguugagaugggggaggcugcgggcauuuucaugaccgccacgccgccuggaagccgggaucccuuuccccaguccaacgcuccuaucauggacgaagaaagagaaauccccgagagaagcuggaacucuggccacgaaugggugacagauuucaaggggaaaaccgucugguuugugccuuccauuaaggccggaaacgacaucgccgcuugccugcggaaaaauggcaagaaaguuauucagcuuagcagaaagaccuucgauucugaguacgugaagacacgcgccaacgacugggauuuugucgugaccacagacaucagcgagaugggggcgaauuucaaagcugaacgggugauugauccgagacgcuguaugaagcccgucauccugaccgacggagaggaacggguuauccuggccggcccuaugcccgugacgcauuccucugccgcucaaagacgcgggcggauuggcagaaacccuaaaaaugagaacgaccaguauaucuacaugggagaaccccucgagaaugaugaggacugcgcccacuggaaggaagcgaaaaugcugcuugauaacauuaauacaccggagggcaucauuccuagcauguuugaacccgagcgcgaaaagguggacgccaucgauggggaguacagacugcggggagaggcucgcaaaaccuucgucgaccucaugagacggggcgaucugccuguguggcuggccuauaagguugcugccgaagggauuaacuacgcugaccgcaagugguguuuugauggaaucaaaaauaaccagauccucgaggaaaacauggagguggagauuuggacaaaggaaggcgagcgcaagaaacuuaaaccccgguggcuggacgccagaaucuauuccgauccucuggcgcucaaggaguucaaggaguucgccgcugggcgcaaaucucugacccuuaaucugauuacggaaaugggccggcuccccaccuuuaugacacagaaggccagaaacgcucuggacaaucuggccguccuccauaccgccgaggcuggaggccgcgcguacaaccacgcccuuagcgagcugccggaaacacuggagacccuccugcuucugacacuccuggcuaccgugacagggggaaucuuccuguuucucauguccggcaaagggauuggaaagaugacacuuggcaugugcugcaucaucaccgccagcauucugcugugguaugcccaaauccagccucacuggauugcugccucuaucauucucgaguucuuucugaucguucuucugauccccgagcccgaaaaacagcggaccccucaggauaaucaacucacauacguggucauugcgauccugaccguggucgccgcuacaauggccaacgagaugggcuuccuggagaagacgaagaaagaccucgggcuuggauccauuaccacacaggaaagcgaguccaauauccuggacauugaucugagaccggcuucugccuggacccucuaugcgguggccacaaccuuuguuacgcccaugcugcggcauagcaucgaaaacuccucugugaaugugagccuuaccgcuauugccaaccaggcuacaguccugaugggccucgggaagggauggccucuguccaaaauggacaucggcguuccccugcucgccaucggguguuacagccaggugaauccuauuacccuuacagcugcccugcugcuccugguggcgcacuacgccaucauuggacccggccuucaagcuaaggccacccgcgaggcucagaaaagagccgccgcgggcaucaugaagaacccuacggucgaugggauuacagugaucgaccuggaaccgauccccuaugauccuaaguucgagaaacagcucggacagguuaugcugcugauucucugcgugacccaaguccuuaugaugcggacaaccugggcucugugugaggcccugacccucgcuacaggccccaucucuacgcugugggaagggaauccuggacgcuuuuggaacaccacaauugccguguccauggccaauaucuucagaggcagcuaccuugcuggggccggacugcucuuuucuauuaugaagaacaccacauccacccggcgcggcacgggcaauaucggggagacacugggagaaaaauggaaaagcagacugaacgcgcucggcaaaucugaguuccagaucuauaagaaaagcgggauucaggaggucgaccggacccuugccaaggaaggaaucaagcgcggcgagaccgaucaucacgcuguguccagagggucugccaaacugcggugguuuguugaaagaaacauggugacacccgagggaaaggucguggaccugggcugcggccgcgggggauggagcuacuauuguggcgggcucaaaaauguucgggaagugaagggacugaccaaaggcgggccgggacaugaggagccuauucccauguccacauacggcuggaaccuugucagacugcaaagcggcguggauguguucuucacgcccccugaaaagugcgacacccuccugugugauaucggggaguccucucccaauccuacaauugaagcuggacgcacccugcggguucucaaccuugucgagaauuggcugaacaauaacacacaguuuugcaucaaggugcugaauccguauaugcccagcgugaucgagaagauggaggcccuccagagacaguacggcggggcgcugguccgcaacccucuuuccagaaauucuacccacgagauguacuggguuagcaacgccacgggaaauauuguguccucugugaacaugaucagcagaaugcugauuaaucgcuucaccaugaagcacaaaaaggcuacauaugaacccgacgucgaucucggcuccgggacccggaacaucggaauugagagcgaaaucccuaaccuggacauuaucggcaaaagaaucgagaagauuaagcaagaacaugagaucucuuggcacuacgaccaggaucaucccuauaaaacaugggccuaccacggcuccuaugagaccaagcagacagggagcgcuucuuccauggugaauggaguugugcgccugcucaccaaaccgugggacgucgugccuaugguuacgcagauggccaugacagauaccacccccuuuggccaacagcggguguucaaggaaaaagucgacacaagaacgcaggagccuaaggaagggaccaagaaacuuaugaagauuacagcugaguggcuguggaaagagcugggaaagaaaaagacaccccgcauguguacaagagaagaguuuacccggaaagugcgcagcaacgccgcgcucggcgccaucuucacagaugaaaauaaguggaagucugcuagagaggccguggaagacgggcgguuuugggagcuggucgauagagagcggaaccuucaccuggaaggaaaaugcgagaccuguguuuacaauaugaugggcaagcgcgagaagaagcucggcgaguucgggaaagcuaagggauccagagccauuugguauauguggcugggcgcccgguuucuggaguucgaggcgcucggguuucugaacgaggaccauugguucagccgcggaaauucccuuagcggcguggaaggggagggccugcacagacucggauacauccugcgggaugugggcaagaaagaagggggagcuauguacgccgacgauacggccggcugggacacccgcaucacacuugaggaccugaagaacgaagagauggucaccaaucauaugaaaggggagcacaagaaacucgcugaagccauuuuuaagcugacauaucagaacaaggugguuagagugcaacggccuacaccccgcggaacggucauggauaucauuucuagacgggaccagcgcggcagcggacaggugggcacauacggacugaauaccuucacaaacauggaggcucaacucaucagacagauggaaggcgaggggauuuucaaauccauccagcaucugaccgccacggaggaaaucgcgguucagaauuggcuugcccgggugggacgcgagagacugucucggauggcuauuagcggcgaugacugcgucgugaagccgaucgaugacagauuugccuccgcucucaccgcccugaacgauauggggaaaguucgcaaggacauucaacagugggaaccuucucggggauggaaugauuggacacaggugcccuucugcagccaccacuuucaugagcuugucaugaaagacggcagagugcuggucgugcccugucgcaaccaggaugaacucaucgggcgggcgagaauuucccaaggcgccggauggucucugaaggagaccgcuugccugggcaagagcuaugcccagauguggacacucauguacuuccaccgccgggaccugagacuugcugccaacgcuaucuguuccgccguuccuagccauugggugccgaccucucgcacaaccugguccauucacgcgaaacacgaguggaugacgacagaagauaugcuggccgucuggaaucggguguggauccaggagaaccccuggauggaagacaagaccccuguggagagcugggaagagguucccuaucucgggaaaagagaggaccaguggugcggaucucugaucggccuuaccucccgcgcuacaugggccaagaauauucaagccgcuaucaaccaggugcggagccugauugggaaugaagaguacaccgauuauaugccuuccaugaaaagauuucggagagaagaggaagaggccggaguccucugguga

SEQ ID NO: 19805 - RNA, 9876 nt, Artificial Sequence
  derived and/or modified CDS sequence (opt5) from DENV-2__GQ868604__SS-prME
acagccggcgugaucgucaugcugauucccacagcuauggccuuccaccucacgaccagaaacggggagccucauaugaucguuggacggcaggaaaagggcaaaagccugcuuuuuaagacagaggacggggugaauaugugcacccugauggcgauugaucucggagaacugugugaggacacaaucaccuacaaaugcccgcuucugagacaaaacgaacccgaggauauugacuguuggugcaauuccacaucuaccugggugacguauggcaccuguacaaccacaggggagcacagacgggaaaagagaagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaaggcgggauugucacaugcgccauguuuacgugcaaaaagaauauggaagggaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacagccgagugccccaauaccaaccgcgcuuggaacucucucgagguggaagacuacggauuuggcgucuucacaaccaacaucuggcugaaacuucgggagaaacaggacguguuuugugauuccaagcugaugagcgccgcuaucaaagacaauagagccguucacgcggauaugggcuauuggauugaaucugcccucaacgacacguggaagauggagaaggcuuccuucaucgaggugaaaagcugccacuggccuaagucucauacacuguggagcaaugggguccuggaauccgagaugauuauccccaaaaacuucgccggaccggugagccagcacaacuaccgcccuggcuaucauacccaaaccgcugggcccuggcaccuuggaaagcucgaaauggauuuugaccugugugagggcacaaccguggucguuacggaagauugcgggaaucggggacccucucugagaacaaccacagccuccggcaaacucauuaccgaguggugcugucggagcugcacacugccuccgcuucgcuacagaggcgaggacggguguugguacggaauggaaauccggccccugaaggagaaggaagagaaccucgugaauagccuggugaccgccggcagagggcagauugauaacuucucucugggaguccuuggcauggcucucuuucuggaagagaugcugcgcacgcggaucgggaccaaacaugcgauccuccugguggccguuagcuucgugacacuuauuaccggaaauauguccuuuagagaccugggccgcgucauggugaugguuggcgcuacaaugaccgaugacaucgggaugggagugacguaucucgcccugcuggccgcuuucaaggucagaccuacauuugccgcgggccuucugcuccggaaacugaccucuaaggagcucaugauggcuacaauugggaucgcccugcuuagccaguccaccauucccgaaaacauccuggagcucaccgaugcccuggcucugggaaugauggugcuuaaaaucguucgcaauauggaaaaguaccaacuggccgugacaauuauggcgaucucuugcgucccuaacgcugugauucuccagaaugccuggaaggugagcuguacgauccuggccgcugucuccguuagcccccuccugcuuaccucuucccagcagaaagccgacuggauuccucuggcucucacaaucaagggccugaaccccaccgccaucuuccugacaacccuuagcagaacgucuaaaaagcgguccuggccgcugaaugaggcgauuauggccguggggauggugagcauccucgcuucuucccugcucaaaaacgacauuccuaugacaggaccccuggucgccggcggccuucugaccgugugcuauguucugaccgggcgcagcgcugaucucgaacuggagagagccgccgacgugaagugggaggaucaagcugaaaucuccggaagcucuccuauucuuagcaucacaauuuccgaggacggcucuaugagcaucaaaaaugaagaggaggaacagacccugacaauccucauucggacggggcugcucgucaucuccggaguguuucccguuucuauuccgaucaccgcggccgcuugguaccugugggaggugaagaagcagcgcgccggcguccuuugggaugugccuucucccccucccgucgaaaaagccgagcuggaagacggggcuuauagaauuaagcagcggggaauccugggcuacucccaaaucggcgccgggguguauaaagagggaacauuccacaccauguggcacguuacacgcggcgcggugcucaugcauagagggaagcggauugagcccuccugggcugaugucaaaaaggaccugaucagcuacggaggcggguggaaacuugaaggagaguggaaagaaggcgaggaagugcagguucuggcccucgagccuggcaagaacccgagagccgugcagaccaaacccgggauuuuuaagacgaauaccggaacaaucggcgcugucucccuggauuucagcccugggaccucuggaucccccauuguggaccgcaaaggcaaggugguugggcucuacggaaacggcgucgugacacggagcggcgccuaugugucugcgaucgcucagaccgagaaguccaucgaagauaacccugagauugaagacgauaucuuucgcaagaagcgccugacaauuauggaccuucaccccggggccggaaaaacgaagcgguaccugccugccaucgucagagaggcuauuaaacgcggccugcggacccucauccuggccccgacaagagugguugcugccgaaauggaggaggcgcuucgcgggcugcccauucgguaucaaaccccugccaucaagaccgaacauacaggaagagagaucguggaccucaugugucacgcuacguucaccaugcggcugcucagccccguccgcgugccuaauuacaaccugauuaucauggaugaagcccauuucacagaccccgcuuccauugccgccagaggcuauaucucuacccggguugagaugggggaggcugcgggcauuuuuaugacagccaccccgccuggaagccgcgaucccuucccccaguccaaugcuccuaucauggacgaagagagagaaauccccgagcggagcuggaacucuggccacgaaugggugacggauuuuaaggggaaaacagucugguucgugccuuccauuaaggccggaaaugacaucgccgcuugccuucgcaagaauggcaagaaaguuauucagcugagccgcaagaccuuugauucugaguacgugaagacccgggccaaugacugggauuucgucgugacaaccgacaucagcgagaugggggcgaacuuuaaagcugaaagagugauugauccgcgccgguguaugaagcccgucauccugacagacggagaggaaagaguuauccucgccggcccuaugcccgugacccacuccucugccgcucaacgccgggggagaauuggccgcaauccuaaaaacgagaaugaccaguauaucuacaugggagaaccccuggagaacgaugaggacugcgcccauuggaaggaagcgaaaaugcuucuggauaauauuaacacgccggagggcaucauuccuagcauguucgaacccgagagagaaaagguggacgccaucgauggggaguaccggcuccgcggagaggcuagaaaaacauuugucgaccugaugcggcgcggcgaucugccuguguggcucgccuauaagguugcugccgaagggauuaauuacgcugacagaaagugguguuucgauggaaucaaaaacaaccagauccuugaggaaaauauggagguggagauuuggaccaaggaaggcgagcggaaaaagcugaaacccagauggcuggacgcccgcaucuauuccgauccucucgcgcugaaggaauuuaaggaguucgccgcugggcggaaaucucuuacacugaaccucauuaccgaaaugggcagacugcccacguucaugacccagaaggcccgcaaugcucuggacaaccucgccguccuucacacagccgaggcuggaggccgggcguacaaucaugcccugagcgagcugccggaaacccucgagacacugcuucugcucacccugcuggcuacagugaccgggggaaucuuucucuuccuuauguccggcaaagggauuggaaagaugacgcugggcaugugcugcaucaucacagccagcauucugcucugguaugcccaaauccagccucacuggauugcugccucuaucauucuggaauuuuuccuuaucguucugcucauccccgagcccgaaaaacagagaaccccucaggauaaccaacugaccuacguggucauugcgauccugacaguggucgccgcuaccauggccaaugagaugggcuuucucgagaagacaaagaaagaccuugggcugggauccauuacgacccaggaaagcgaguccaacauccuggacauugaucuccggccggcuucugccuggacacuguaugcgguggccaccacauucguuacccccaugcuucgccacagcaucgaaaauuccucugugaacgugagccugacggcuauugccaaucaggcuaccguccucaugggccuggggaagggauggccucuguccaaaauggacaucggcguuccccuccuugccaucggguguuacagccaggugaacccuauuacacugaccgcugcccugcuccugcuuguggcgcauuacgccaucauuggacccggccugcaagcuaaggccacaagagaggcucagaaacgggccgccgcgggcaucaugaagaauccuaccgucgaugggauuacggugaucgaccucgaaccgauccccuaugauccuaaguuugagaaacagcugggacagguuaugcugcucauucuuugcgugacacaaguccugaugaugcgcaccacaugggcucugugugaggcccucacccuggcuaccggccccaucucuacacuuugggaagggaacccuggaagauucuggaauacgaccauugccguguccauggccaacaucuuucggggcagcuaccuggcuggggccggacuccuguucucuauuaugaagaauacaaccuccacacgcagaggcaccggcaacaucggggagacgcugggagaaaaauggaaaagccggcucaacgcgcuuggcaaaucugaguuucagaucuauaagaaaagcgggauucaggaggucgaccgcacacuggccaaggaaggaaucaagagaggcgagaccgaucaccaugcugugucccgggggucugccaaacugagaugguucguugaacgcaauauggugacccccgagggaaaggucguggaccucggcugcggcagagggggauggagcuacuauuguggcgggcugaaaaacguucgggaagugaagggacuuacaaaaggcgggccgggacacgaggagccuauucccauguccaccuacggcuggaaucugguccgccuccaaagcggcguggauguguuuuucacacccccugaaaagugcgacacgcugcugugugauaucggggaguccucucccaacccuaccauugaagcuggacggacacucagaguucuuaaucuggucgagaacuggcugaauaacaauacccaguucugcaucaaggugcucaacccguauaugcccagcgugaucgagaagauggaggcccugcagcgccaguacggcggggcgcuuguccggaauccucuguccagaaacucuacacaugagauguacuggguuagcaaugccaccggaaacauuguguccucugugaauaugaucagccgcaugcucauuaaccgguuuacgaugaagcacaaaaaggcuaccuaugaacccgacgucgaucugggcuccgggacaagaaacaucggaauugagagcgaaaucccuaaucuggacauuaucggcaaacgcaucgagaagauuaagcaagaacacgagaucucuuggcauuacgaccaggaucaccccuauaaaaccugggccuaccauggcuccuaugagacaaagcagaccgggagcgcuucuuccauggugaacggaguugugcggcuccuuacaaaaccgugggacgucgugccuaugguuacccagauggccaugacggauacaacccccuucggccaacagagaguguuuaaggaaaaagucgacacccgcacacaggagccuaaggaagggacgaagaaacugaugaagauuaccgcugaguggcuguggaaagagcucggaaagaaaaagacacccagaauguguacccgggaagaguucaccaagaaggugcgcagcaaugccgcgcugggcgccaucuuuaccgaugaaaacaaguggaaaucugcuagagaggccguggaagacgggcgguucugggagcuugucgauagagagcggaaucugcaccucgaaggaaagugcgagacauguguuuacaacaugaugggcaaacgcgaaaagaaacugggcgaguuugggaaggcuaagggauccagagccauuugguauauguggcugggcgcccgguuccucgaauuugaggcgcugggguuccuuaaugaggaccacugguuuagccgcggaaacucccugagcggcguggaaggggagggccuccauagacugggauacauccuucgggaugugggcaaaaaggaagggggagcuauguacgccgacgauaccgccggcugggacacgcgcaucacccuggaggaccucaaaaaugaagagauggucacaaaccacaugaagggggagcauaaaaagcuggcugaagccauuuucaagcugaccuaucagaauaaagugguuagagugcaacggccuacaccccgcggaaccgucauggauaucauuucuagacgggaccagcgcggcagcggacaggugggcacguacggacucaacacauuuaccaauauggaggcucaacugaucagacagauggaaggcgaggggauuuucaaguccauccagcaccuuacagccaccgaggaaaucgcgguucagaacuggcuggcccgggugggacgcgagagacucucucggauggcuauuagcggcgaugacugcgucgugaaaccgaucgaugacagauucgccuccgcucugacggcccuuaaugauauggggaagguucgcaaagacauucaacagugggaaccuucucggggauggaacgauuggacccaggugcccuuuugcagccaucacuuccacgagcuggucaugaaggacggcagagugcucgucgugcccugucgcaaccaggaugaacugaucgggcgggcgagaauuucccaaggcgccggauggucucugaaggagacagcuugccucggcaaaagcuaugcccagauguggacccugauguacuuucaucgccgggaccuuagacuggcugccaaugcuaucuguuccgccguuccuagccacugggugccgacaucucgcaccacaugguccauucaugcgaagcacgaguggaugaccacggaagauaugcucgccgucuggaaccggguguggauccaggagaaucccuggauggaagacaaaacaccuguggagagcugggaagagguucccuaucuggggaagagagaggaccaguggugcggaucucuuaucggccugaccucccgcgcuaccugggccaaaaacauucaaacagccaucaaucaggugcggagccucauugggaacgaagaguacaccgauuauaugccuuccaugaagagauuccggagagaagaggaagaggcuggaguccugugguga

SEQ ID NO: 19806 - RNA, 9876 nt, Artificial Sequence
  derived and/or modified CDS sequence (opt5) from DENV-2__EU482752__SS-prME
accgccggcgugaucgucaugcugauucccaccgcuauggccuuccaccucacgaccagaaauggggaaccucauaugaucguuggacggcaggaaaagggcaagagccugcuuuuuaagacggaggacggggugaauaugugcacccugauggcgauugaucucggagaacugugugaggacacaaucaccuacaagugcccccuucugcgccaaaacgaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaacauccuggagcucaccgaugcccuggcucugggaaugaugguccuuaagaucgugcgcaauauggaaaaauaccaacuggccguuacaauuauggcgaucucuugcgugccuaacgcugucauucuccagaaugccuggaaggugagcuguacgauccuggccgcuguguccgucagcccccuccugcuuaccucuucccagcagaaggccgacuggauuccucuggcucucacaaucaaaggccugaaccccaccgccaucuuccugacaacccuuagcagaacgucuaagaaacgguccuggccgcugaaugaggcgauuauggccguugggauggugagcauccucgcuucuucccugcucaagaacgacauuccuaugacaggaccccugguggccggcggccuucugaccgucugcuaugugcugaccgggcgcagcgcugaucucgaacuggagagagccgccgacguuaaaugggaggaucaagcugaaaucuccggaagcucuccuauucuuagcaucacaauuuccgaggacggcucuaugagcaucaagaaugaagaggaggaacagacccugacaauccucauucggacggggcugcucgugaucuccggagucuuucccgugucuauuccgaucaccgcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaacauuccacaccauguggcaugugacacgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaacccgagagccguucagaccaagcccgggauuuuuaaaacgaauaccggaacaaucggcgcugugucccuggauuucagcccugggaccucuggaucccccauugucgaccgcaagggcaaagugguggggcucuacggaaacggcguugucacacggagcggcgccuaugugucugcgaucgcucagaccgagaaguccaucgaagauaacccugagauugaagacgauaucuuuagaaagaaacgccugacaauuauggaccuucaucccggggccggaaagacgaaacgguaccugccugccaucgugagagaggcuauuaagcgcggccugcggacccucauccuggccccgacaagagucguggcugccgaaauggaggaggcgcuucgcgggcugcccauucgguaucaaaccaccgccaucaaaacagaacacacgggaagagagaucguugaccucaugugucaugcuaccuucacaaugcggcugcucagcccugugcgcguccccaauuacaaccugauuaucauggaugaagcccacuucaccgacccugcuuccauugccgccagaggcuauaucucuacacggguggagaugggggaggcugcgggcauuuuuaugaccgccacgcccccgggaagccgcgauccuuucccccaguccaaugcucccaucauggacgaagagagagaaaucccugagcggagcuggaacucuggccacgaauggguuacagauuuuaaggggaagaccgugugguucguccccuccauuaaagccggaaaugacaucgccgcuugccuuagaaagaacggcaaaaaggugauucagcugagccgcaaaaccuuugauucugaguacguuaagacacgggccaaugacugggauuucguggucaccacagacaucagcgagaugggggcgaacuuuaaggcugaaagagugauugauccucgccgguguaugaaaccggugauccugaccgacggagaggaaagagucauccucgccggccccaugccuguuacgcauuccucugccgcucaacgccgggggagaauuggccgcaaucccaagaacgagaaugaccaguauaucuacaugggagaaccucuggagaacgaugaggacugcgcccacuggaaagaagcgaagaugcuucuggauaauauuaacacacccgagggcaucauuccgagcauguucgaaccugagagagaaaaaguggacgccaucgauggggaguaccggcuccgcggagaggcuagaaagaccuuuguggaccugaugcggcgcggcgaucugcccgucuggcucgccuauaaaguggcugccgaagggauuaauuacgcugacagaaagugguguuucgauggaaucaagaacaaccagauccuugaggaaaauauggagguugagauuuggacaaaagaaggcgagcggaagaaacugaagccuagauggcuggacgcccgcaucuauuccgauccccucgcgcugaaagaauuuaaggaguucgccgcugggcggaagucucuuacccugaaccucauuacggaaaugggcagacugccuaccuucaugacacagaaagcccgcaaugcucuggacaaccucgccgugcuucauaccgccgaggcuggaggccgggcguacaaucacgcccugagcgagcugcccgaaacacucgagacccugcuucugcucacacugcuggcuaccgucacagggggaaucuuucucuuccuuauguccggcaaggggauuggaaaaaugacacugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaccaacugacauacguugugauugcgauccugaccgucguggccgcuacaauggccaaugagaugggcuuucucgagaaaacgaagaaggaccuugggcugggauccauuaccacacaggaaagcgaguccaacauccuggacauugaucuccggccugcuucugccuggacccuguaugcggucgccacaaccuucgugacgccgaugcuucgccauagcaucgaaaauuccucuguuaacgugagccugaccgcuauugccaaucaggcuacagugcucaugggccuggggaaaggauggccccuguccaagauggacaucggcgucccucuccuugccaucggguguuacagccagguuaaccccauuacccugacagcugcccugcuccugcuuguggcgcacuacgccaucauuggaccuggccugcaagcuaaagccaccagagaggcucagaagcgggccgccgcgggcaucaugaaaaaucccacgguggaugggauuacagucaucgaccucgaaccuaucccguaugaucccaaguuugagaagcagcugggacaggugaugcugcucauucuuugcguuacccaagugcugaugaugcgcacaaccugggcucugugugaggcccucacccuggcuacaggcccuaucucuacgcuuugggaagggaaccccggaagauucuggaauaccacaauugccgucuccauggccaacaucuuucggggcagcuaccuggcuggggccggacuccuguucucuauuaugaaaaauaccacaaacacccgcagaggcacgggcaacaucggggagacacugggagaaaaguggaaaucccggcucaaugcgcuuggcaagagcgaguuucagaucuauaaaaagucugggauucaggagguggaccgcacccuggccaaagaaggaaucaagagaggcgagaccgaucaucacgcugucagccggggguccgccaagcugagaugguucguggaacgcaacaugguuacaccugagggaaaaguggucgaccucggcugcggcagagggggauggucuuacuauuguggcgggcugaagaaugugcgggaaguuaaaggacuuaccaagggcgggcccggacaugaggagccgauuccuaugagcacauacggcuggaaccuggugcgccuccaauccggcgucgauguguuuuucacgccgcccgaaaaaugcgacacccugcugugugauaucggggagagcuccccuaaucccacaauugaagcuggacggacccucagagugcuuaaccugguugagaauuggcugaacaauaacacacaguucugcaucaagguccucaauccuuauaugccgucugugaucgaaaagauggaggcccugcagcgcaaauacggcggggcgcuugugcggaacccccugagcagaaauuccacccacgagauguacugggucucuaacgccacgggaaauauuguuagcuccgugaacaugaucucucgcaugcucauuaaccgguuuaccaugaagcacaaaaaggcuacauaugaaccugacguggaucugggcagcgggaccagaaauaucggaauugaguccgaaauccccaaccuggacauuaucggcaaacgcaucgagaagauuaagcaggaacaugagacaagcuggcacuacgaccaagaucauccuuauaaaaccugggccuaccacggcucuuaugagacaaagcagaccggguccgcuagcucuauggucaauggagugguucggcuccuuacgaaacccugggacguggucccgauggugacacagauggccaugaccgauaccacaccuuucggccagcaaagaguuuuuaaggaaaaaguggacacgcgcacccaggagcccaaggaagggacaaagaaacugaugaagaucaccgcugaguggcuguggaaagagcucggaaagaaaaagacaccuagaauguguacccgggaagaguucacacgcaaagucagauccaacgccgcgcugggcgccauuuuuaccgaugaaaauaaguggaaaagcgcucgggaggccguggaagacgggagauucugggagcuuguggaucgggagcgcaaccugcaccucgaaggaaaaugcgagacgugugucuacaauaugaugggcaagagagagaagaagcugggcgaguuugggaaagcuaagggaucucgggccaucugguauauguggcugggcgcccgcuuccucgaauuugaggcgcugggguuccuuaacgaggaccauugguuuuccagaggaaauagccuguccggcguugaaggggagggccuccaccggcugggauacauucuucgcgaugugggcaagaaagaagggggagcuauguacgccgacgauaccgccggcugggacacaagaaucacccuggaggaccucaagaacgaagagauggugacaaaucauaugaaaggggagcacaagaaacuggcugaagccaucuucaagcugaccuaucagaacaaggucgugcggguucagcgccccacgccuagaggaacagugauggauauuaucagccggcgcgaccaaagaggcucugggcaggucggcaccuacggacucaauacauuuaccaacauggaggcucagcugauucggcaaauggaaggcgaggggaucuucaaaagcauucagcaucuuacggccaccgaggaaaucgcggugcagaauuggcuggcccgcguuggaagagagcggcucuccagaauggcuaucucuggcgaugacugcguggucaagcccauugaugaccgcuucgccagcgcucugacagcccuuaacgauauggggaaagugcggaaggacauccagcaaugggaaccguccagaggauggaacgauuggacccagguuccuuuuugcucucaccacuuccaugagcuggugaugaaagacggccgcguccucgugguccccugucggaaucaggaugaacugauugggagagcgcgcaucagccagggcgccggauggucccugaaggagacagcuugccucggcaagucuuaugcccaaauguggacccugauguacuuucaccggagagaccuucgccuggcugccaacgcuauuuguagcgccgugcccucccauuggguuccuacaagccggaccacguggucuauccacgcgaaacacgaguggaugacaaccgaagauaugcucgccguguggaauagagucuggauucaggagaacccguggauggaagacaagacccccguggaguccugggaagaggugccuuaucuggggaaacgcgaggaccaguggugcggaagccuuaucggccugacaucucgggcuaccugggccaagaauauccagacagccauuaaccaaguuagaucccucaucgggaaugaagaguacacggauuauaugcccagcaugaaacgguucagacgcgaagaggaagaggcuggagugcugugguga

SEQ ID NO: 19807 - RNA, 9876 nt, Artificial Sequence
  derived and/or modified CDS sequence (opt5) from DENV-2__EU482753__SS-prME
accgccggcgugaucgucaugcugauucccacagcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaagcacgcgauccuccuggucgccgugagcuucguuacacuuauuaccggaaauauguccuuuagagaccugggccgcgugauggucauggugggcgcuacaaugaccgaugacaucgggaugggaguuacguaucucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaccaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuaugugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaccugugggagguuaaaaagcagcgcgccggcgugcuuugggaugucccuucucccccucccguggaaaaggccgagcuggaagacggggcuuauagaauuaaacagcggggaauccugggcuacucccaaaucggcgccggggucuauaaggagggaaccuuccacacaauguggcaugugacccgcggcgcgguucucaugcacagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuacggaaauggcguugucacccggagcggcgccuaugugucugcgaucgcucagacagagaaguccaucgaagauaacccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagagucguggcugccgaaauggaggaggcgcuucgcgggcugcccauucgguaucaaaccacagccaucaaaacggaacacaccggaagagagaucguugaccucaugugucaugcuacauucaccaugcggcugcucagcccugugcgcguccccaacuacaaucugauuaucauggaugaagcccacuucacagacccugcuuccauugccgccagaggcuauaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguacguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacauuccucugccgcucaacgccgggggagaauuggccgcaaccccaagaaugagaacgaccaguauaucuacaugggagaaccucuggagaaugaugaggacugcgcccacuggaaagaagcgaagaugcuucuggauaacauuaauacccccgagggcaucauuccgagcauguucgaaccugagagagaaaaaguggacgccaucgauggggaguaccggcuccgcggagaggcuagaaagacauuuguggaccugaugcggcgcggcgaucugcccgucuggcucgccuauaaaguggcugccgaagggauuaacuacgcugacagaaagugguguuucgauggaaucaagaauaaccagauccuugaggaaaacauggagguugagauuuggaccaaagaaggcgagcggaagaaacugaagccuagauggcuggacgcccgcaucuauuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucauacagccgaggcuggaggccgggcguacaaccacgcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguaugcccaaauccagccgcacuggauugcugccucuaucauucuggaauuuuuccuuaucgugcugcucaucccugagcccgaaaagcagagaacaccccaggauaaucaacugaccuacguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguaugcggucgccaccacguucgugaccccgaugcuucgccauagcaucgaaaacuccucuguuaaugugagccugacagcuauugccaaccaggcuaccgugcucaugggccuggggaaaggauggccccuguccaagauggacaucggcgucccucuccuugccaucggguguuacagccagguuaaucccauuacacugaccgcugcccugcuccugcuuguggcgcacuacgccaucauuggaccuggccugcaagcuaaagccacgagagaggcucagaagcgggccgccgcgggcaucaugaaaaaccccacaguggaugggauuaccgucaucgaccucgaaccuaucccguaugaucccaaguuugagaagcagcugggacaggugaugcugcucauucuuugcguuacacaagugcugaugaugcgcaccaccugggcucugugugaggcccucacacuggcuacgggcccuaucucuacccuuugggaagggaaucccggaagauucuggaacacaaccauugccgucuccauggccaauaucuuucggggcagcuaccuggcuggggccggacuccuguucucuauuaugaaaaacacaaccaauacgcgcagaggcacaggcaacaucggggagacccugggagaaaaguggaaaucccggcucaacgcgcuuggcaagagcgaguuucagaucuauaaaaagucugggauucaggagguggaccgcacccuggccaaagaaggaaucaagagaggcgagacagaucaucacgcugucagccggggguccgccaagcugagaugguucguggaacgcaauaugguuaccccugagggaaaaguggucgaccucggcugcggcagagggggauggucuuacuauuguggcgggcugaagaacgugcgggaaguuaaaggacuuacaaagggcgggcccggacaugaggagccgauuccuaugagcacguacggcuggaaucuggugcgccuccaauccggcgucgauguguuuuucacaccgcccgaaaaaugcgacacacugcugugugauaucggggagagcuccccuaaccccaccauugaagcuggacggacacucagagugcuuaaucugguugagaacuggcugaauaacaauacccaguucugcaucaagguccucaacccuuauaugccgucugugaucgaaaagauggaggcccugcagcgcaaauacggcggggcgcuugugcggaauccccugagcagaaacuccacgcacgagauguacugggucucuaaugccaccggaaacauuguuagcuccgugaauaugaucucucgcaugcucauuaaccgguuuacaaugaagcacaaaaaggcuaccuaugaaccugacguggaucugggcagcgggacaagaaacaucggaauugaguccgaaauccccaaucuggacauuaucggcaaacgcaucgagaagauuaagcaggaacaugagaccagcuggcacuacgaccaagaucauccuuauaaaacaugggccuaccacggcucuuaugagaccaagcagacgggguccgcuagcucuauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugaguggcuguggaaagagcucggaaagaaaaagaccccuagaauguguacacgggaagaguucacccgcaaagucagauccaaugccgcgcugggcgccauuuuuacggaugaaaacaaguggaaaagcgcucgggaggccguggaagacgggagauucugggagcuuguggaucgggagcgcaaucugcaccucgaaggaaaaugcgagaccugugucuacaacaugaugggcaagagagagaagaagcugggcgaguuugggaaagcuaagggaucucgggccaucugguauauguggcugggcgcccgcuuccucgaauuugaggcgcugggguuccuuaaugaggaccauugguuuuccagaggaaacagccuguccggcguugaaggggagggccuccaccggcugggauacauucuucgcgaugugggcaagaaagaagggggagcuauguacgccgacgauacagccggcugggacaccagaaucacacuggaggaccucaagaaugaagagauggugaccaaccauaugaaaggggagcacaagaaacuggcugaagccaucuucaagcugacguaucagaauaaggucgugcggguucagcgccccacaccuagaggaaccgugauggauauuaucagccggcgcgaccaaagaggcucugggcaggucggcacauacggacucaacaccuuuacgaauauggaggcucagcugauucggcaaauggaaggcgaggggaucuucaaaagcauucagcaucuuaccgccacagaggaaaucgcggugcagaacuggcuggcccgcguuggaagagagcggcucuccagaauggcuaucucuggcgaugacugcguggucaagcccauugaugaccgcuucgccagcgcucugaccgcccuuaaugauauggggaaagugcggaaggacauccagcaaugggaaccguccagaggauggaacgauuggacacagguuccuuuuugcucucaccacuuccaugagcuggugaugaaagacggccgcguccucgugguccccugucggaaccaggaugaacugauugggagagcgcgcaucagccagggcgccggauggucccugaaggagaccgcuugccucggcaagucuuaugcccaaauguggacacugauguacuuucaccggagagaccuucgccuggcugccaaugcuauuuguagcgccgugcccucccauuggguuccuaccagccggacgacauggucuauccacgcgaaacacgaguggaugaccaccgaagauaugcucgccguguggaacagagucuggauucaggagaauccguggauggaagacaagacacccguggaguccugggaagaggugccuuaucuggggaaacgcgaggaccaguggugcggaagcaugaucggccuuaccucucgggcuacaugggccaagaacauccagacggccauuaaucaaguuagaucccugaucgggaacgaagaguacaccgauuauaugcccagcaugaaacgguucagacgcgaagaggaagaggcuggagugcucugguga

SEQ ID NO: 19808 - RNA, 9876 nt, Artificial Sequence
  derived and/or modified CDS sequence (opt5) from DENV-2__EU482680__SS-prME
accgccggagugaucgugaugcugauucccaccgcuauggccuuccaccucacgaccagaaauggggagccucauaugaucguuggacggcaggaaaagggcaaaagccugcuuuuuaagaccgaggacggggugaauaugugcacccugauggcgauugaucucggagaacugugugaggacacaaucaccuacaaaugcccgcuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaaggcgggauugucacaugcgccauguuuacgugcaaaaagaauauggaagggaaaaucguucagccugagaaccucgaauacaccauugugaucacaccccacagcggggaggagcaugcggugggaaaugacaccggcaagcacggcaaagaaaucaagauuacaccucagucuuccaucaccgaggccgaacugacgggguauggaaccgucacaauggaguguagcccccggaccggccuugauuucaacgaaauggugcugcuccaaauggaggacaaggcuuggcugguucaccgccagugguuucuugaucugccgcucccuuggcugcccggggccgacacacagggaucuaauuggauucagaaggagacccuggugacguucaagaacccucaugcuaaaaagcaagacgucgugguucucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugugaaagaaaucgcggagacacagcacggcacgaucgucauuagagugcaguaugagggggacggaucccccugcaagauccccuucgaaauuaccgaucucgagaaacgccauguccugggccggcugaucacagugaacccuauuguuaccgaaaaggacagcccggugaacaucgaggccgaacccccuuuuggggauucuuacauuaucaucggcgucgagcccggacagcucaaacugaauugguucaagaagggcuccagcauugggcaaauguuugagacaaccaugagaggagcuaaacgcauggccauccuuggcgacacggccugggauuucgggucucugggaggcguguuuacaagcauugggaaggcucuccaccagguuuucggcgccaucuacggagcggcuuuuuccggcgugucuuggaccaugaaaauucugaucggggucaucauuaccuggaucggaaugaacagccgguccacaagccugucugugucccuugugcucguuggcgucgugacccuguaucugggggccauggugcaggccgacagcggaugugucgugucuuggaagaauaaagaacucaagugcggcuccgggauuuucaucacagauaacguucacacguggaccgagcaguacaaguuucaaccugaaagccccuccaaacuggcuucugccauucagaaggcucaugaggaaggcaucuguggaaucagaagcgugacacgccuugagaaucugauguggaaacagauuaccccggagcucaaccacauccuguccgaaaaugaggucaagcugacaauuaugaccggcgacauccgggggauuaugcaggccggaaaaagaucucuucgcccucaacccacggaacucaaguauagcuggaaaaccuggggcaaggcgaagaugcuguccacagagagccauaaccagaccuuccugaucgaugggccugaaacagccgagugccccaauaccaaccgggcuuggaacucucucgagguggaagacuacggauuuggcguuuucacaaccaacaucuggcugaaacuuagagagaagcaggacguguuuugugauuccaaacugaugagcgccgcuauuaaggacaaucgcgccguccacgcggauaugggcuauuggaucgaaucugcccucaacgacacguggaaaauggagaaggcuuccuucauugaggucaagagcugccacuggccuaaaucucauacacuguggagcaaugggguucuggaauccgagaugaucauucccaagaacuucgccggaccggugagccagcacaacuaccggccuggcuaucauacccaaaccgcugggcccuggcaccuuggaaaacucgaaauggauuuugaccugugugagggcacaaccgucguggugacggaagauugcgggaauagaggacccucucugcggacaaccacagccuccggcaagcucaucaccgaguggugcugucgcagcugcacacugccuccgcuuagauaccggggcgaggacggguguugguacggaauggaaauuagaccccugaaagagaaggaagagaaccucgucaauucccugguuaccgccggccaugggcagaucgauaacuucucucugggagugcuuggcauggcucucuuucuggaagagaugcugcgcacgcggaucgggaccaagcacgcgauucuccugguggccgucagcuucgugacacuuaucaccggaaauauguccuuuagagaccugggccgcguuauggugauggucggcgcuacaaugaccgaugacauugggacgggagugacauaucucgcccugcuggccgcuuucaaaguuagaccuaccuuugccgcgggccuucugcuccggaagcugacaucuaaagagcucaugauggcuaccaucgggauugcccugcuuagccaguccaccauccccgaaacaauccuggagcucacggaugcccuggcucugggaaugauggugcuuaagauuguccgcaacauggaaaaauaccaacuggccgugaccaucauggcgauuucuugcguuccuaaugcugugauccuccagaacgccuggaaggucagcuguacaauucuggccgcuguguccgugagcccccuccugcuuaccucuucccagcagaaggccgacuggaucccucuggcucucacaaucaaaggccugaaucccaccgccauuuuccugacgacacuuagcagaaccucuaagaaacgguccuggccgcugaacgaggcgaucauggccgucgggaugguuagcauucucgcuucuucccugcucaagaaugacaucccuaugaccggaccccugguggccggcggccuucugacagugugcuauguccugaccgggcgcagcgcugaucucgaacuggagagagccgccgacgugaaaugggaggaucaagcugaaauuuccggaagcucuccuauccuuagcauuacaaucuccgaggacggcucuaugagcaucaagaacgaagaggaggaacagacgcugaccauucucauccggacagggcugcucguuauuuccggaguguuucccgucucuaucccgauuaccgcggccgcuugguaccugugggaggugaaaaagcagcgcgccggcguucuuugggaugugccuucucccccucccgucgaaaaggccgagcuggaagacggggcuuauagaaucaaacagcggggaauccugggcuacucccaaauuggcgccgggguguauaaggagggaacauuccacaccauguggcaugucacgcgcggcgcggugcucaugcacagagggaaacggaucgagcccuccugggcugauguuaagaaagaccugauuagcuacggaggcggguggaaacuugaaggagaguggaaggaaggcgaggaagugcagguccuggcccucgagccuggcaaaaauccgagagccgugcagaccaagcccgggaucuuuaaaacaaacaccggaacaauuggcgcuguuucccuggauuucagcccugggaccucuggaucccccaucguggaccgcaagggcaaagucguggggcucuacggaaauggcgugguuacacggagcggcgccuaugucucugcgaucgcucagacggagaaguccauugaagauaacccugagaucgaagacgauauuuuuagaaagaaacgccugaccaucauggaccuucaucccggggccggaaagacaaaacgguaccugccugccauugugagagaggcuaucaagcgcggccugcggacccucauucuggccccgaccagaguggucgcugccgaaauggaggaggcgcuucgcgggcugcccauccgguaucaaacaacggccaucaaaaccgaacacacaggaagagagauuguggaccucaugugucaugcuaccuucacaaugcggcugcucagcccuguucgcgugcccaacuacaaucugaucauuauggaugaagcccacuucaccgacccugcuuccaucgccgccagaggcuauauuucuacgcgggucgagaugggggaggcugcgggcaucuuuaugacagccacaccucccggaagccgcgaucccuucccccaguccaacgcucccaucauggacgaagagagagaaauuccugagcggagcuggaacucuggccacgaaugggugaccgauuuuaaggggaagacaguuugguucgugcccuccaucaaagccggaaacgacauugccgcuugccuuagaaagaauggcaaaaaggucauccagcugagccgcaaaaccuuugauucugaguacgugaagacacgggccaacgacugggauuucguugugaccacggacauuagcgagaugggggcgaauuuuaaggcugaaagagucaucgauccucgccgguguaugaaaccggugauccugacagacggagaggaaagagugauucucgccggccccaugccugucacccauuccucugccgcucaacgccgggggagaaucggccgcaaccccaagaaugagaacgaccaguauauuuacaugggagaaccucuggagaaugaugaggacugcgcccacuggaaagaagcgaagaugcuucuggauaacaucaauacacccgagggcauuaucccgagcauguucgaaccugagagagaaaaaguugacgccauugauggggaguaccggcuccgcggagaggcuagaaagaccuuuguggaccugaugcggcgcggcgaucugcccguguggcucgccuauaaagucgcugccgaagggaucaacuacgcugacagaaagugguguuucgauggaaucaagaauaaccagauucuugaggaaaacauggagguggagaucuggacgaaagaaggcgagcggaagaaacugaagccuagauggcuggacgcccgcauuuauuccgauccccucgcgcugaaagaauuuaaggaguucgccgcugggcggaagucucuuacccugaaucucaucacagaaaugggcagacugccuaccuucaugacacagaaagcccgcaacgcucuggacaaucucgccguucuucauaccgccgaggcuggaggccgggcguacaaccacgcccugagcgagcugcccgaaacacucgagacccugcuucugcucacgcugcuggcuacagugaccgggggaauuuuucucuuccuuauguccggcaaggggaucggaaaaaugacccugggcaugugcugcaucauuacagccagcauccugcucugguaugcccaaauucagccgcacuggaucgcugccucuauuauccuggaauuuuuccuuaucguccugcucauuccugagcccgaaaagcagagaacaccccaggauaaucaacugacauacgugguuaucgcgauucugacgguggucgccgcuaccauggccaacgagaugggcuuucucgagaaaacaaagaaggaccuugggcugggauccaucaccacacaggaaagcgaguccaauauucuggacaucgaucuccggccugcuucugccuggacccuguaugcgguggccacgaccuucgucacaccgaugcuucgccauagcauugaaaacuccucugugaauguuagccugaccgcuaucgccaaccaggcuacagugcucaugggccuggggaaaggauggccccuguccaagauggacaucggcgugccucuccuugccauuggguguuacagccaggucaaucccaucacccugacggcugcccugcuccugcuuguugcgcacuacgccauuaucggaccuggccugcaagcuaaagccacaagagaggcucagaagcgggccgccgcgggcauuaugaaaaaccccaccguggaugggaucacagugaucgaccucgaaccuauuccguaugaucccaaguuugagaagcagcugggacaggucaugcugcucauccuuugcgugacccaaguucugaugaugcgcaccacaugggcucugugugaggcccucacgcuggcuaccggcccuauuucuacacuuugggaagggaaucccggaagauucuggaacaccacaaucgccguguccauggccaauauuuuucggggcagcuaccuggcuggggccggacuccuguucucuaucaugaaaaacaccacgaauacacgcagaggcaccggcaacaucggggagacccugggagaaaaguggaaaucccggcucaacgcgcuuggcaagagcgaguuucagauuuauaaaaagucugggauccaggaggucgaccgcacacuggccaaagaaggaauuaagagaggcgagaccgaucaucacgcugugagccggggguccgccaagcugagaugguucgucgaacgcaauauggugacaccugagggaaaaguuguggaccucggcugcggcagagggggauggucuuacuauuguggcgggcugaagaacguccgggaagugaaaggacuuacgaagggcgggcccggacaugaggagccgaucccuaugagcaccuacggcuggaaucugguucgccuccaauccggcguggaugucuuuuucacaccgcccgaaaaaugcgacacccugcugugugauauuggggagagcuccccuaaccccacaaucgaagcuggacggacccucagagugcuuaaucugguggagaacuggcugaauaacaauacgcaguucugcaucaagguucucaacccuuauaugccgucugucauugaaaagauggaggcccugcagcgcaaauacggcggggcgcuugugcggaauccccugagcagaaacuccacccacgagauguacugggugucuaaugccacaggaaacaucgucagcuccguuaauaugauuucucgcaugcucaucaaccgguuuaccaugaagcacaaaaaggcuacauaugaaccugacguggaucugggcagcgggaccagaaacauuggaaucgaguccgaaaaacccaaucuggacauuaucggcaagcgcaucgagaagauuaaacaggaacaugagacaagcuggcacuacgaccaagaucauccuuauaagaccugggccuaccacggcucuuaugagacgaaacagacaggguccgcuagcucuauggugaacggagucgugcggcuccuuaccaagcccugggacguugugccgauggucacccagauggccaugacagauacgaccccuuucggccagcaaagaguguuuaaagaaaagguugacacacgcacccaggagcccaaggaagggaccaagaagcugaugaaaaucaccgcugaguggcuguggaaggagcucggcaagaagaaaacaccuagaauguguacccgggaagaguucacgcgcaaggugagauccaaugccgcgcugggcgccauuuuuaccgaugaaaacaaguggaaaagcgcucgggaggccgucgaagacgggagauucugggagcuuguggaucgggagcgcaaucugcaccucgaaggaaagugcgagacauguguguacaacaugaugggcaaaagagaaaagaaacugggcgaguuugggaaggcuaagggaucucgggccaucugguauauguggcugggcgcccgcuuccucgaauuugaggcgcugggguuccuuaaugaggaccauugguuuuccagaggaaacagccuguccggcgucgaaggggagggccuccaccggcugggauacauucuucgcgauguuggcaaaaaggaagggggagcuauguacgccgacgauaccgccggcugggacacaagaaucacccuggaggaccucaaaaaugaagagauggugacgaaccauaugaagggggagcacaaaaagcuggcugaagccaucuucaagcugacauaucagaauaaagugguccgggugcagcgccccaccccuagaggaacaguuauggauauuaucagccggcgcgaccaaagaggcucuggacaggugggcaccuacggacucaacacguuuaccaauauggaggcucagcugauucggcaaauggaaggcgaggggaucuucaagagcauucagcaucuuacagccaccgaggaaaucgcgguccagaacuggcuggcccgcgugggaagagagcggcucuccagaauggcuaucucuggcgaugacugcguugugaaacccauugaugaccgcuucgccagcgcucugacagcccuuaaugauauggggaagguccggaaagacauccagcaaugggaaccguccagaggauggaacgauuggacccaggugccuuuuugcucucaccacuuccaugagcugguuaugaaggacggccgcgugcucgucgugcccugucggaaccaggaugaacugauugggagagcgcgcaucagccagggcgccggauggucccugaaggagacagcuugccucggcaaaucuuaugcccaaauguggacccugauguacuuucaccggagagaccuucgccuggcugccaaugcuauuuguagcgccguccccucccauugggugccuacgagccggacaaccuggucuauccacgcgaagcacgaguggaugaccacagaagauaugcucgccguuuggaacagaguguggauucaggagaauccguggauggaagacaaaacccccgucgaguccugggaagaggugccuuaucuggggaagcgcgaggaccaguggugcggaagccuuaucggccugacaucucgggcuacgugggccaaaaacauccagaccgccauuaaucaagugagaucccucaucgggaacgaagaguacacagauuauaugcccagcaugaagcgguucagacgcgaagaggaagaggcuggaguucugugguga

SEQ ID NO: 19809 - RNA, 9876 nt, Artificial Sequence
  derived and/or modified CDS sequence (opt5) from DENV-2__EU482754__SS-prME
accgccggcgugaucgugaugcugauucccacagcuauggccuuccaccucacgaccagaaauggggaaccucauaugaucguuggacggcaggaaaagggcaagagccugcuuuuuaagaccgaggacggggugaauaugugcacccugauggcgauggaucucggagaacugugugaggacacaauuaccuacaagugcccccuucugcgccaaaaugaacccgaggauaucgacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggauugagaccuggauccugcgccaucccggguucacaaucauggccgcuauucucgccuacaccaucggaaccacacacuuucagagagcucugauuuucauccuucugacggccgucgcgccuagcaugaccaugcggugcauuggcaucuccaaccgcgauuuuguggaagggguuucuggaggcagcuggguggacauuguccucgagcacggguccugugugacaaccauggccaagaauaagcccacacuggauuucgaacuuaucaaaaccgaggcuaagcagccugccacgcugagaaaauauugcaucgaagcuaagcucacaaacaccaccacagagagccgguguccgacccaaggagagcccucucugaaugaggaacaggacaaacgcuuuauuugcaagcauuccaugguggauagaggcuggggcaacggguguggacuguucggcaaaggcgggaucgucacaugcgccauguuuacgugcaaaaagaauauggaagggaaaguugugcagccugagaaccucgaauacaccauugugaucacaccccacagcggggaggagcaugcggucggaaaugacaccggcaagcacggcaaagaaauuaagaucacaccucagucuuccaucaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauucagaaggagacccuggucacguucaagaacccucaugcuaaaaagcaagacgugguugugcucggcucccaggaaggggccaugcacacagcccugaccggcgcuacagagauccagaugagcuccggaaaucuucuguuuaccggccaucucaaaugcagacugcggauggauaaacuucaacugaaagggaugucuuacagcauguguaccggaaaguucaagauugucaaagaaaucgcggagacacagcacggcacgauugugaucagaguccaguaugagggggacggaucccccugcaagauccccuucgaaauuaccgaucucgagaaacgccaugugcugggccggcugaucacaguuaacccuauugugaccgaaaaggacagcccggucaacaucgaggccgaacccccuuuuggggauucuuacauuaucauuggcguggagcccggacagcucaaacugaauugguucaagaagggcuccagcaucgggcaaauguuugagacaaccaugagaggagcuaaacgcauggccauccuuggcgacacggccugggauuucgggucucugggaggcguuuuuacaagcauugggaaggcucuccaccagguguucggcgccaucuacggagcggcuuuuuccggcgucucuuggaccaugaaaauucugaucggggugauuaucaccuggaucggaaugaacagccgguccacaagccugucugugucccuuguucucgucggcguggugacccuguaucugggggccaugguccaggccgacagcggaugugugguuucuuggaagaauaaagaacucaagugcggcuccgggauuuucaucacagauaacauucacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugaggucaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguggaagacuacggauuuggcguuuucacaaccaacaucuggcugaaacuuagagagaagcaggacguguuuugugauuccaaacugaugagcgccgcuaucaaggacaaucgcgccguccacgcggauaugggcuauuggauugaaucugcccucaacgacacguggaaaauggagaaggcuuccuucaucgaggucaagagcugccacuggccuaaaucucauacacuguggagcaaugggguucuggaauccgagaugauuauccccaagaacuucgccggaccggugagccagcacaacuaccggccuggcuaucauacccaaaccgcugggcccuggcaccuuggaaaacucgaaauggauuuugaccugugugagggcacaaccgucguggugacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucgucaauucccugguuaccgccggccaugggcagauugauaacuucucucugggagugcuuggcauggcucucuuucuggaagagaugcugcgcacgcggaucgggaccaagcacgcgauccuccugguggccgucagcuucgugacacuuauuaccggaaauauguccuuuagagaccugggccgcguuauggugauggucggcgcuacaaugaccgaugacaucgggaugggagugacguaucucgcccugcuggccgcuuucaaaguuagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugauggugcuuaagaucguccgcaacauggaaaaauaccaacuggccgugacgauuauggcgaucucuugcguuccuaaugcugugauucuccagaacgccuggaaggucagcuguaccauccuggccgcuguguccgugagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccgucgggaugguuagcauccucgcuucuucccugcucaagaaugacauuccuaugaccggaccccugguggccggcggccuucugaccgugugcuauguccugacagggcgcagcgcugaucucgaacuggagagagccgccgacgugaaaugggaggaucaagcugaaaucuccggaagcucuccuauucuuagcaucaccauuuccgaggacggcucuaugagcaucaagaacgaagaggaggaacagacacugacgauccucauucggaccgggcugcucguuaucuccggaguguuucccgucucuauuccgaucacagcggccgcuugguaccugugggaggugaaaaagcagcgcgccggcguucuuugggaugugccuucucccccucccgucgaaaaggccgagcuggaagacggggcuuauagaauuaaacagcggggaauccugggcuacucccaaaucggcgccgggguguauaaggagggaaccuuccacacaauguggcaugucacccgcggcgcggugcucaugcacagagggaaacggauugagcccuccugggcugauguuaagaaagaccugaucagcuacggaggcggguggaaacuugaaggagaguggaaggaaggcgaggaagugcagguccuggcccucgagccuggcaaaaauccgagagccgugcagacgaagcccgggauuuuuaaaaccaacacaggaaccaucggcgcuguuucccuggauuucagcccugggacaucuggaucccccauuguggaccgcaagggcaaagucguggggcucuacggaaauggcgugguuacccggagcggcgccuaugucucugcgaucgcucagacagagaaguccaucgaagauaacccugagauugaagacgauaucuuuagaaagaaacgccugacgauuauggaccuucaucccggggccggaaagaccaaacgguaccugccugccaucgugagagaggcuauuaagcgcggccugcggacacucauccuggccccgaccagaguggucgcugccgaaauggaggaggcgcuucgcgggcugcccauucgguaucaaaccacagccaucaaaacggaacacaccggaagagagaucguggaccucaugugucaugcuacauucaccaugcggcugcucagcccuguucgcgugcccaacuacaaucugauuaucauggaugaagcccacuucacagacccugcuuccauugccgccagaggcuauaucucuacccgggucgagaugggggaggcugcgggcauuuuuaugacggccacacccccgggaagccgcgauccuuucccccaguccaacgcucccaucauggacgaagagagagaaaucccugagcggagcuggaacucuggccacgaaugggugaccgauuuuaaggggaagaccguuugguucgugcccuccauuaaagccggaaacgacaucgccgcuugccuuagaaagaauggcaaaaaggucauucagcugagccgcaaaacauuugauucugaguacgugaagacccgggccaacgacugggauuucguugugacaaccgacaucagcgagaugggggcgaauuuuaaggcugaaagagucauugauccucgccgguguaugaaaccggugauccugacggacggagaggaaagagugauccucgccggccccaugccugucacacauuccucugccgcucaacgccgggggagaauuggccgcaaccccaagaaugagaacgaccaguauaucuacaugggagaaccucuggagaaugaugaggacugcgcccacuggaaagaagcgaagaugcuucuggauaacauuaauacccccgagggcaucauuccgagcauguucgaaccugagagagaaaaaguugacgccaucgauggggaguaccggcuccgcggagaggcuagaaagacauuuguggaccugaugcggcgcggcgaucugcccguguggcucgccuauaaagucgcugccgaagggauuaacuacgcugacagaaagugguguuucgauggaaucaagaauaaccagauccuugaggaaaacauggagguggagauuuggaccaaagaaggcgagcggaagaaacugaagccuagauggcuggacgcccgcaucuauuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccguucuucauacagccgaggcuggaggccgggcguacaaccacgcccugagcgagcugcccgaaacccucgagacacugcuucugcucacccugcuggcuacggugacagggggaaucuuucucuuccuuauguccggcaaggggauuggaaaaaugacccugggcaugugcugcaucaucaccgccagcauucugcucugguaugcccaaauccagccgcacuggauugcugccucuaucauucuggaauuuuuccuuaucguccugcucaucccugagcccgaaaagcagagaacaccccaggauaaucaacugaccuacgugguuauugcgauccugacaguggucgccgcuacgauggccaacgagaugggcuuucucgagaaaaccaagaaggaccuugggcugggauccauuacaacccaggaaagcgaguccaauauccuggacauugaucuccggccugcuucugccuggacacuguaugcgguggccaccacguucgucaccccgaugcuucgccauagcaucgaaaacuccucugugaauguuagccugacagcuauugccaaccaggcuaccgugcucaugggccuggggaaaggauggccccuguccaagauggacaucggcgugccucuccuugccaucggguguuacagccaggucaaucccauuacacugaccgcugcccugcuccugcuuguugcgcacuacgccaucauuggaccuggccugcaagcuaaagccacgagagaggcucagaagcgggccgccgcgggcaucaugaaaaaccccacaguggaugggauuaccgugaucgaccucgaaccuaucccguaugaucccaaguuugagaagcagcugggacaggucaugcugcucauucuuugcgugacacaaguucugaugaugcgcaccaccugggcucugugugaggcccucacacuggcuacgggcccuaucucuacccuuugggaagggaaucccggaagauucuggaacacaaccauugccguguccauggccaauaucuuucggggcagcuaccuggcuggggccggacuccuguucucuauuaugaaaaacacaaccaauacgcgcagaggcacaggcaacaucggggagacccugggagaaaaguggaaaucccggcucaacgcgcuuggcaagagcgaguuucagaucuauaaaaagucugggauucaggaggucgaccgcacccuggccaaagaaggaaucaagagaggcgagacagaucaucacgcugugagccggggguccgccaagcugagaugguucgucgaacgcaauauggugaccccugagggaaaaguuguggaccucggcugcggcagagggggauggucuuacuauuguggcgggcugaagaacguccgggaagugaaaggacuuacaaagggcgggcccggacaugaggagccgauuccuaugagcacguacggcuggaaucugguucgccuccaauccggcguggaugucuuuuucacaccgcccgaaaaaugcgacacacugcugugugauaucggggagagcuccccuaaccccaccauugaagcuggacggacacucagagugcuuaaucugguggagaacuggcugaauaacaauacccaguucugcaucaagguucucaacccuuauaugccgucugucaucgaaaagauggaggcccugcagcgcaaauacggcggggcgcuugugcggaauccccugagcagaaacuccacgcacgagauguacugggugucuaaugccaccggaaacauugucagcuccguuaauaugaucucucgcaugcucauuaaccgguuuacaaugaagcacaaaaaggcuaccuaugaaccugacguggaucugggcagcgggacaagaaacaucggaauugaguccgaaauccccaaucuggacauuaucggcaaacgcaucgagaagauuaagcaggaacaugagaccagcuggcacuacgaccaagaucauccuuauaaaacaugggccuaccacggcucuuaugagaccaagcagacgggguccgcuagcucuauggugaacggagucgugcggcuccuuacaaaacccugggacguugugccgauggucacccagauggccaugaccgauacaacgccuuucggccagcaaagaguguuuaaggaaaaaguugacacccgcacacaggagcccaaggaagggaccaagaaacugaugaagaucacagcugaguggcuguggaaagagcucggaaagaaaaagaccccuagaauguguacacgggaagaguucacccgcaaagugagauccaaugccgcgcugggcgccauuuuuacggaugaaaacaaguggaaaagcgcucgggaggccgucgaagacgggagauucugggagcuuguggaucgggagcgcaaucugcaccucgaaggaaaaugcgagaccuguguguacaacaugaugggcaagagagagaagaagcugggcgaguuugggaaagcuaagggaucucgggccaucugguauauguggcugggcgcccgcuuccucgaauuugaggcgcugggguuccuuaaugaggaccauugguuuuccagaggaaacagccuguccggcgucgaaggggagggccuccaccggcugggauacauucuucgcgauguuggcaagaaagaagggggagcuauguacgccgacgauacagccggcugggacaccagaaucacacuggaggaccucaagaaugaagagauggugaccaaccauaugaaaggggagcacaagaaacuggcugaagccaucuucaagcugacguaucagaauaaggugguccgggugcagcgccccacaccuagaggaaccguuauggauauuaucagccggcgcgaccaaagaggcucuggacaggugggcacauacggacucaacaccuuuacgaauauggaggcucagcugauucggcaaauggaaggcgaggggaucuucaaaagcauucagcaucuuaccgccacagaggaaaucgcgguccagaacuggcuggcccgcgugggaagagagcggcucuccagaauggcuaucucuggcgaugacugcguugugaagcccauugaugaccgcuucgccagcgcucugaccgcccuuaaugauauggggaaaguccggaaggacauccagcaaugggaaccguccagaggauggaacgauuggacacaggugccuuuuugcucucaccacuuccaugagcugguuaugaaagacggccgcgugcucgucgugcccugucggaaccaggaugaacugauugggagagcgcgcaucagccagggcgccggauggucccugaaggagaccgcuugccucggcaagucuuaugcccaaauguggacacugauguacuuucaccggagagaccuucgccuggcugccaaugcuauuuguagcgccguccccucccauugggugccuaccagccggacgacauggucuauccacgcgaaacacgaguggaugaccaccgaagauaugcucgccguuuggaacagaguguggauucaggagaauccguggauggaagacaagacacccgucgaguccugggaagaggugccuuaucuggggaaacgcgaggaccaguggugcggaagccuuaucggccugaccucucgggcuacaugggccaagaacauccagacggccauuaaucaagugagaucccucaucgggaacgaagaguacaccgauuauaugcccagcaugaaacgguucagacgcgaagaggaagaggcuggaguucugugguga

SEQ ID NO: 19810 - RNA, 9876 nt, Artificial Sequence
  derived and/or modified CDS sequence (opt5) from DENV-2__FJ478455__SS-prME
accgccggcgugaucguuaugcugauucccaccgcuauggccuuccaccucacgacccggaauggggaaccucauaugaucguuggacggcaggaaaagggcaagagccugcuuuuuaagaccgaagacggggugaauaugugcacccugauggcgauugaucucggagaacugugugaagacacgaucaccuacaaaugcccgcuucugcgccaaaaugaacccgaggauauugacuguuggugcaauuccacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaagaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccgucgugcaggccgacagcggauguguugugucuuggaagaauaaagaacucaagugcggcuccgggaucuucauuacagauaacguccacacguggaccgagcaguacaaguuucaaccugaaagccccuccaaacuggcuucugccauccagaaggcucaugaggaaggcauuuguggaaucagaagcgugacacgccuugagaaucugauguggaaacagaucaccccggagcucaaccacauucuguccgaaaaugagguuaagcugacaaucaugaccggcgacauuaaagggaucaugcaggccggaaagcggucucuuagaccucaacccacggaacucaaauauagcuggaagaccuggggcaaggcgaaaaugcuguccacagagagccauaaccagaccuuccugauugaugggccugaaacaguggagugccccaauaccaaccgcgccuggaacucucucgaggucgaagacuacggauuuggcguguucacaaccaacaucuggcugaaacuucgggagaaacaggacgucuuuugugauuccaagcugaugagcgcugccaucaaagacaauagagcugugcacgccgauaugggcuauuggauugaaucugcgcucaacgacacguggaagauggagaaggccuccuucaucgaggucaaaagcugccacuggccuaagucucauacacuguggagcaauggggugcuggaauccgagaugauuauccccaaaaacuucgcuggaccggugagccagcacaacuaccgcccuggcuaucauacccaaaccgccgggcccuggcaccuuggaaagcucgaaauggauuuugacuucugugagggcacaaccgucguugugacggaagauugcgggaaucggggacccucucugagaacaaccacagcuuccggcaaacugauuaccgaguggugcugucggagcugcacacucccuccgcugcgcuacagaggcgaggacggguguugguacggaauggaaauccggccccuuaaggagaaggaagagaaccuggugaauagccucgucaccgccggccaugggcagauugauaacuuuucucugggagugcugggcauggcccuuuuccucgaagagaugcugagaacgcgcaucgggaccaaacacgcuauccugcucguugcggugagcuuugucacacugauuaccggaaauauguccuuccgggaccuuggcagagugaugguuauggugggcgccacaaugaccgaugacaucgggaugggagucacguaucuggcucuccuggccgccuuuaaggugcgcccuacauucgcugccggccugcuucugagaaaacucaccucuaaggagcugaugauggcgacaauugggaucgcucuccugagccaguccaccauucccgaaaccauccuugagcugacagaugcccucgcccugggaaugaugguucugaaaaucgugcggaacauggaaaaguaccaacuugcugucacgauuauggccaucucuugcgugccuaaugcggugauucugcagaacgcuuggaaggucagcuguaccauccucgccgccguuuccgugagcccccugcuccugacaucuucccagcagaaagcugacuggauuccucuugcccugaccaucaagggccucaaucccacagcuaucuuucugaccacgcugagccgcacaucuaaaaagagauccuggccgcuuaacgaggccauuauggcgguggggauggucagcauccuggccucuucccuccugaaaaaugacauuccuaugaccggaccccucguggcuggcggccugcuuaccguuugcuaugugcugacagggcggagcgccgaucuggaacucgagcgcgcugccgacgucaagugggaggaucaagccgaaaucuccggaagcucuccuauucugagcaucaccauuuccgaggacggcucuaugagcaucaaaaacgaagaggaggaacagacacuuacgauccugauuagaaccgggcuccuggugaucuccggaguuuuccccgugucuauuccgaucacagcugcggccugguaccucugggaggucaagaagcagcgggcuggcgugcugugggaugucccuucucccccucccguggaaaaagccgagcuugaagacggggccuaucgcauuaagcagagaggaauccugggcuacucccaaaucggcgcugggguuuauaaagagggaaccuuucacacaauguggcaugugacccggggcgccguccugaugcaccgcgggaagagaauugagcccuccugggcggaugugaaaaaggaccucaucagcuacggaggcggguggaagcuggaaggagaguggaaagaaggcgaggaaguucaggugcuugcucuggagccuggcaagaauccgcgggccguccagacgaaacccgggauuuucaagaccaacacaggaaccaucggcgccgugucccucgauuuuagcccugggacaucuggaucccccauuguggacagaaaaggcaagguugucgggcuguacggaaauggcguggugacccgcagcggcgcuuaugucucugccaucgcgcagacagagaaguccaucgaagauaacccugagauugaagacgauaucuuccggaaaaagagacucacgauuauggaccugcaucccggggcuggaaaaaccaagcgcuaccuuccugccaucgugcgggaggccauuaaaagaggccugcgcacacugauccucgcuccgacccggguuguggccgcugaaauggaggaggcccugagagggcuucccauucgcuaucaaaccccugcgaucaagacagaacacacgggacgggagaucgucgaccugaugugucaugccaccuucacaaugagacuccugagccccgugcggguuccuaacuacaaucucauuaucauggaugaagcucacuuuaccgaccccgccuccauugcugcccgcggcuauaucucuacaagaguggagaugggggaggccgcuggcauuuucaugaccgcgacgccgccuggaagccgggaucccuuuccccaguccaacgccccuaucauggacgaagaaagagaaauccccgagagaagcuggaacucuggccacgaaugggucacagauuucaaggggaaaaccgugugguuuguuccuuccauuaaggcuggaaacgacaucgccgccugccugcggaaaaauggcaagaaagugauucagcuuagcagaaagaccuucgauucugaguacgucaagacacgcgcuaacgacugggauuuuguggugaccacagacaucagcgagaugggggccaauuucaaagcggaacgggucauugauccgagacgcuguaugaagcccguuauccugaccgacggagaggaacgggugauccuggcuggcccuaugcccgugacgcauuccucugccgcccaaagacgcgggcggauuggcagaaacccuaaaaaugagaacgaccaguauaucuacaugggagaaccccucgagaaugaugaggacugcgcucacuggaaggaagccaaaaugcugcuugauaacauuaauacaccggagggcaucauuccuagcauguuugaacccgagcgcgaaaaggucgacgcgaucgauggggaguacagacugcggggagaggcccgcaaaaccuucguggaccucaugagacggggcgaucugccuguuuggcuggcuuauaagguggccgcugaagggauuaacuacgccgaccgcaagugguguuuugauggaaucaaaaauaaccagauccucgaggaaaacauggaggucgagauuuggacaaaggaaggcgagcgcaagaaacuuaaaccccgguggcuggacgcuagaaucuauuccgauccucuggcccucaaggaguucaaggaguucgcggccgggcgcaaaucucugacccuuaaucugauuacggaaaugggccggcuccccaccuuuaugacacagaaggcuagaaacgcccuggacaaucuggcugugcuccauaccgccgaggccggaggccgcgcuuacaaccacgcgcuuagcgagcugccggaaacacuggagacccuccugcuucugacacuccuggccaccguuacagggggaaucuuccuguuucucauguccggcaaagggauuggaaagaugacacuuggcaugugcugcaucaucaccgcuagcauucugcugugguaugcccaaauccagccucacuggauugccgcuucuaucauucucgaguucuuucugaucgugcuucugauccccgagcccgaaaaacagcggaccccucaggauaaucaacucacauacgucgugauugccauccugaccgucguggcggccacaauggcuaacgagaugggcuuccuggagaagacgaagaaagaccucgggcuuggauccauuaccacacaggaaagcgaguccaauauccuggacauugaucugagaccggccucugcuuggacccucuaugccguugcgacaaccuuugugacgcccaugcugcggcauagcaucgaaaacuccucugugaaugucagccuuaccgccauugcuaaccaggccacaguucugaugggccucgggaagggauggccucuguccaaaauggacaucggcgugccccugcucgcuaucggguguuacagccaggugaauccuauuacccuuacagccgcucugcugcuccuggucgcccacuacgcgaucauuggacccggccuucaagccaaggcuacccgcgaggcccagaaaagagcugccgccggcaucaugaagaacccuacgguggaugggauuacaguuaucgaccuggaaccgauccccuaugauccuaaguucgagaaacagcucggacaggugaugcugcugauucucugcgucacccaagugcuuaugaugcggacaaccugggcgcugugugaggcucugacccucgccacaggccccaucucuacgcugugggaagggaauccuggacgcuuuuggaacaccacaauugcugucuccauggccaauaucuucagaggcagcuaccuugccggggcuggacugcucuuuucuauuaugaagaacaccacauccacccggcgcggcacgggcaauaucggggagacacugggagaaaaauggaaaagcagacugaacgcccucggcaaaucugaguuccagaucuauaagaaaagcgggauucaggagguggaccggacccuugcgaaggaaggaaucaagcgcggcgagaccgaucaucacgccguuuccagagggucugcuaaacugcggugguuuguggaaagaaacauggucacacccgagggaaaggugguugaccugggcugcggccgcgggggauggagcuacuauuguggcgggcucaaaaaugugcgggaagucaagggacugaccaaaggcgggccgggacaugaggagccuauucccauguccacauacggcuggaaccuugugagacugcaaagcggcguggauguuuucuucacgcccccugaaaagugcgacacccuccugugugauaucggggaguccucucccaauccuacaauugaagccggacgcacccugcggguccucaaccuuguggagaauuggcugaacaauaacacacaguuuugcaucaaggugcugaauccguauaugcccagcgucaucgagaagauggaggcucuccagagacaguacggcggggcccugguucgcaacccucuuuccagaaauucuacccacgagauguacugggugagcaacgcgacgggaaauauuguguccucugucaacaugaucagcagaaugcugauuaaucgcuucaccaugaagcacaaaaaggccacauaugaacccgacguggaucucggcuccgggacccggaacaucggaauugagagcgaaaucccuaaccuggacauuaucggcaaaagaaucgagaagauuaagcaagaacaugagaucucuuggcacuacgaccaggaucaucccuauaaaacaugggcuuaccacggcuccuaugagaccaagcagacagggagcgccucuuccaugguuaauggagugguccgccugcucaccaaaccgugggacgugguuccuauggugacgcagauggcuaugacagauaccacccccuuuggccaacagcgggucuucaaggaaaaaguggacacaagaacgcaggagccuaaggaagggaccaagaaacuuaugaagauuacagccgaguggcuguggaaagagcugggaaagaaaaagacaccccgcauguguacaagagaagaguuuacccggaaagugcgcagcaacgcugcccucggcgcgaucuucacagaugaaaauaaguggaagucugccagagaggcugucgaagacgggcgguuuugggagcugguugauagagagcggaaccuucaccuggaaggaaaaugcgagaccuguguguacaauaugaugggcaagcgcgagaagaagcucggcgaguucgggaaagccaagggauccagagcuauuugguauauguggcugggcgcccgguuucuggaguucgaggcccucggguuucugaacgaggaccauugguucagccgcggaaauucccuuagcggcguggaaggggagggccugcacagacucggauacauccugcgggaugucggcaagaaagaagggggagcgauguacgcugacgauacggccggcugggacacccgcaucacacuugaggaccugaagaacgaagagauggugaccaaucauaugaaaggggagcacaagaaacucgccgaagcuauuuuuaagcugacauaucagaacaagguugugagaguccaacggccuacaccccgcggaacggugauggauaucauuucuagacgggaccagcgcggcagcgggcagguuggcacauacggacugaauaccuucacaaacauggaggcccaacucaucagacagauggaaggcgaggggauuuucaaauccauccagcaucugaccgcuacggaggaaaucgccgugcagaauuggcuugcgcgggucggacgcgagagacugucucggauggccauuagcggcgaugacugcgugguuaagccgaucgaugacagauuugcuuccgcccucaccgcucugaacgauauggggaaagugcgcaaggacauucaacagugggaaccuucucggggauggaaugauuggacacagguccccuucugcagccaccacuuucaugagcuugugaugaaagacggcagaguccuggugguucccugucgcaaccaggaugaacucaucgggcgggccagaauuucccaaggcgcgggauggucucugaaggagaccgccugccugggcaagagcuaugcucagauguggacacucauguacuuccaccgccgggaccugagacuugccgcuaacgccaucuguuccgcugugccuagccauugggucccgaccucucgcacaaccugguccauucacgccaaacacgaguggaugacgacagaagauaugcuggcgguguggaaucggguguggauccaggagaaccccuggauggaagacaagaccccuguugagagcugggaagaggugcccuaucucgggaaaagagaggaccaguggugcggaucucugaucggccuuaccucccgcgccacaugggcuaagaauauucaagccgccaucaaccagguccggagccugauugggaaugaagaguacaccgauuauaugccuuccaugaaaagauuucggagagaagaggaagaggcuggagugcucugguga

SEQ ID NO: 19811 - RNA, 9876 nt, Artificial Sequence
  derived and/or modified CDS sequence (opt5) from DENV-2__EU482756__SS-prME
accgccggcgugaucgucaugcugauucccacagcuauggccuuccaccucacgaccagaaauggggaaccucauaugaucguuggacggcaggaaaagggcaagagccugcuuuuuaagaccgaggacggggugaauaugugcacccugauggcgauugaucucggagaacugugugaggacacaaucaccuacaagugcccccuucugcgccaaaaugaacccgaggauauugacuguuggugcaauagcacaucuaccugggugacguauggcaccuguacaaccacaggggagcacagacgggaaaagcgcagcgucgcucucgugccucauguuggaaugggccuggagaccagaacggaaacauggauguccucugagggcgccuggaaacacgugcagcggaucgagaccuggauccugcgccaucccggguucacaauuauggccgcuauccucgccuacaccauuggaaccacacacuuucagagagcucugaucuucauucuucugacggccgucgcgccuagcaugaccaugcggugcaucggcauuuccaaccgcgauuuuguggaagggguuucuggaggcagcuggguggacaucguccucgagcacggguccugugugacaaccauggccaagaauaagcccacacuggauuucgaacuuaucaaaaccgaggcuaagcagccugccacgcugagaaaauauugcauugaagcuaagcucacaaacaccaccacagagagccgguguccgacccaaggagagcccucucugaaugaggaacaggacaaacgcuuuaucugcaagcauuccaugguggauagaggcuggggcaacggguguggacuguucggcaaagggggaauugucacaugcgccauguuuacgugcaaaaagaauauggaaggcaaaguugugcagccugagaaccucgaauacaccaucgugauuacaccccacagcggggaggagcaugcggucggaaaugacaccggcaagcacggcaaagaaaucaagaucacaccucagucuuccauuaccgaggccgaacugacgggguauggaaccgugacaauggaguguagcccccggaccggccuugauuucaacgaaaugguucugcuccaaauggaggacaaggcuuggcuggugcaccgccagugguuucuugaucugccgcucccuuggcugcccggggccgacacacagggaucuaauuggauccagaaggagacccuggucacguucaagaacccucaugcuaaaaagcaagacgugguugugcucggcucccaggaaggggccaugcacacagcccugaccggcgcuacagagauucagaugagcuccggaaaucuucuguuuaccggccaucucaaaugcagacugcggauggauaaacuucaacugaaagggaugucuuacagcauguguaccggaaaguucaagaucgucaaagaaauugcggagacacagcacggcacgaucgugaucagaguccaguaugagggggacggaucccccugcaagauucccuucgaaaucaccgaucucgagaaacgccaugugcugggccggcugauuacaguuaacccuaucgugaccgaaaaggacagcccggucaacauugaggccgaacccccuuuuggggauucuuacaucauuaucggcguggagcccggacagcucaaacugaauugguucaagaagggcuccagcaucgggcaaauguuugagacaaccaugagaggagcuaaacgcauggccauucuuggcgacacggccugggauuucgggucucugggaggcguuuuuacaagcaucgggaaggcucuccaccagguguucggcgccauuuacggagcggcuuuuuccggcgucucuuggaccaugaaaauccugauuggggugaucaucaccuggauuggaaugaacagccgguccacaagccugucugugucccuuguucucgucggcguggugacccuguaucugggggccaugguccaggccgacagcggaugugugguuucuuggaagaauaaagaacucaagugcggcuccgggaucuucauuacagauaacgugcacacguggaccgagcaguacaaguuucaaccugaaagccccuccaaacuggcuucugccauccagaaggcucaugaggaaggcauuuguggaaucagaagcgucacacgccuugagaaucugauguggaaacagaucaccccggagcucaaccacauucuguccgaaaaugaggugaagcugacaaucaugaccggcgacauucgggggaucaugcaggccggaaaaagaucucuucgcccucaacccacggaacucaaguauagcuggaaaaccuggggcaaggcgaagaugcuguccacagagagccauaaccagaccuuccugauugaugggccugaaacagccgagugccccaauaccaaccgggcuuggaacucucucgagguugaagacuacggauuuggcguguucacaaccaacaucuggcugaaacuuagagagaagcaggacgucuuuugugauuccaaacugaugagcgccgcuaucaaggacaaucgcgccgugcacgcggauaugggcuauuggauugaaucugcccucaacgacacguggaaaauggagaaggcuuccuucaucgagguuaagagcugccacuggccuaaaucucauacacuguggagcaauggggugcuggaauccgagaugauuauccccaagaacuucgccggaccggucagccagcacaacuaccggccuggcuaucauacccaaaccgcugggcccuggcaccuuggaaaacucgaaauggauuuugaccugugugagggcacaaccgugguggucacggaagauugcgggaauagaggacccucucugcggacaaccacagccuccggcaagcucauuaccgaguggugcugucgcagcugcacacugccuccgcuuagauaccggggcgaggacggguguugguacggaauggaaaucagaccccugaaagagaaggaagagaaccucguuaauucccuggugaccgccggccaugggcagauugauaacuucucucugggagugcuuggcauggcucucuuucuggaagagaugcugcgcacgcggaucgggaccaaguaugcgauccuccuggucgccgugagcuucguuacacuuauuaccggaaauauguccuuuagagaccugggccgcgugauggucauggugggcgcuacaaugaccgaugacaucgggaugggaguuacguaccucgcccugcuggccgcuuucaaagugagaccuacauuugccgcgggccuucugcuccggaagcugaccucuaaagagcucaugauggcuacaauugggaucgcccugcuuagccaguccaccauucccgaaaccauccuggagcucacagaugcccuggcucugggaaugaugguccuuaagaucgugcgcaacauggaaaaauaucaacuggccguuacgauuauggcgaucucuugcgugccuaaugcugucauucuccagaacgccuggaaggugagcuguaccauccuggccgcuguguccgucagcccccuccugcuuacaucuucccagcagaaggccgacuggauuccucuggcucucaccaucaaaggccugaaucccacagccaucuuccugaccacgcuuagcagaacaucuaagaaacgguccuggccgcugaacgaggcgauuauggccguugggauggugagcauccucgcuucuucccugcucaagaaugacauuccuaugaccggaccccugguggccggcggccuucugaccgucugcuacgugcugacagggcgcagcgcugaucucgaacuggagagagccgccgacguuaaaugggaggaucaagcugaaaucuccggaagcucuccuauucuuagcaucaccauuuccgaggacggcucuaugagcaucaagaacgaagaggaggaacagacacugacgauccucauucggaccgggcugcucgugaucuccggagucuuucccgugucuauuccgaucacagcggccgcuugguaucugugggagguuaaaaagcagcgcgccggcgugcuuugggaugucccuucucccccucccguggaaaaggccgagcuggaagacggggcuuacagaauuaaacagcggggaauccugggcuauucccaaaucggcgccggggucuacaaggagggaaccuuccacacaauguggcacgugacccgcggcgcgguucucaugcauagagggaaacggauugagcccuccugggcugaugugaagaaagaccugaucagcuacggaggcggguggaaacuugaaggagaguggaaggaaggcgaggaaguccaggugcuggcccucgagccuggcaaaaauccgagagccguucagacgaagcccgggauuuuuaaaaccaacacaggaaccaucggcgcugugucccuggauuucagcccugggacaucuggaucccccauugucgaccgcaagggcaaagugguggggcucuauggaaauggcguugucacccggagcggcgccuacgugucugcgaucgcucagacagagaaguccaucgaagauaacccugagauugaagacgauaucuuuagaaagaaacgccugacgauuauggaccuucaccccggggccggaaagaccaaacgguaucugccugccaucgugagagaggcuauuaagcgcggccugcggacacucauccuggccccgaccagagucguggcugccgaaauggaggaggcgcuucgcgggcugcccauucgguaccaaaccacagccaucaaaacggaacauaccggaagagagaucguugaccucaugugucacgcuacauucaccaugcggcugcucagcccugugcgcguccccaacuauaaucugauuaucauggaugaagcccauuucacagacccugcuuccauugccgccagaggcuacaucucuacccggguggagaugggggaggcugcgggcauuuuuaugacggccacacccccgggaagccgcgauccuuucccccaguccaacgcucccaucauggacgaagagagagaaaucccugagcggagcuggaacucuggccacgaauggguuaccgauuuuaaggggaagaccgugugguucguccccuccauuaaagccggaaacgacaucgccgcuugccuuagaaagaauggcaaaaaggugauucagcugagccgcaaaacauuugauucugaguauguuaagacccgggccaacgacugggauuucguggucacaaccgacaucagcgagaugggggcgaauuuuaaggcugaaagagugauugauccucgccgguguaugaaaccggugauccugacggacggagaggaaagagucauccucgccggccccaugccuguuacacacuccucugccgcucaacgccgggggagaauuggccgcaaccccaagaaugagaacgaccaguacaucuacaugggagaaccucuggagaaugaugaggacugcgcccauuggaaagaagcgaagaugcuucuggauaacauuaauacccccgagggcaucauuccgagcauguucgaaccugagagagaaaaaguggacgccaucgauggggaguaucggcuccgcggagaggcuagaaagacauuuguggaccugaugcggcgcggcgaucugcccgucuggcucgccuacaaaguggcugccgaagggauuaacuaugcugacagaaagugguguuucgauggaaucaagaauaaccagauccuugaggaaaacauggagguugagauuuggaccaaagaaggcgagcggaagaaacugaagccuagauggcuggacgcccgcaucuacuccgauccccucgcgcugaaagaauuuaaggaguucgccgcugggcggaagucucuuacgcugaaucucauuaccgaaaugggcagacugccuacauucaugacccagaaagcccgcaacgcucuggacaaucucgccgugcuucacacagccgaggcuggaggccgggcguauaaccaugcccugagcgagcugcccgaaacccucgagacacugcuucugcucacccugcuggcuacggucacagggggaaucuuucucuuccuuauguccggcaaggggauuggaaaaaugacccugggcaugugcugcaucaucaccgccagcauucugcucugguacgcccaaauccagccgcacuggauugcugccucuaucauucuggaauuuuuccuuaucgugcugcucaucccugagcccgaaaagcagagaacaccccaggauaaucaacugaccuauguugugauugcgauccugacagucguggccgcuacgauggccaacgagaugggcuuucucgagaaaaccaagaaggaccuugggcugggauccauuacaacccaggaaagcgaguccaauauccuggacauugaucuccggccugcuucugccuggacacuguacgcggucgccaccacguucgugaccccgaugcuucgccacagcaucgaaaacuccucuguuaaugugagccugacagcuauugccaaccaggcuaccgugcucaugggccuggggaaaggauggccccuguccaagauggacaucggcgucccucuccuugccaucggguguuacagccagguuaaucccauuacacugaccgcugcccugcuccugcuuguggcgcauuaugccaucauuggaccuggccugcaagcuaaagccacgagagaggcucagaagcgggccgccgcgggcaucaugaaaaaccccacaguggaugggauuaccgucaucgaccucgaaccuaucccguacgaucccaaguuugagaagcagcugggacaggugaugcugcucauucuuugcguuacacaagugcugaugaugcgcaccaccugggcucugugugaggcccucacacuggcuacgggcccuaucucuacccuuugggaagggaaucccggaagauucuggaacacaaccauugccgucuccauggccaauaucuuucggggcagcuaucuggcuggggccggacuccuguucucuauuaugaaaaacacaaccaauacgcgcagaggcacaggcaacaucggggagacccugggagaaaaguggaaaucccggcucaacgcgcuuggcaagagcgaguuucagaucuacaaaaagucugggauucaggagguggaccgcacccuggccaaagaaggaaucaagagaggcgagacagaucaccaugcugucagccggggguccgccaagcugagaugguucguggaacgcaauaugguuaccccugagggaaaaguggucgaccucggcugcggcagagggggauggucuuauuacuguggcgggcugaagaacgugcgggaaguuaaaggacuuacaaagggcgggcccggacacgaggagccgauuccuaugagcacguauggcuggaaucuggugcgccuccaauccggcgucgauguguuuuucacaccgcccgaaaaaugcgacacacugcugugugauaucggggagagcuccccuaaccccaccauugaagcuggacggacacucagagugcuuaaucugguugagaacuggcugaauaacaauacccaguucugcaucaagguccucaacccuuacaugccgucugugaucgaaaagauggaggcccugcagcgcaaauacggcggggcgcuugugcggaauccccugagcagaaacuccacgcaugagauguauugggucucuaaugccaccggaaacauuguuagcuccgugaauaugaucucucgcaugcucauuaaccgguuuacaaugaagcacaaaaaggcuaccuacgaaccugacguggaucugggcagcgggacaagaaacaucggaauugaguccgaaauccccaaucuggacauuaucggcaaacgcaucgagaagauuaagcaggaacacgagaccagcuggcauuaugaccaagaucacccuuacaaaacaugggccuaucauggcucuuacgagaccaagcagacgggguccgcuagcucuauggucaacggagugguucggcuccuuacaaaacccugggacguggucccgauggugacccagauggccaugaccgauacaacgccuuucggccagcaaagaguuuuuaaggaaaaaguggacacccgcacacaggagcccaaggaagggaccaagaaacugaugaagaucacagcugaguggcuguggaaagagcucggaaagaaaaagaccccuagaauguguacacgggaagaguucacccgcaaagucagauccaaugccgcgcugggcgccauuuuuacggaugaaaacaaguggaaaagcgcucgggaggccguggaagacgggagauucugggagcuuguggaucgggagcgcaaucugcaccucgaaggaaaaugcgagaccugugucuauaacaugaugggcaagagagagaagaagcugggcgaguuugggaaagcuaagggaucucgggccaucugguacauguggcugggcgcccgcuuccucgaauuugaggcgcugggguuccuuaaugaggaccacugguuuuccagaggaaacagccuguccggcguugaaggggagggccuccaucggcugggauacauucuucgcgaugugggcaagaaagaagggggagcuauguaugccgacgauacagccggcugggacaccagaaucacacuggaggaccucaagaaugaagagauggugaccaaccacaugaaaggggagcauaagaaacuggcugaagccaucuucaagcugacguaccagaauaaggucgugcggguucagcgccccacaccuagaggaaccgugauggauauuaucagccggcgcgaccaaagaggcucugggcaggucggcacauauggacucaacaccuuuacgaauauggaggcucagcugauucggcaaauggaaggcgaggggaucuucaaaagcauucagcaccuuaccgccacagaggaaaucgcggugcagaacuggcuggcccgcguuggaagagagcggcucuccagaauggcuaucucuggcgaugacugcguggucaagcccauugaugaccgcuucgccagcgcucugaccgcccuuaaugauauggggaaagugcggaaggacauccagcaaugggaaccguccagaggauggaacgauuggacacagguuccuuuuugcucucaucacuuccacgagcuggugaugaaagacggccgcguccucgugguccccugucggaaccaggaugaacugauugggagagcgcgcaucagccagggcgccggauggucccugaaggagaccgcuugccucggcaagucuuacgcccaaauguggacacugauguauuuucaucggagagaccuucgccuggcugccaaugcuauuuguagcgccgugcccucccacuggguuccuaccagccggacgacauggucuauccaugcgaaacacgaguggaugaccaccgaagauaugcucgccguguggaacagagucuggauucaggagaauccguggauggaagacaagacacccguggaguccugggaagaggugccuuaccuggggaaacgcgaggaccaguggugcggaagccuuaucggccugaccucucgggcuacaugggccaagaacauccagacggccauuaaucaaguuagaucccucaucgggaacgaagaguauaccgauuacaugcccagcaugaaacgguucagacgcgaagaggaagaggcuggagugcugugguga
